US009487797B2

(12) United States Patent
Boukharov et al.

(10) Patent No.: US 9,487,797 B2
(45) Date of Patent: Nov. 8, 2016

(54) GENOMIC PLANT SEQUENCES AND USES THEREOF

(75) Inventors: Andrey A. Boukharov, Chesterfield, MO (US); Yongwei Cao, Lexington, MA (US); Stanton B. Dotson, Chesterfield, MO (US); Jeffrey M. Koshi, Cambridge, MA (US); David K. Kovalic, University City, MO (US); Jingdong Liu, Ballwin, MO (US); James D. McIninch, Burlington, MA (US); Wei Wu, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 405 days.

(21) Appl. No.: 13/373,133

(22) Filed: Nov. 4, 2011

(65) Prior Publication Data
US 2014/0130204 A1    May 8, 2014

Related U.S. Application Data

(60) Continuation of application No. 11/834,317, filed on Aug. 6, 2007, now Pat. No. 8,058,516, which is a continuation-in-part of application No. 11/595,983, filed on Nov. 13, 2006, now Pat. No. 7,790,958, which is a division of application No. 09/815,264, filed on Mar. 23, 2001, now Pat. No. 7,365,185, which is a continuation-in-part of application No. 09/702,134, filed on Oct. 31, 2000, now abandoned, and a continuation-in-part of application No. 09/620,392, filed on Jul. 19, 2000, now abandoned.

(60) Provisional application No. 60/144,351, filed on Jul. 20, 1999.

(51) Int. Cl.
*C12N 15/82* (2006.01)
*C07K 14/415* (2006.01)

(52) U.S. Cl.
CPC ......... *C12N 15/8286* (2013.01); *C07K 14/415* (2013.01); *C12N 15/8227* (2013.01); *C12N 15/8243* (2013.01); *C12N 15/8247* (2013.01); *C12N 15/8274* (2013.01); *C12N 15/8279* (2013.01)

(58) Field of Classification Search
None
See application file for complete search history.

(56) References Cited

U.S. PATENT DOCUMENTS

| 4,784,949 | A | 11/1988 | Gelfand et al. | 435/68 |
|---|---|---|---|---|
| 4,956,282 | A | 9/1990 | Goodman et al. | 435/69.51 |
| 5,011,912 | A | 4/1991 | Hopp et al. | 530/387 |
| 6,093,545 | A | 7/2000 | Goodearl et al. | 435/6 |
| 6,194,636 | B1 | 2/2001 | McElroy et al. | 800/278 |
| 7,365,185 | B2 * | 4/2008 | Boukharov et al. | 536/24.1 |
| 7,427,676 | B2 * | 9/2008 | Hatzfeld et al. | 536/24.1 |
| 7,553,954 | B2 | 6/2009 | Andersen et al. | 435/6 |
| 7,557,201 | B2 | 7/2009 | Fincher et al. | 536/23.6 |
| 7,560,542 | B2 | 7/2009 | Andersen et al. | 536/23.6 |
| 7,572,902 | B2 | 8/2009 | Abad et al. | 536/23.6 |
| 7,625,738 | B1 | 12/2009 | CaJacob et al. | 435/232 |
| 7,655,777 | B2 | 2/2010 | Bhat et al. | 536/23.1 |
| 7,790,958 | B2 | 9/2010 | Boukharov et al. | 800/298 |
| 7,868,149 | B2 | 1/2011 | Boukharov et al. | 536/23.1 |
| 7,872,172 | B2 | 1/2011 | Frankard | |
| 8,847,015 | B2 | 9/2014 | Hatzfeld et al. | |
| 2004/0034888 | A1 | 2/2004 | Liu et al. | 536/23.1 |
| 2006/0253933 | A1 | 11/2006 | Brown et al. | 435/6 |
| 2006/0265782 | A1 | 11/2006 | Hinkle et al. | 800/278 |
| 2007/0011783 | A1 | 1/2007 | Liu et al. | 800/278 |
| 2007/0016974 | A1 | 1/2007 | Byrum et al. | 800/278 |
| 2007/0039076 | A1 | 2/2007 | Boukharov et al. | 435/6 |
| 2007/0067865 | A1 | 3/2007 | Kovalic et al. | 435/6 |
| 2007/0083945 | A1 | 4/2007 | Byrum et al. | 536/23.1 |
| 2007/0143878 | A1 | 6/2007 | Bhat et al. | 435/6 |
| 2007/0150978 | A1 | 6/2007 | Byrum | 536/23.1 |
| 2008/0008996 | A1 | 1/2008 | Byrum | 435/6 |
| 2008/0072354 | A1 | 3/2008 | Byrum et al. | 435/6 |
| 2008/0114160 | A1 | 5/2008 | Boukharov et al. | 536/23.6 |
| 2008/0120751 | A1 | 5/2008 | Andersen et al. | 435/6 |
| 2008/0127376 | A1 | 5/2008 | Fincher et al. | 536/23.6 |
| 2008/0227639 | A1 | 9/2008 | Wu et al. | 800/298 |
| 2008/0256663 | A1 | 10/2008 | Andersen et al. | 536/23.1 |

FOREIGN PATENT DOCUMENTS

WO    WO 00/18922    4/2000

OTHER PUBLICATIONS

Buell et al, 2002, GenBank Accession No. AC020666, http://www.ncbi.nlm.nih.gov/nuccore/AC020666.*
Wing et al, 1999, GenBank Accession No. AQ051230, http://www.ncbi.nlm.nih.gov/nucgss/AQ051230.*
U.S. Appl. No. 09/620,392, filed Jul. 19, 2000, Boukharov et al.
U.S. Appl. No. 11/329,175, filed Jan. 11, 2006, CaJacob et al.
U.S. Appl. No. 11/329,388, filed Jan. 11, 2006, Andersen et al.
U.S. Appl. No. 11/330,082, filed Jan. 11, 2006, Buehler et al.
U.S. Appl. No. 11/330,364, filed Jan. 12, 2006, Abad et al.
U.S. Appl. No. 11/331,019, filed Jan. 13, 2006, Fincher et al.
U.S. Appl. No. 11/353,150, filed Feb. 14, 2006, Andersen et al.

(Continued)

*Primary Examiner* — Anne Kubelik

(74) *Attorney, Agent, or Firm* — Dentons US LLP; Carine M. Doyle, Esq.

(57) ABSTRACT

The present invention discloses rice genomic promoter sequences. The promoters are particularly suited for use in rice and other cereal crops. Methods of modifying, producing, and using the promoters are also disclosed. The invention further discloses compositions, transformed host cells, transgenic plants, and seeds containing the rice genomic promoter sequences, and methods for preparing and using the same.

22 Claims, No Drawings

(56) References Cited

OTHER PUBLICATIONS

U.S. Appl. No. 11/595,983.
U.S. Appl. No. 11/834,317, filed Aug. 6, 2007, Wu et al.
Aach et al., "ent-kaurene biosynthesis in a cell-free system from wheat (*Triticum aestivum* L.) seedlings and the localization of ent-kaurene synthetase in plastids of three species," *Planta*, 197(2):333-342, 1995.
Adams et al., "Complementary DNA sequencing: expressed sequence tags and human genome project," *Science*, 252(5013):1651-1656, 1991.
Ait-Ali et al., "The LS locus of pea encodes the gibberellin biosynthesis enzyme ent-kaurene synthase A," *Plant J.*, 11(3):443-454, 1997.
Anaviev et al., "Oat-maize chromosome addition lines: a new system for mapping the maize genome," *Proc. Natl. Acad. Sci. USA*, 94:3524-3529, 1997.
Anton et al., "Sequencing and overexpression of the *escherichia coli* aroE gene encoding shikimate dehydrogenase," *Biochem. J.*, 249:319-326, 1988.
Attwood, "The babel of bioinoformatics," *Science*, 290(5491):471-473, 2000.
Benfey et al., "The CaMV 35S enhancer contains at least two domains which can confer different developmental and tissue-specific expression patterns," *EMBO J.*, 8(8):2195-2202, 1989.
Benfey et al., "The cauliflower mosaic virus 35S promoter: combinatorial regulation of transcription in plants," *Science*, 250:959-966, 1990.
Bensen, et al., "Cloning and characterization of the maize An1 gene," *Plant Cell*, 7:75-84, 2004.
Bentley, "The shikimate pathway—a metabolic tree with many branches," *Critical Rev. Biochem. Mol. Biol.*, 25(5):307-384, 1990.
Birkenbihl et al., "Cosmid-derived map of *E. coli* strain BHE2600 in comparison to the map of strain W3110." *Nucleic Acids Res.*, 17(13):5057-5069, 1989.
Bishop et al., "The tomato dwarf gene isolated by heterologous transposon tagging encodes the first member of a new cytochrome P450 family," *Plant Cell*, 8:959-969, 1996.
Bonner et al., "Cloning of cDNA encoding the bifunctional dehydroquinase-shikimate dehydrogenease of aromatic-amino-acid biosynthesis in nicotiana tabacum," *Biochem. J.*, 362:11-14, 1994.
Bork, "Powers and pitfalls in sequence analysis: the 70% hurdle," *Genome Res.*, 10:398-400, 2000.
Bougri et al., "Members of a low-copy number gene family encoding glutamyl-tRNA reductase are differentially expressed in barley," *Plant J.*, 9(6):867-878, 1996.
Broun et al., "Catalytic plasticity of fatty acid modification enzymes underlying chemical diversity of plant lipids," *Science*, 282:1315-1317, 1998.
Bukanov et al., "Ordered cosmid library and high-resolution physical-genetic Aap of helicobacter pylori strain NCTC11638," *Mol. Microbiol.*, 11(3):509-523, 1994.
Charles et al., "Isolation, characterization and nucleotide sequences of the aroC genes encoding chorismate synthase from *Salmonella typhi* and *Escherichia coli*," *J. Gen. Microbiol.*, 136:353-358, 1990.
Chen et al., "Microcolinearity in sh2-homologous regions of the maize, rice, and sorghum genomes," *Proc. Natl. Acad. Sci. USA*, 94:3431-3435, 1997.
Cho et al., "Regulation of root hair initiation and expansin gene expression in arabidopsis," *The Plant Cell*, 14:3237-3253, 2002.
Coulson et al., "Toward a physical map of the genome of the nematode caenorhabditis elegans," *Proc. Natl. Acad. Sci. USA*, 83:7821-8725, 1986.
Day et al., "Cloning of the cDNA for glutamyl-tRNA synthetase from arabidopsis thaliana," *Biochim. Biophys. Acta*, 1399(2-3):219-224, 1998.
Donald et al., "Mutation of either G box of I box sequences profoundly affects expression from the arabidopsis rbcS-1A promoter," *EMBO J.*, 9(6):1717-1726, 1990.

Duncan et al., "The overexpression and complete amino acid sequence of *escherichia coli* 3-dehydroquinase," *Biochem. J.*, 238:475-483, 1986.
Eberhard et al., "Cloning and expression in yeast of a higher plant chorismate mutase," *FEBS Letters*, 334(2):233-236, 1993.
Ebert et al., "Identification of an essential upstream element in the nopaline synthase promoter by stable and transient assays," *Proc. Natl. Acad. Sci. USA*, 84(16):5745-5749, 1987.
Efstratiadis et al., "Enzymatic in vitro synthesis of globin genes," *Cell*, 7:279-288, 1976.
Eiglmeier et al., "Use of an ordered cosmid library to deduce the genomic organization of *mycobacterium leprae*," *Mol. Microbiol.*, 7(2):197-206, 1993.
Entrez Accession No. 1213067, dated Mar. 1, 1996.
Entrez Accession No. 1220402, dated Mar. 5, 1996.
Entrez Accession No. 1421741, dated Oct. 17, 1996.
Entrez Accession No. 1524045, dated Aug. 20, 1997.
Entrez Accession No. 153878, dated Jun. 15, 1990.
Entrez Accession No. 170374, dated Sep. 15, 1989.
Entrez Accession No. 2160544, dated Jun. 5, 1997.
Entrez Accession No. 2224890, dated Jul. 31, 1997.
Entrez Accession No. 2224892, dated Jul. 31, 1997.
Entrez Accession No. 2257714, dated Jul. 15, 1997.
Entrez Accession No. 2316104, dated Aug. 8, 1997.
Entrez Accession No: 2708690, dated May 7, 1998.
Entrez Accession No. 3068709, dated Apr. 2 1998.
Entrez Accession No. 3080490, dated Jan. 12, 1999.
Entrez Accession No. 3093410, dated Oct. 1, 1998.
Entrez Accession No. 313150, dated Jun. 13, 1995.
Entrez Accession No. 3135277, dated May 16, 1998.
Entrez Accession No. 3288821, dated Jul. 20, 1998.
Entrez Accession No. 3420233, dated Apr. 20, 1998.
Entrez Accession No. 3435196, dated Sep. 21, 1998.
Entrez Accession No. 3694811, dated Sep. 24, 1998.
Entrez Accession No. 3925407, dated Nov. 24, 1998.
Entrez Accession No. 4001680, dated Dec. 11, 1998.
Entrez Accession No. 40973, dated Jul. 12, 1995.
Entrez Accession No. 40978, dated Sep. 12, 1993.
Entrez Accession No. 429153, dated Dec. 2, 1993.
Entrez Accession No. 474964, dated Jul. 27, 1995.
Entrez Accession No. 48906, dated Jun. 30, 1993.
Entrez Accession No. 520943, dated Feb. 26, 1997.
Entrez Accession No. 551666, dated Jan. 25, 1995.
Entrez Accession No. 551855, dated Apr. 12, 1995.
Entrez Accession No. 987267, dated Jul. 31, 1995.
Entrez Accession No. AAC17095; GI:315616, dated Apr. 5, 1999.
Entrez Accession No. AB011416, dated Feb. 5, 1999.
Entrez Accession No. AB015492, dated Dec. 11, 1998.
Entrez Accession No. AC003058, dated May 16, 1998.
Entrez Accession No. AF010169, dated Aug. 9, 1997.
Entrez Accession No. AF017431, dated Jan. 2, 1999.
Entrez Accession No. AF038152, dated May 7, 1998.
Entrez Accession No. AF049236, dated Apr. 22, 1998.
Entrez Accession No. AF058763, dated Aug. 16, 1998.
Entrez Accession No. AF060481, dated Oct. 4, 1998.
Entrez Accession No. AF063901, dated Jul. 21, 1998.
Entrez Accession No. AF067773, dated Sep. 22, 1998.
Entrez Accession No. AF083948, dated Nov. 25, 1998.
Entrez Accession No. AJ225107, dated Oct. 1, 1998.
Entrez Accession No. AL022602, dated Jan. 12, 1999.
Entrez Accession No. AP000836; GI:6539551, dated Aug. 12, 2000.
Entrez Accession No. AY013245, dated May 7, 2002.
Entrez Accession No. D63474 D16312, dated Jul. 27, 1995.
Entrez Accession No. D88382, dated Mar. 17, 1998.
Entrez Accession No. M21071 J03227, dated Sep. 15, 1989.
Entrez Accession No. M27715, dated Jun. 15, 1990.
Entrez Accession No. M63245, dated Mar. 11, 1996.
Entrez Accession No. M87280 M99707, dated Apr. 12, 1995.
Entrez Accession No. U32579, dated Sep. 16, 1995.
Entrez Accession No. U54770, dated Oct. 18, 1996.
Entrez Accession No. U61385, dated Aug. 1, 1997.
Entrez Accession No. U61386, dated Aug. 1, 1997.
Entrez Accession No. U63652, dated Jun. 6, 1997.

(56) References Cited

OTHER PUBLICATIONS

Entrez Accession No. U93215, dated Jul. 15, 1997.
Entrez Accession No. W49458, dated May 28, 1996.
Entrez Accession No. X04306, dated Jul. 12, 1995.
Entrez Accession No. X59509 S55160, dated Jun. 30, 1993.
Entrez Accession No. X73535, dated Jun. 13, 1995.
Entrez Accession No. X81413, dated Jan. 25, 1995.
Entrez Accession No. X82831, dated Mar. 1, 1996.
Entrez Accession No. X86101, dated Nov. 8, 1996.
Entrez Accession No. X96943, dated Aug. 20, 1997.
Entrez Accession No. Y00710, dated Sep. 12, 1993.
Entrez Accession No. Y12809, dated Dec. 2, 1997.
Entrez Accession No. Z26519, dated Dec. 2, 1993.
EST Database AA501409, dated Aug. 19, 1997.
Evans et al., "Immunodetection of recombinant proteins based on antibodies directed against a metal binding peptide engineered for purification by immobilized metal affinity chromatography," *J. Immunol. Meth.*, 156(2):231-238, 1992 (Abstract only).
Fiedler et al., "The formation of homogentisate in the biosynthesis of tocopherol and plastoquinone in spinach chloroplast," *Planta*, 155:511-515, 1982.
Fukuzawa et al., "The rice metallothionein gene promoter does not direct foreign gene expression in seed endosperm," *Plant Cell Rep.*, 23:231-235, 2004.
Garbe et al., "The *mycobacterium* tuberculosis shikimate pathway genes: evolutionary relationship between biosynthetic and catabolic 3-dehydroquinases," *Mol. Gen. Genet.*, 228:385-392, 1991.
Gasser et al., "Structure, expression and evolution of the 5-enolpyruvylshikimate-3-phonsphate synthase genes of petunia and tomato," *J. Biol. Chem.*, 263:4280-4289, 1988.
Gaubier et al., "A chlorophyll synthetase gene from arabidopsis thaliana," *Mol. Gen. Genet.*, 249:58-64, 1995.
GenBank Accession No. AC005922, dated Nov. 14, 1998.
GenBank Accession No. AC018632, dated Dec. 15, 1999.
GenBank Accession No. AF015462, dated Jul. 16, 1998.
GenBank Accession No. AI834598, dated Feb. 2, 2000.
GenBank Accession No. AI861202, dated Jul. 19, 1999.
GenBank Accession No. AK105219, dated Feb. 16, 2008.
GenBank Accession No. AK243071, dated Feb. 16, 2008.
GenBank Accession No. AK243301, dated Feb. 16, 2008.
GenBank Accession No. AK287615, dated Feb. 16, 2008.
GenBank Accession No. AK288523, dated Feb. 16, 2008.
GenBank Accession No. AK288568, dated Feb. 16, 2008.
GenBank Accession No. AL731784, dated Jan. 16, 2006.
GenBank Accession No. AL772425, dated Jan. 16, 2006.
GenBank Accession No. AL845346, dated Jan. 16, 2006.
GenBank Accession No. AP008218, dated May 19, 2007.
GenBank Accession No. AQ257482, dated Oct. 23, 1998.
GenBank Accession No. AQ402486, dated Mar. 13, 1999.
GenBank Accession No. AU033328, dated Apr. 28, 1999.
GenBank Accession No. AW871780, dated Dec. 11, 2001.
GenBank Accession No. AZ134591, dated Jun. 2, 2000.
GenBank Accession No. BE428765, dated Jul. 26, 2000.
GenBank Accession No. BF542512, dated Dec. 11, 2000.
GenBank Accession No. BQ603510, dated Jun. 24, 2002.
GenBank Accession No. BX513761, dated May 27, 2003.
GenBank Accession No. CT829024, dated Apr. 8, 2008.
GenBank Accession No. CT831683, dated Apr. 8, 2008.
GenBank Accession No. CT831684, dated Apr. 8, 2008.
GenBank Accession No. CT831685, dated Apr. 8, 2008.
GenBank Accession No. CT831686, dated Apr. 8, 2008.
GenBank Accession No. CT832527, dated Apr. 8, 2008.
GenBank Accession No. CT837596, dated Apr. 8, 2008.
GenBank Accession No. DR37H4T, dated Nov. 22, 2002.
GenBank Accession No. E03435, dated Sep. 29, 1997.
GenBank Accession No. H30177, dated Aug. 16, 1995.
GenBank Accession No. L37750, dated Aug. 3, 1995.
GenBank Accession No. NM_001073615, dated Feb. 14, 2008.
GenBank Accession No. U03774, dated Jun. 22, 1994.
GenBank Accession No. U46159, dated May 18, 1999.
GenBank Accession No. U50333, Feb. 28, 1997.
GenBank Accession No. W21756, dated May 6, 1996.
GenBank Accession No. X74737, dated Jan. 21, 1999.
GenBank Accession No. X80265, dated Feb. 26, 1997.
GenEMBL Accession No. AF096555, dated Jul. 22, 1999.
GenEMBL Accession No. AL096768, dated Dec. 12, 1999.
GenSeq Accession No. AAZ35275, dated Mar. 27, 2000.
Gerhold et al., "It's the genes! EST access to human genome content," *BioEssays*, 18(2):973-981, 1996.
Gibson et al., "The bacteriochlorophyll biosynthesis gene, bchM, of Rhodobacter sphaeroides encodes S-adenosyl-l-methionine: Mg protoporphyrin IX methyltransferase," *FEBS Letters*, 352:127-130, 1994.
Goers et al., "The differential allosteric regulation of two chorismate-mutase isoenzymes of nicotiana silvestris," *Planta*, 162:117-124, 1984.
Goff, "Rica as a model for cereal genomics," *Curr. Opin. Plant Biol.*, 2:86-89, 1999.
Hedden et al., "Gibberellin biosynthesis: enzymes, genes and their regulation," *Annu. Rev. Plant Physiol. Plant Mol. Biol.*, 48:4631-460, 1997.
Herrmann, "The shikimate pathway as an entry to aromatic secondary metabolism," *Plant Physiol.*, 107:7-12, 1995.
Hong, "A rapid and accurate strategy for rice contig map construction by combination of fingerprinting and hybridization," *Plant Mol. Biol.*, 35:129-133, 1997.
Hsieh et al., "Promoter structure and activity of type 1 rice metallothionein-like gene," *DNA Sequence—The Journal of Sequencing and Mapping*, 9(1):9-18, 1998.
Hundle et al., "Functional assignment of erwinia herbicola Eho10 carotenoid genes expressed in *Escherichia coli*," *Mol. Gen. Genet.*, 245:406-416, 1994.
Ibba, "Biochemistry and bioinformatics: when worlds collide," *Trends in Biochem. Sci.*, 27(2):64, 2000.
Iyer et al., "Quod erat demonstrandum? The mystery of experimental validation of apparently erroneous computational analysis of protein sequences," *Genome Biol.*, 2(12):1-11, 2001.
Johnston et al., "Cloning and characterization of potato cDNAs involved in tetrapyrrole biosynthesis: ferrochelatase (Accession No. AJ005802), Chloroplatic protoporphyrinogen IX oxidase (Accession No. AJ225107), and mitochondrial protoporphyrinogen IX oxidase (Accession No. AJ225108)," *Plant Physiol.*, 118:329-331, 1998.
Kang et al., "Cloning and molecular analyses of a gibberellin 20-oxidase gene expressed specifically in developing seeds of watermelon," *Plant Physiology*, 121:373-382, 1999.
Keon et al., "Isolation and heterologous expression of a gene encoding 4-hydroxyphenylpyruvate dioxygenase from the wheat leaf-spot pathogen," *FEMS Microbiol. Lett.*, 161:337-343, 1998.
Kidwell et al., "Transposable elements as sources of variation in animals and plants," *Proc. Natl. Acad. Sci. USA*, 94:7704-7711, 1997.
Kim et al., "A 20 nucleotide upstream element is essential for the nopaline synthase (nos) promoter activity," *Plant Molecular Biology*, 24:105-117, 1994.
Kim et al., "Construction and characterization of a human bacterial artificial chromosome library," *Genomics*, 34:213-218, 1996.
Knott et al., "Randomly picked cosmid clones overlap the pyrB and oriC gap in the physical map of the *E. coli* chromosome," *Nucleic Acids Res.*, 16:2601-2612, 1988.
Ko et al., "An 'equalized cDNA' library by the reassociation of short double-stranded cDNA," *Nucleic Acids Res.*, 18(19):5705-5711, 1990.
Kurata et al., "A 300 kilobase interval genetic map of rice including 883 expressed sequences," *Natur Gen.*, 8(4):362-372, 1994.
Kyrpides et al., "Whole-genome sequence annotation: 'going wrong with confidence'," *Mol. Microbiol.*, 32:886-887, 1999.
Lange et al., "Cloning and expression of a gibberellin 2β,3β-hydroxylase cDNA from pumpkin endosperm," *Plant Cell*, 9(8):1459-I467, 1997.

(56) References Cited

OTHER PUBLICATIONS

Lange et al., "Cloning gibberellin dioxygenase genes from pumpkin endosperm by heterologous expression of enzyme activities in *Escherichia coli*," *Proc. Natl. Acad. Sci. USA*, 94(12):6553-6558, 1997.
Lange et al., "Expression cloning of a gibberellin 20-oxidase, a multifunctional enzyme involved in gibberellin biosynthesis," *Proc. Natl. Acad. Sci. USA*, 91(18):8552-8556, 1994.
Liepman et al., "Sequence analysis of a cDNA encoding alanine:glyoxylate amino transferase from arabidopsis (Accession No. AF063901)," *Plant Physiol.*, 117:1125-1127, 1998.
Lim et al., "Porphobilinogen deaminase is encoded by a single gene in arabidopsis thaliana and is targeted to the chloroplasts," *Plant Mol. Biol.*, 26:863-872, 1994.
Lu et al., "The GUS reporter-aided analysis of the promoter activities of a rice metallothionein gene reveals different regulatory regions responsible for tissue-specific and inducible expression in transgenic arabidopsis," *Transgenic Res.*, 16:177-191, 2007.
Mahairas et al., "Sequence-tagged connectors: a sequence approach to mapping and scanning the human genome," *Proc. Natl. Acad. Sci. USA*, 96:9739-9744, 1999.
Martin et al., "Mendel's dwarfing gene: cDNAs from the le alleles and function of the expressed proteins," *Proc. Natl. Acad Sci. USA*, 94(16):8907-8911, 1997.
Martin et al., "MYB transcription factors in plants," *Trends Genet.*, 13(2):67-73, 1997.
McCombie et aL, "Caenorhabditis elegans expressed sequence tags identify gene families and disease gene homologues," *Nature Gen.*, 1:124-131, 1992.
Meinkoth et al., "Hybridization of nucleic acids immobilized on solid supports," *Anal. Biochem.*, 138:267-284, 1984.
Mende et al., "The geranylgeranyl diphosphate synthase gene of gibberella fijikuroi: isolation and expression," *Mol. Gen. Genet.*, 255(1):96-105, 1997.
Mohan et al., "Genome mapping, molecular markers and marker-assisted selection crop plants," *Mol. Breed.*, 3:87-103, 1997.
Nakane et al., "Nucleotide sequence of the shikimate kinase gene (arol) of bacillus subtilis," *J. Ferment. Bioeng.*, 77:312-314, 1994.
Nakayashiki et al., "Nucleotide sequence of a cDNA clone encoding glutamyl-tRNA reductase from rice (Accession No. AB011416)," *Plant Physiol.*, 117:332, 1998.
NCBI Accession No. AAA34069, corresponding to gi:535771, dated Sep. 11, 1994.
NCBI Accession No. D23883, dated Nov. 29, 1993.
NCBI Accession No. S42508, dated May 8, 1993.
Norris et al., "Complementation of the arabidopsis pds 1 mutation with the gene encoding p-hydroxyphenylpyruvate dioxygenase," *Plant Physiol.*, 117:1317-1323, 1998.
Odell et al., "Identification of DNA sequences required for activity of the cauliflower mosaic virus 35S promoter," *Nature*, 313:810-812, 1985.
Oka et al., "Replication origin of the *Escherichia coli* K-12 chromosome: the size and structure of the minimum DNA,segment carrying the information for autonomous replication," *Mol. Gen. Genet.*, 178(1):9-20, 1980.
Okubo et al., "Large scale cDNA sequencing for analysis of quantitative and qualitative aspects of gene expression," *Nature Gen.*, 2:173-179, 1992.
Perez-Florez et al., "Expression analysis of a GA 20-oxidase in embryos from two sorghum lines with contrasting dormancy: possible participation of this gene in the hormonal control of germination," *J. of Experimental Botany*, 54(390):2071-2079, 2003.
Phillips et al., "Isolation and expression of three gibberellin 20-oxidase cDNA clones from arabidopsis," *Plant Physiol.*, 108(3):1049-1057, 1995.
Piechulla et al., "Identification of tomato Lhc promoter regions necessary for circadian expression," *Plant Molecular Biology*, 38:655-662, 1998.
Porra, "Recent progress in porphyrin and chlorophyll biosynthesis," *Photochem. Photobiol.*, 65(3):492-516, 1997.

Rounsley et al., "Large-scale sequencing of plant genomes," *Current Opinion in Plant Biology* 1:136-141, 1998.
Russell et al., "Structural features can be unconserved in proteins with similar folds. An analysis of side-chain to side-chain contacts secondary structure and accessibility," *J. Mol. Biol.*, 244:332-350, 1994.
Sakamoto et al., "An overview of gibberellin metabolism enzyme genes and their related mutants in rice," *Plant Physiol.*, 134:1642-1653, 2004.
Schmitz et al., "The tomato blind gene encodes a MYB transcription factor that controls the formation of lateral meristems," *Proc. Nat. Acad. Sci.*, 99(2):1064-1069, 2002.
Schumann et al., "Identification of three cDNA clones expressed in the leaf extension zone and with altered patterns of expression in the slender mutant of barley: a tonoplast intrinsic protein, a putative structural protein and protochlorophylide oxidoreductase," *Plant Mol. Biol.*, 31:529-537, 1996.
Seffernick et al., "Melamine deaminase and atrazine chlorohydrolase: 98 percent identical but functionally different," *J. Bacteriol.*, 183(3):2405-2410, 2001.
SIGMA Chemical Catalogue (Sigma Chemical Co.; P.O. Box 14508, St. Louis, MO 63178) 1993, product Nos. 01256, 03628, 04375, pp. 736-737.
Smith et al., "Partial purification and characterization of the gibberellin A20 3β-hydroxylase from seeds of phaseolus vulgaris," *Plant Physiol.*, 94:1390-1401, 1990.
Smith et al., "The first step of gibberellin biosynthesis in pumpkin is catalyzed by at least two copalyl diphosphate synthases encoded by differentially regulated genes," *Plant Physiol.*, 118:1411-1419, 1998.
Stammers et al., "Rapid purification and characterization of HIV-1 reverse transcriptase and RNaseH engineered to incorporate a C-terminal tripeptide α-tubulin epitope," *FEBS Lett.*, 283(2):298-302, 1991.
Tanaka et al., "The third member of the hemA gene family encoding glutamyl-tRNA reductase is primarily expressed in roots in hordeum vulgare," *Photosynthesis Res.*, 53:161-171, 1997.
Tanksley et al., "Chromosome landing: a paradigm for map-based gene cloning in plants with large genomes," *Trends in Genet.*, 11(2):63-68, 1995.
Tikhonov et al., "Colinearity and its exceptions in orthologous adh regions of maize and sorghum," *Proc. Natl. Acad. Sci. USA*, 96:7409-7414, 1999.
Van de Loo et al., "An oleate 12-hydroxylase from ricirus communis L. is a fatty acyl desaturase homolog," *Proc. Nat. Acad. Sci.*, 92:6743-6747, 1995.
Venter et al., "A new strategy for genome sequencing," *Nature*, 381:364-366, 1996.
Venter et al., "The sequence of the human genome," *Science*, 291:1304-1351, 2001.
Wang et al., "Construction of a rice bacterial artificial chromosome library and identification of clones linked to the X-21 disease resistance locus," *Plant J.*, 7(3):525-533, 1995.
Wells et al., "The chemokine information source: identification and characterization of novel chemokines using the WorldWideWeb and expressed sequence tag databases," *J. Leukocyte Biol.*, 61(5):545-550, 1997.
Welsch et al., "Structural and functional characterization of the phytoene synthase promoter from arabidopsis thaliana," *Planta*, 216:523-534, 2003.
Wendel et al., "New isozyme systems for maize (*Zea mays* L.): aconitate hydratase, adenylate kinase, NADH dehydrogenase, and shikimate dehydrogenase," *Biochem. Genet.*, 26(5-6):421-446, 1998 (Abstract only).
Wenzel et al., "Physical mapping of the mycoplasma pneumoniae genome," *Nucleic Acids Res.*, 16(17):8323-8336, 1988.
Winkler et al., "The maize dwarf3 gene encodes ad cytochrome P450-mediated early step in gibberellin biosynthesis," *Plant Cell*, 7(8):1307-1317, 1995.
Woese et al., "Conservation of primary structure in 16S ribosomal RNA," *Nature*, 254:83-85, 1975.

(56) References Cited

OTHER PUBLICATIONS

Wong et al., "Down-regulation of metallothionein, a reactive oxygen scavenger, by the small GTPase OsRac 1 in rice," *Plant Physiology*, 135:1447-1456, 2004.
Written Description Training material, Example 7, pp. 25-28, Mar. 25, 2008.
Yomo et al., "Histochemical studies on protease formation in the cotyledons of germinating bean seeds," *Planta*, 112(1):35-43, 1973.
Zhang et al., "Construction and characterization of two rice bacterial artificial chromosome libraries from the parents of a permanent recombinant inbred mapping population," *Mol. Breeding*, 2:11-24, 1996.
Zhang et al., "Physical mapping of the rice genome with BACs," *Plant Mol. Biol.*, 35:115-127, 1997.
Zwick et al., "Physical mapping of the liguleless linkage group in sorghum bicolor using rice RFLP-selected sorghum BACs," *Genetics*, 248:1983-1992, 1998.
GenBank Accession No. AY166659, dated Nov. 1, 2005.
Nakase et al., "Characterization of a novel rice bZIP protein which binds to the alpha-globulin promoter," *Plant Mol. Biol.* 33(3):513-522, 1997.
Niu et al., "DNA binding specificity of the wheat bZIP protein EmBP-1," *Nucleic Acids Res.* 22(23):4969-4978, 1994.

\* cited by examiner

GENOMIC PLANT SEQUENCES AND USES THEREOF

REFERENCES TO RELATED APPLICATIONS

This application is a continuation of U.S. application Ser. No. 11/834,317 filed on Aug. 6, 2007, now issued U.S. Pat. No. 8,058,516, which is a continuation-in-part of U.S. application Ser. No. 11/595,983 filed on Nov. 13, 2006, now issued U.S. Pat. No. 7,790,958, which is a division of U.S. application Ser. No. 09/815,264 filed on Mar. 23, 2001, now issued U.S. Pat. No. 7,365,185, which is a continuation-in-part of U.S. application Ser. No. 09/702,134 filed on Oct. 31, 2000, now abandoned, and is a continuation-in-part of U.S. application Ser. No. 09/620,392 filed on Jul. 19, 2000, now abandoned, which claims benefit of U.S. Provisional Application Ser. No. 60/144,351 filed Jul. 20, 1999, all of the disclosures of which applications are incorporated by reference in their entireties.

INCORPORATION OF SEQUENCE LISTING

Two copies of the sequence listing (Copy 1 Replacement 3 and Copy 2 Replacement 3) and a computer readable form of the sequence listing (Computer Readable Form (CRF Copy) Replacement 1), all on CD-ROMs, each containing the file named MONS203USC1 seq amended.txt which is 420,834,715 bytes, and was created on Jul. 7, 2014 in PC format using MS Windows operating system, are herein incorporated by reference.

INCORPORATION OF TABLES 1, 3, 4, 5 and 6

Two copies of Tables 1, 3, 4, 5, and 6 on CD-ROMs, each containing 47,041,202 bytes (measured in MS-DOS) and each having the file name Pa—00329.txt all created on Jun. 30, 2015, are herein incorporated by reference.

FIELD OF THE INVENTION

The present invention relates to the field of plant biochemistry and genetics. Specifically, the invention relates to regulatory elements comprising genomic nucleic acid sequences from rice plants, and nucleic acid molecules containing the same. More specifically, the invention discloses nucleic acid sequences from *Oryza sativa* (rice) containing regulatory elements, such as promoters. The invention also discloses methods of modifying, producing, and using the regulatory elements.

BACKGROUND OF THE INVENTION

Promoters

The genetic enhancement of plants and seeds provides significant benefits to society. For example, plants and seeds may be enhanced to have desirable agricultural, biosynthetic, commercial, chemical, insecticidal, industrial, nutritional, or pharmaceutical properties. Despite the availability of many molecular tools, however, the genetic modification of plants and seeds is often constrained by an insufficient or poorly localized expression of the engineered transgene.

Many intracellular processes may impact overall transgene expression, including transcription, translation, protein assembly and folding, methylation, phosphorylation, transport, and proteolysis. Intervention in one or more of these processes can increase the amount of transgene expression in genetically engineered plants and seeds. For example, raising the steady-state level of mRNA in the cytosol often yields an increased accumulation of transgene expression. Many factors may contribute to increasing the steady-state level of an mRNA in the cytosol, including the rate of transcription, promoter strength and other regulatory features of the promoter, efficiency of mRNA processing, and the overall stability of the mRNA.

Among these factors, the promoter plays a central role. Along the promoter, the transcription machinery is assembled and transcription is initiated. This early step is often rate-limiting relative to subsequent stages of protein production. Transcription initiation at the promoter may be regulated in several ways. For example, a promoter may be induced by the presence of a particular compound or external stimuli, express a gene only in a specific tissue, express a gene during a specific stage of development, or constitutively express a gene. Thus, transcription of a transgene may be regulated by operably linking the coding sequence to promoters with different regulatory characteristics. Accordingly, regulatory elements such as promoters, play a pivotal role in enhancing the agronomic, pharmaceutical or nutritional value of crops.

At least two types of information are useful in predicting promoter regions within a genomic DNA sequence. First, promoters may be identified on the basis of their sequence "content," such as transcription factor binding sites and various known promoter motifs. (Stormo, *Genome Research* 10: 394-397 (2000)). Such signals may be identified by computer programs that identify sites associated with promoters, such as TATA boxes, transcription factor (TF) binding sites, and CpG islands.

Second, promoters may be identified on the basis of their "location," i.e. their proximity to a known or suspected coding sequence. (Stormo, *Genome Research* 10: 394-397 (2000)). Promoters are typically contained within a region of DNA extending approximately 150-1500 basepairs in the 5' direction from the start codon of a coding sequence. Thus, promoter regions may be identified by locating the start codon of a coding sequence, and moving beyond the start codon in the 5' direction to locate the promoter region.

Rice

Approximately half a billion tons of rice is produced each year world-wide. More than 90% of this rice is for human consumption (Goff, *Curr. Opin. Plant Biol.* 2:86-89 (1999)). Rice, however, is not only a commercially important crop; it is also a model for other cereal crops, such as *sorghum*, maize, barley and wheat.

Rice is a model crop for several reasons. First, the genes in rice are predicted to be generally arranged in the genome in an order that is similar to other cereal crops. In fact, comparisons of the physical and genetic maps of cereal genomes have suggested the existence of a colinearity of gene order among the various cereal genomes studied. (Goff, *Curr. Opin. Plant Biol.* 2:86-89 (1999)).

Second, studies of a number of individual genes indicate that there is considerable homology within gene families found among various cereal crops. This conservation of gene and protein sequences suggests that functional studies of genes or proteins from one cereal crop can help elucidate the function of similar genes or proteins in other cereal crops. Likewise, non-coding regulatory elements in rice, such as promoters, are predicted to display similar functions compared to related regulatory elements found in other cereal crops. Accordingly, a strong constitutive or tissue-specific promoters from one cereal is more likely to retain its function when introduced as a portion of a transgene into another cereal crop species (Goff, *Curr. Opin. Plant Biol.* 2:86-89 (1999)).

Third, rice can be used as a model for other cereal genomes because its genome is smaller than those of other major cereals. The size of the rice genome is estimated at 420 to 450 megabase pairs. *Sorghum*, maize, barley and wheat have larger genomes (1000, 3000, 5000 and 16000 Mbp, respectively). Despite such differences in genome size, however, the number of genes in each of these crops is on the same order of magnitude. Thus, the smaller genome size of rice results in a higher gene density relative to the other cereals. Based on estimates of 30,000 genes in a cereal genome, rice will have on average one gene approximately every 15 Kbp. In contrast, maize and wheat have one gene approximately every 100 and 500 Kbp, respectively. This higher gene density makes rice an attractive target for cereal gene discovery efforts, genomic sequence analysis, and identification of regulatory elements, such as promoters (Goff, *Curr. Opin. Plant Biol.* 2:86-89 (1999)).

For these reasons, rice is a model for other crops. Accordingly, discoveries in rice may be extended to other crops. Thus, the identification of new genes, regulatory elements (e.g., promoters), etc. that function in rice is useful not only in developing enhanced varieties of rice, but also in developing enhanced varieties of other crops. In particular, developments in rice are applicable to other cereal crops, such as *sorghum*, maize, barley and wheat.

Clearly, there exists a need in the art for new regulatory elements, such as promoters, that are capable of expressing heterologous nucleic acid sequences in important crop species.

SUMMARY OF THE INVENTION

The present invention includes and provides a substantially purified nucleic acid molecule comprising a nucleic acid sequence wherein the nucleic acid sequence: i) hybridizes under stringent conditions with a sequence selected from the group consisting of SEQ ID NO:1 through 57,467, and the complements thereof; or ii) exhibits an 85% or greater identity to a sequence selected from the group consisting of SEQ ID NO:1 through 57,467.

The present invention includes and provides a transgenic plant containing a nucleic acid molecule that comprises in the 5' to 3' direction: a nucleic acid sequence that: i) hybridizes under stringent conditions with a sequence selected from the group consisting of SEQ ID NO:1 through 57,467, and the complements thereof; or ii) exhibits an 85% or greater identity to a sequence selected from the group consisting of SEQ ID NO:1 through 57,467; operably linked to a structural nucleic acid sequence; wherein the nucleic acid sequence is heterologous with respect to the structural nucleic acid sequence.

The present invention includes and provides a seed from a transgenic plant containing a nucleic acid molecule that comprises in the 5' to 3' direction: a nucleic acid sequence that: i) hybridizes under stringent conditions with a sequence selected from the group consisting of SEQ ID NO:1 through 57,467, and the complements thereof; or ii) exhibits an 85% or greater identity to a sequence selected from the group consisting of SEQ ID NO:1 through 57,467; operably linked to a structural nucleic acid sequence; wherein the nucleic acid sequence is heterologous with respect to the structural nucleic acid sequence.

The present invention includes and provides a fertile transgenic plant containing a nucleic acid molecule that comprises in the 5' to 3' direction: a nucleic acid sequence that: i) hybridizes under stringent conditions with a sequence selected from the group consisting of SEQ ID NO:1 through 57,467, and the complements thereof; or ii) exhibits an 85% or greater identity to a sequence selected from the group consisting of SEQ ID NO:1 through 57,467; operably linked to a structural nucleic acid sequence; wherein the nucleic acid sequence is heterologous with respect to the structural nucleic acid sequence.

The present invention includes and provides a method of transforming a host cell comprising: a) providing a nucleic acid molecule that comprises in the 5' to 3' direction: a nucleic acid sequence that: i) hybridizes under stringent conditions with a sequence selected from the group consisting of SEQ ID NO:1 through 57,467, and the complements thereof; or ii) exhibits an 85% or greater identity to a sequence selected from the group consisting of SEQ ID NO:1 through 57,467; operably linked to a structural nucleic acid sequence; and b) transforming said plant with the nucleic acid molecule.

Definitions

The following definitions are provided as an aid to understanding the detailed description of the present invention.

The phrases "coding sequence," "structural sequence," and "structural nucleic acid sequence" refer to a physical structure comprising an orderly arrangement of nucleic acids. The nucleic acids are arranged in a series of nucleic acid triplets that each form a codon. Each codon encodes for a specific amino acid. Thus the coding sequence, structural sequence, and structural nucleic acid sequence encode a series of amino acids forming a protein, polypeptide, or peptide sequence. The coding sequence, structural sequence, and structural nucleic acid sequence may be contained, without limitation, within a larger nucleic acid molecule, vector, etc. In addition, the orderly arrangement of nucleic acids in these sequences may be depicted, without limitation, in the form of a sequence listing, figure, table, electronic medium, etc.

The phrases "DNA sequence" and "nucleic acid sequence" refer to a physical structure comprising an orderly arrangement of nucleic acids. The DNA sequence or nucleic acid sequence may be contained within a larger nucleic acid molecule, vector, or the like. In addition, the orderly arrangement of nucleic acids in these sequences may be depicted in the form of a sequence listing, figure, table, electronic medium, or the like.

The term "expression" refers to the transcription of a gene to produce the corresponding mRNA and translation of this mRNA to produce the corresponding gene product (i.e., a peptide, polypeptide, or protein) and activity of the protein to confer a function.

The term "expression of antisense RNA" refers to the transcription of a DNA to produce a first RNA molecule capable of hybridizing to a second RNA molecule.

The term "gene" refers to chromosomal or genomic DNA, plasmid DNA, cDNA, synthetic DNA, or other DNA that encodes a peptide, polypeptide, protein, or RNA molecule.

"Homology" refers to the level of similarity between two or more nucleic acid or amino acid sequences in terms of percent of positional identity (i.e., sequence similarity or identity). Homology also refers to the concept of similar functional properties among different nucleic acids or proteins.

The phrase "heterologous" refers to the relationship between two or more nucleic acid or protein sequences that are derived from different sources. For example, a promoter is heterologous with respect to a coding sequence if such a combination is not normally found in nature. In addition, a particular sequence may be "heterologous" with respect to a cell or organism into which it is inserted (i.e. does not naturally occur in that particular cell or organism).

The term "hybridization" refers generally to the ability of nucleic acid molecules to join via complementary base strand pairing. Such hybridization may occur when nucleic acid molecules are contacted under appropriate conditions (see also, "specific hybridization," below).

The phrase "operably linked" refers to the functional spatial arrangement of two or more nucleic acid regions or nucleic acid sequences. For example, a promoter region may be positioned relative to a nucleic acid sequence such that transcription of the nucleic acid sequence is directed by the promoter region. Thus, the promoter region is "operably linked" to the nucleic acid sequence.

The term "promoter," "promoter region," or "promoter sequence" refer to a nucleic acid sequence, usually found upstream (5') to a coding sequence, that directs transcription of a nucleic acid sequence into mRNA. The promoter or promoter region typically provide a recognition site for RNA polymerase and the other factors necessary for proper initiation of transcription. As contemplated herein, a promoter or promoter region includes variations of promoters derived by inserting or deleting regulatory regions, subjecting the promoter to random or site-directed mutagenesis, etc. The activity or strength of a promoter may be measured in terms of the amounts of RNA it produces, or the amount of protein accumulation in a cell or tissue, relative to a promoter whose transcriptional activity has been previously assessed.

The term "recombinant vector" refers to any agent such as a plasmid, cosmid, virus, autonomously replicating sequence, phage, or linear or circular single-stranded or double-stranded DNA or RNA nucleotide sequence. The recombinant vector may be derived from any source; is capable of genomic integration or autonomous replication; and comprises a promoter nucleic acid sequence operably linked to one or more nucleic acid sequences. A recombinant vector is typically used to introduce such operably linked sequences into a suitable host.

"Regulatory sequence" refers to a nucleotide sequence located upstream (5'), within, or downstream (3') to a coding sequence. Transcription and expression of the coding sequence is typically impacted by the presence or absence of the regulatory sequence.

"Specifically hybridizes" refers to the ability of two nucleic acid molecules to form an anti-parallel, double-stranded nucleic acid structure. A nucleic acid molecule is said to be the "complement" of another nucleic acid molecule if they exhibit "complete complementarity," i.e., each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules that hybridize to other nucleic acid molecules, e.g., at least under low stringency conditions are said to be "hybridizable cognates" of the other nucleic acid molecules. Conventional low stringency and high stringency conditions are described herein and by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985). Departures from complete complementarity are permissible, as long as such departures do not completely preclude the capacity of the molecules to form a double-stranded structure.

The term "substantially homologous" refers to two sequences which are at least 90% identical in sequence, as measured by the BestFit program described herein (Version 10; Genetics Computer Group, Inc., Madison, Wis.), using default parameters.

"Substantially purified" refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The term "transformation" refers to the introduction of nucleic acid into a recipient host. The term "host" refers to bacteria cells, fungi, animals and animal cells, plants and plant cells, or any plant parts or tissues including protoplasts, calli, roots, tubers, seeds, stems, leaves, seedlings, embryos, and pollen.

The term "transgenic" refers to an animal, plant, or other organism containing one or more heterologous nucleic acid sequences.

DETAILED DESCRIPTION OF THE INVENTION

The present invention includes nucleic acid molecules comprising promoter sequences useful for transcribing a heterologous structural nucleic acid sequence in plants, and methods of modifying, producing, and using the same. The invention also includes compositions, transformed host cells, transgenic plants, and seeds containing the promoters, and methods for preparing and using the same.

Nucleic Acid Molecules

The present invention includes a nucleic acid molecule having a nucleic acid sequence that hybridizes to SEQ ID NO:1 through SEQ ID NO:57,467, or any complements thereof; or any fragments thereof. The present invention also provides a nucleic acid molecule comprising a nucleic acid sequence selected from the group consisting of SEQ ID NO:1 through SEQ ID NO:57,467, any complements thereof, and any fragments thereof.

Nucleic acid hybridization is a technique well known to those of skill in the art of DNA manipulation. The hybridization properties of a given pair of nucleic acids are an indication of their similarity or identity.

Low stringency conditions may be used to select nucleic acid sequences with lower sequence identities to a target nucleic acid sequence. One may wish to employ conditions such as about 0.15 M to about 0.9 M sodium chloride, at temperatures ranging from about 20° C. to about 55° C.

High stringency conditions may be used to select for nucleic acid sequences with higher degrees of identity to the disclosed nucleic acid sequences (Sambrook et al., 1989).

High stringency conditions typically involve nucleic acid hybridization in about 2× to about 10×SSC (diluted from a 20×SSC stock solution containing 3 M sodium chloride and 0.3 M sodium citrate, pH 7.0 in distilled water), about 2.5× to about 5×Denhardt's solution (diluted from a 50× stock solution containing 1% (w/v) bovine serum albumin, 1% (w/v) ficoll, and 1% (w/v) polyvinylpyrrolidone in distilled water), about 10 mg/mL to about 100 mg/mL fish sperm DNA, and about 0.02% (w/v) to about 0.1% (w/v) SDS, with an incubation at about 50° C. to about 70° C. for several hours to overnight. High stringency conditions are preferably provided by 6×SSC, 5×Denhardt's solution, 100 mg/mL fish sperm DNA, and 0.1% (w/v) SDS, with an incubation at 55° C. for several hours.

Hybridization is generally followed by several wash steps. The wash compositions generally comprise 0.5× to about 10×SSC, and 0.01% (w/v) to about 0.5% (w/v) SDS with a 15 minute incubation at about 20° C. to about 70° C. Preferably, the nucleic acid segments remain hybridized after washing at least one time in 0.1×SSC at 65° C.

A nucleic acid molecule preferably comprises a nucleic acid sequence that hybridizes, under low or high stringency conditions, with SEQ ID NO:1 through SEQ ID NO:57,467, any complements thereof, or any fragments thereof. A nucleic acid molecule most preferably comprises a nucleic acid sequence that hybridizes under high stringency conditions with SEQ ID NO:1 through SEQ ID NO:57,467, any complements thereof, or any fragments thereof.

In an alternative embodiment, the nucleic acid molecule comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid molecule selected from the group consisting of SEQ ID NO:1 through SEQ ID NO:57, 467 and complements thereof. The nucleic acid molecule most preferably comprises a nucleic acid sequence selected from the group consisting of SEQ ID NO:1 through SEQ ID NO:57,467 and complements thereof.

The percent of sequence identity is preferably determined using the "Best Fit" or "Gap" program of the Sequence Analysis Software Package™ (Version 10; Genetics Computer Group, Inc., Madison, Wis.). "Gap" utilizes the algorithm of Needleman and Wunsch (Needleman and Wunsch, *Journal of Molecular Biology* 48:443-453, 1970) to find the alignment of two sequences that maximizes the number of matches and minimizes the number of gaps. "BestFit" performs an optimal alignment of the best segment of similarity between two sequences and inserts gaps to maximize the number of matches using the local homology algorithm of Smith and Waterman (Smith and Waterman, *Advances in Applied Mathematics*, 2:482-489, 1981, Smith et al., *Nucleic Acids Research* 11:2205-2220, 1983). The percent identity is most preferably determined using the "Best Fit" program.

As used herein "sequence identity" refers to the extent to which two optimally aligned polynucleotide or peptide sequences are invariant throughout a window of alignment of components, e.g., nucleotides or amino acids. An "identity fraction" for aligned segments of a test sequence and a reference sequence is the number of identical components which are shared by the two aligned sequences divided by the total number of components in reference sequence segment, i.e., the entire reference sequence or a smaller defined part of the reference sequence. "Percent identity" is the identity fraction times 100.

Useful methods for determining sequence identity are also disclosed in Guide to Huge Computers, Martin J. Bishop, ed., Academic Press, San Diego, 1994, and Carillo, H., and Lipton, D., *Applied Math* (1988) 48:1073. More particularly, preferred computer programs for determining sequence identity include the Basic Local Alignment Search Tool (BLAST) programs which are publicly available from National Center Biotechnology Information (NCBI) at the National Library of Medicine, National Institute of Health, Bethesda, Md. 20894; see BLAST Manual, Altschul et al., NCBI, NLM, NIH; Altschul et al., *J. Mol. Biol.* 215:403-410 (1990); version 2.0 or higher of BLAST programs allows the introduction of gaps (deletions and insertions) into alignments; for peptide sequence BLASTX can be used to determine sequence identity; and, for polynucleotide sequence BLASTN can be used to determine sequence identity.

For purposes of this invention "percent identity" may also be determined using BLASTX version 2.0 for translated nucleotide sequences and BLASTN version 2.0 for polynucleotide sequences. In a preferred embodiment of the present invention, the presently disclosed rice genomic promoter sequences comprise nucleic acid molecules or fragments having a BLAST score of more than 200, preferably a BLAST score of more than 300, and even more preferably a BLAST score of more than 400 with their respective homologues.

Nucleic acid molecules of the present invention include nucleic acid sequences that are between about 0.01 Kb and about 50 Kb, more preferably between about 0.1 Kb and about 25 Kb, even more preferably between about 1 Kb and about 10 Kb, and most preferably between about 3 Kb and about 10 Kb, about 3 Kb and about 7 Kb, about 4 Kb and about 6 Kb, about 2 Kb and about 4 Kb, about 2 Kb and about 5 Kb, about 1 Kb and about 5 Kb, about 1 Kb and about 3 Kb, or about 1 Kb and about 2 Kb.

Promoters

Any of the nucleic acid molecules described herein may comprise nucleic acid sequences comprising promoters. Promoters of the present invention can include between about 300 bp upstream and about 10 kb upstream of the trinucleotide ATG sequence at the start site of a protein coding region. Promoters of the present invention can preferably include between about 300 bp upstream and about 5 kb upstream of the trinucleotide ATG sequence at the start site of a protein coding region. Promoters of the present invention can more preferably include between about 300 bp upstream and about 2 kb upstream of the trinucleotide ATG sequence at the start site of a protein coding region. Promoters of the present invention can include between about 300 bp upstream and about 1 kb upstream of the trinucleotide ATG sequence at the start site of a protein coding region. While in many circumstances a 300 bp promoter may be sufficient for expression, additional sequences may act to further regulate expression, for example, in response to biochemical, developmental or environmental signals.

It is also preferred that the promoters of the present invention contain a CAAT and a TATA cis element. Moreover, the promoters of the present invention can contain one or more cis elements in addition to a CAAT and a TATA box.

By "regulatory element" it is intended a series of nucleotides that determines if, when, and at what level a particular gene is expressed. The regulatory DNA sequences specifically interact with regulatory or other proteins. Many regulatory elements act in cis ("cis elements") and are believed to affect DNA topology, producing local conformations that selectively allow or restrict access of RNA polymerase to the DNA template or that facilitate selective opening of the double helix at the site of transcriptional initiation. Cis elements occur within, but are not limited to promoters, and promoter modulating sequences (inducible elements). Cis elements can be identified using known cis elements as a target sequence or target motif in the BLAST programs of the present invention.

Promoters of the present invention include homologues of cis elements known to effect gene regulation that show homology with the promoter sequences of the present invention. These cis elements include, but are not limited to, oxygen responsive cis elements (Cowen et al., *J Biol. Chem.* 268(36):26904-26910 (1993)), light regulatory elements (Bruce and Quaill, *Plant Cell* 2 (11):1081-1089 (1990); Bruce et al., *EMBO J.* 10:3015-3024 (1991); Rocholl et al, *Plant Sci.* 97:189-198 (1994); Block et al., *Proc. Natl. Acad. Sci. USA* 87:5387-5391 (1990); Giuliano et al., *Proc. Natl. Acad. Sci. USA* 85:7089-7093 (1988); Staiger et al., *Proc. Natl. Acad. Sci. USA* 86:6930-6934 (1989); Izawa et al., *Plant Cell* 6:1277-1287 (1994); Menkens et al., *Trends in Biochemistry* 20:506-510 (1995); Foster et al., *FASEB J.* 8:192-200 (1994); Plesse et al., *Mol Gen Gene* 254:258-266 (1997); Green et al., *EMBO J.* 6:2543-2549 (1987); Kuhlemeier et al., *Ann. Rev Plant Physiol.* 38:221-257 (1987); Villain et al., *J. Biol. Chem.* 271:32593-32598 (1996); Lam et al., *Plant Cell* 2:857-866 (1990); Gilmartin et al., *Plant Cell* 2:369-378 (1990); Datta et al., *Plant Cell* 1:1069-1077 (1989); Gilmartin et al., *Plant Cell* 2:369-378 (1990); Castresana et al., *EMBO J.* 7:1929-1936 (1988); Ueda et al., *Plant Cell* 1:217-227 (1989); Terzaghi et al., *Annu. Rev. Plant Physiol. Plant Mol. Biol.* 46:445-474 (1995); Green et al., *EMBO J.* 6:2543-2549 (1987); Villain et al., *J. Biol. Chem.* 271:32593-32598 (1996); Tjaden et al., *Plant Cell* 6:107-118 (1994); Tjaden et al., *Plant Physiol.* 108:1109-1117 (1995); Ngai et al., *Plant J.* 12:1021-1234 (1997); Bruce et al., *EMBO J.* 10:3015-3024 (1991); Ngai et al., *Plant J.* 12:1021-1034 (1997)), elements responsive to gibberellin, (Muller et al., *J. Plant Physiol.* 145:606-613 (1995); Croissant et al., *Plant Science* 116:27-35 (1996); Lohmer et al., *EMBO J.* 10:617-624 (1991); Rogers et al., *Plant Cell* 4:1443-1451 (1992); Lanahan et al., *Plant Cell* 4:203-211 (1992); Skriver et al., *Proc. Natl. Acad. Sci. USA* 88:7266-7270 (1991); Gilmartin et al., *Plant Cell* 2:369-378 (1990); Huang et al., *Plant Mol. Biol.* 14:655-668 (1990), Gubler et al., *Plant Cell* 7:1879-1891 (1995)), elements responsive to abscisic acid, (Busk et al., *Plant Cell* 9:2261-2270 (1997); Guiltinan et al., *Science* 250:267-270 (1990); Shen et al., *Plant Cell* 7:295-307 (1995); Shen et al., *Plant Cell* 8:1107-1119 (1996); Seo et al., *Plant Mol. Biol.* 27:1119-1131 (1995); Marcotte et al., *Plant Cell* 1:969-976 (1989); Shen et al., *Plant Cell* 7:295-307 (1995); Iwasaki et al., *Mol Gen Genet* 247:391-398 (1995); Hattori et al., *Genes Dev.* 6:609-618 (1992); Thomas et al., *Plant Cell* 5:1401-1410 (1993)), elements similar to abscisic acid responsive elements, (Ellerstrom et al., *Plant Mol. Biol.* 32:1019-1027 (1996)), auxin responsive elements (Liu et al., *Plant Cell* 6:645-657 (1994); Liu et al., *Plant Physiol.* 115:397-407 (1997); Kosugi et al., *Plant J.* 7:877-886 (1995); Kosugi et al., *Plant Cell* 9:1607-1619 (1997); Ballas et al., *J. Mol. Biol.* 233:580-596 (1993)), a cis element responsive to methyl jasmonate treatment (Beaudoin and Rothstein, *Plant Mol. Biol.* 33:835-846 (1997)), a cis element responsive to abscisic acid and stress response (Straub et al., *Plant Mol. Biol.* 26:617-630 (1994)), ethylene responsive cis elements (Itzhaki et al., *Proc. Natl. Acad. Sci. USA* 91:8925-8929 (1994); Montgomery et al., *Proc. Natl. Acad. Sci. USA* 90:5939-5943 (1993); Sessa et al., *Plant Mol. Biol.* 28:145-153 (1995); Shinshi et al., *Plant Mol. Biol.* 27:923-932 (1995)), salicylic acid cis responsive elements, (Strange et al., *Plant J.* 11:1315-1324 (1997); Qin et al., *Plant Cell* 6:863-874 (1994)), a cis element that responds to water stress and abscisic acid (Lam et al., *J. Biol. Chem.* 266:17131-17135 (1991); Thomas et al., *Plant Cell* 5:1401-1410 (1993); Pla et al., *Plant Mol Biol* 21:259-266 (1993)), a cis element essential for M phase-specific expression (Ito et al., *Plant Cell* 10:331-341 (1998)), sucrose responsive elements (Huang et al., *Plant Mol. Biol.* 14:655-668 (1990); Hwang et al., *Plant Mol Biol* 36:331-341 (1998); Grierson et al., *Plant J.* 5:815-826 (1994)), heat shock response elements (Pelham et al., *Trends Genet.* 1:31-35 (1985)), elements responsive to auxin and/or salicylic acid and also reported for light regulation (Lam et al., *Proc. Natl. Acad. Sci. USA* 86:7890-7897 (1989); Benfey et al., *Science* 250:959-966 (1990)), elements responsive to ethylene and salicylic acid (Ohme-Takagi et al., *Plant Mol. Biol.* 15:941-946 (1990)), elements responsive to wounding and abiotic stress (Loake et al., *Proc. Natl. Acad. Sci. USA* 89:9230-9234 (1992); Mhiri et al., *Plant Mol. Biol.* 33:257-266 (1997)), antoxidant response elements (Rushmore et al., *J. Biol. Chem.* 266:11632-11639; Dalton et al., *Nucleic Acids Res.* 22:5016-5023 (1994)), Sph elements (Suzuki et al., *Plant Cell* 9:799-807 1997)), elicitor responsive elements, (Fukuda et al., *Plant Mol. Biol.* 34:81-87 (1997); Rushton et al., *EMBO J.* 15:5690-5700 (1996)), metal responsive elements (Stuart et al., *Nature* 317:828-831 (1985); Westin et al. *EMBO J.* 7:3763-3770 (1988); Thiele et al., *Nucleic Acids Res.* 20:1183-1191 (1992); Faisst et al., *Nucleic Acids Res.* 20:3-26 (1992)), low temperature responsive elements, (Baker et al., *Plant Mol. Biol.* 24:701-713 (1994); Jiang et al., *Plant Mol. Biol.* 30:679-684 (1996); Nordin et al., *Plant Mol. Biol.* 21:641-653 (1993); Zhou et al., *J. Biol. Chem.* 267:23515-23519 (1992)), drought responsive elements, (Yamaguchi et al., *Plant Cell* 6:251-264 (1994); Wang et al., *Plant Mol. Biol.* 28:605-617 (1995); Bray E A, *Trends in Plant Science* 2:48-54 (1997)) enhancer elements for glutenin, (Colot et al., *EMBO J.* 6:3559-3564 (1987); Thomas et al., *Plant Cell* 2:1171-1180 (1990); Kreis et al., *Philos. Trans. R. Soc. Lond.*, B314:355-365 (1986)), light-independent regulatory elements, (Lagrange et al., *Plant Cell* 9:1469-1479 (1997); Villain et al., *J. Biol. Chem.* 271:32593-32598 (1996)), OCS enhancer elements, (Bouchez et al., *EMBO J.* 8:4197-4204 (1989); Foley et al., *Plant J.* 3:669-679 (1993)), ACGT elements, (Foster et al., *FASEB J.* 8:192-200 (1994); Izawa et al., *Plant Cell* 6:1277-1287 (1994); Izawa et al., *J. Mol. Biol.* 230:1131-1144 (1993)), negative cis elements in plastid related genes, (Zhou et al., *J. Biol. Chem.* 267:23515-23519 (1992); Lagrange et al., *Mol. Cell Biol.* 13:2614-2622 (1993); Lagrange et al., *Plant Cell* 9:1469-1479 (1997); Zhou et al., *J. Biol. Chem.* 267:23515-23519 (1992)), prolamin box elements, (Forde et al., *Nucleic Acids Res.* 13:7327-7339 (1985); Colot et al., *EMBO J.* 6:3559-3564 (1987); Thomas et al., *Plant Cell* 2:1171-1180 (1990); Thompson et al., *Plant Mol. Biol.* 15:755-764 (1990); Vicente et al., *Proc. Natl. Acad. Sci. USA* 94:7685-7690 (1997)), elements in enhancers from the IgM heavy chain gene (Gillies et al., *Cell* 33:717-728 (1983); Whittier et al., *Nucleic Acids Res.* 15:2515-2535 (1987)).

Promoter Activity

The activity or strength of a promoter may be measured in terms of the amount of mRNA or protein accumulation it specifically produces, relative to the total amount of mRNA or protein. The promoter preferably expresses an operably linked nucleic acid sequence at a level greater than 0.01%; more preferably greater than 0.05, 0.1, 0.25, 0.5, 0.75, 1, 2, 3, 4, 5, 6, 7, 8, 9, 10, 11, 12, 13, 14, 15, 16, 17, 18, 19, or 20% (w/w) of the total cellular RNA or protein.

As used herein, an "expression pattern" is any pattern of differential gene expression. In a preferred embodiment, an expression pattern is selected from the group consisting of tissue, temporal, spatial, developmental, stress, environmental, physiological, pathological, cell cycle, and chemically responsive expression patterns.

As used herein, an "enhanced expression pattern" is any expression pattern for which an operably linked nucleic acid sequence is expressed at a level greater than 0.01%; more preferably greater than 0.05, 0.1, 0.25, 0.5, 0.75, 1, 2, 3, 4, 5, 6, 7, 8, 9, 10, 11, 12, 13, 14, 15, 16, 17, 18, 19, or 20% (w/w) of the total cellular RNA or protein.

Alternatively, the activity or strength of a promoter may be expressed relative to a well-characterized promoter (for which transcriptional activity was previously assessed). For example, a less-characterized promoter may be operably linked to a reporter sequence (e.g., GUS) and introduced into a specific cell type. A well-characterized promoter (e.g. the 35S promoter) is similarly prepared and introduced into the same cellular context. Transcriptional activity of the unknown promoter is determined by comparing the amount of reporter expression, relative to the well characterized promoter. In one embodiment, the activity of the present promoter is as strong as the 35S promoter when compared in the same cellular context. The cellular context is preferably rice, *sorghum*, maize, barley, wheat, canola, soybean, or maize; and more preferably is rice, *sorghum*, maize, barley, or wheat; and most preferably is rice.

Structural Nucleic Acid Sequences

The promoter of the present invention may be operably linked to a structural nucleic acid sequence that is heterologous with respect to the promoter. The structural nucleic acid sequence may generally be any nucleic acid sequence for which an increased level of transcription is desired. The structural nucleic acid sequence preferably encodes a polypeptide that is suitable for incorporation into the diet of a human or an animal. Suitable structural nucleic acid sequences include those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

Alternatively, the promoter and structural nucleic acid sequence may be designed to down-regulate a specific nucleic acid sequence. This is typically accomplished by linking the promoter to a structural nucleic acid sequence that is oriented in the antisense direction. One of ordinary skill in the art is familiar with such antisense technology. Briefly, as the antisense nucleic acid sequence is transcribed, it hybridizes to and sequesters a complimentary nucleic acid sequence inside the cell. This duplex RNA molecule cannot be translated into a protein by the cell's translational machinery. Any nucleic acid sequence may be negatively regulated in this manner.

Modified Structural Nucleic Acid Sequences

The promoter of the present invention may also be operably linked to a modified structural nucleic acid sequence that is heterologous with respect to the promoter. The structural nucleic acid sequence may be modified to provide various desirable features. For example, a structural nucleic acid sequence may be modified to increase the content of essential amino acids, enhance translation of the amino acid sequence, alter post-translational modifications (e.g., phosphorylation sites), transport a translated product to a compartment inside or outside of the cell, improve protein stability, insert or delete cell signaling motifs, etc.

Codon Usage in Structural Nucleic Acid Sequences

Due to the degeneracy of the genetic code, different nucleotide codons may be used to code for a particular amino acid. A host cell often displays a preferred pattern of codon usage. Structural nucleic acid sequences are preferably constructed to utilize the codon usage pattern of the particular host cell. This generally enhances the expression of the structural nucleic acid sequence in a transformed host cell. Any of the above described nucleic acid and amino acid sequences may be modified to reflect the preferred codon usage of a host cell or organism in which they are contained. Modification of a structural nucleic acid sequence for optimal codon usage in plants is described in U.S. Pat. No. 5,689,052.

Other Modifications of Structural Nucleic Acid Sequences

Additional variations in the structural nucleic acid sequences described above may encode proteins having equivalent or superior characteristics when compared to the proteins from which they are engineered. Mutations may include deletions, insertions, truncations, substitutions, fusions, shuffling of motif sequences, and the like.

Mutations to a structural nucleic acid sequence may be introduced in either a specific or random manner, both of which are well known to those of skill in the art of molecular biology. A myriad of site-directed mutagenesis techniques exist, typically using oligonucleotides to introduce mutations at specific locations in a structural nucleic acid sequence. Examples include single strand rescue (Kunkel et al., *Proc. Natl. Acad. Sci. U.S.A.*, 82: 488-492, 1985), unique site elimination (Deng and Nickloff, *Anal. Biochem.* 200:81, 1992), nick protection (Vandeyar, et al. *Gene* 65: 129-133, 1988), and PCR (Costa et al., *Methods Mol. Biol.* 57: 31-44, 1996). Random or non-specific mutations may be generated by chemical agents (for a general review, see Singer and Kusmierek, *Ann. Rev. Biochem.* 52: 655-693, 1982) such as nitrosoguanidine (Cerda-Olmedo et al., *J. Mol. Biol.* 33: 705-719, 1968; Guerola, et al. *Nature New Biol.* 230: 122-125, 1971) and 2-aminopurine (Rogan and Bessman, *J. Bacteriol.* 103: 622-633, 1970); or by biological methods such as passage through mutator strains (Greener, et al. *Mol. Biotechnol.* 7: 189-195, 1997).

The modifications may result in either conservative or non-conservative changes in the amino acid sequence. Conservative changes result from additions, deletions, substitutions, etc. in the structural nucleic acid sequence which do not alter the final amino acid sequence of the protein. In a preferred embodiment, the protein has between 20 and 500 conservative changes, more preferably between 15 and 300 conservative changes, even more preferably between 10 and 150 conservative changes, and most preferably between 5 and 75 conservative changes.

Non-conservative changes include additions, deletions, and substitutions which result in an altered amino acid sequence. In a preferred embodiment, the protein has between 10 and 250 non-conservative amino acid changes, more preferably between 5 and 100 non-conservative amino acid changes, even more preferably between 2 and 50 non-conservative amino acid changes, and most preferably between 1 and 30 non-conservative amino acid changes.

Additional methods of making the alterations described above are described by Ausubel et al., *Current Protocols in*

Molecular Biology, John Wiley and Sons, Inc., 1995, Bauer et al., Gene, 37:73, 1985; Craik, BioTechniques, 3: 12-19, 1985; Frits Eckstein et al., Nucleic Acids Research, 10: 6487-6497, 1982; Sambrook, et al., Molecular Cloning: A Laboratory Manual, Second Edition, Cold Spring Harbor Laboratory Press, Cold Spring Harbor, N.Y., 1989, Smith, et al, In: Genetic Engineering: Principles and Methods, Setlow et al., Eds., Plenum Press, N.Y., 1-32, 1981, and Osuna, et al., Critical Reviews In Microbiology, 20: 107-116, 1994.

Modifications may be made to the protein sequences of the present invention and the nucleic acid segments which encode them that maintain the desired properties of the molecule. The following is a discussion based upon changing the amino acid sequence of a protein to create an equivalent, or possibly an improved, second-generation molecule. The amino acid changes may be achieved by changing the codons of the structural nucleic acid sequence, according to the codons given in Table A.

TABLE A

Codon Degeneracy of Amino Acids

| Amino acid | One letter | Three letter | Codons |
|---|---|---|---|
| Alanine | A | Ala | GCA GCC GCG GCT |
| Cysteine | C | Cys | TGC TGT |
| Aspartic acid | D | Asp | GAC GAT |
| Glutamic acid | E | Glu | GAA GAG |
| Phenylalanine | F | Phe | TTC TTT |
| Glycine | G | Gly | GGA GGC GGG GGT |
| Histidine | H | His | CAC CAT |
| Isoleucine | I | Ile | ATA ATC ATT |
| Lysine | K | Lys | AAA AAG |
| Leucine | L | Leu | TTA TTG CTA CTC CTG CTT |
| Methionine | M | Met | ATG |
| Asparagine | N | Asn | AAC AAT |
| Proline | P | Pro | CCA CCC CCG CCT |
| Glutamine | Q | Gln | CAA CAG |
| Arginine | R | Arg | AGA AGG CGA CGC CGG CGT |
| Serine | S | Ser | AGC AGT TCA TCC TCG TCT |
| Threonine | T | Thr | ACA ACC ACG ACT |
| Valine | V | Val | GTA GTC GTG GTT |
| Tryptophan | W | Trp | TGG |
| Tyrosine | Y | Tyr | TAC TAT |

Certain amino acids may be substituted for other amino acids in a protein sequence without appreciable loss of the desired activity.

It is thus contemplated that various changes may be made in the peptide sequences of the disclosed protein sequences, or their corresponding nucleic acid sequences without appreciable loss of the biological activity.

In making such changes, the hydropathic index of amino acids may be considered. The importance of the hydropathic amino acid index in conferring interactive biological function on a protein is generally understood in the art (Kyte and Doolittle, J. Mol. Biol., 157: 105-132, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of their hydrophobicity and charge characteristics. These are: isoleucine (+4.5); valine (+4.2); leucine (+3.8); phenylalanine (+2.8); cysteine/cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate/glutamine/aspartate/asparagine (−3.5); lysine (−3.9); and arginine (−4.5).

It is known in the art that certain amino acids may be substituted by other amino acids having a similar hydropathic index or score and still result in a protein with similar biological activity, i.e., still obtain a biologically functional protein. In making such changes, the substitution of amino acids whose hydropathic indices are within ±2 is preferred, those within ±1 are more preferred, and those within ±0.5 are most preferred.

It is also understood in the art that the substitution of like amino acids may be made effectively on the basis of hydrophilicity. U.S. Pat. No. 4,554,101 (Hopp) states that the greatest local average hydrophilicity of a protein, as governed by the hydrophilicity of its adjacent amino acids, correlates with a biological property of the protein. The following hydrophilicity values have been assigned to amino acids: arginine/lysine (+3.0); aspartate/glutamate (+3.0±1); serine (+0.3); asparagine/glutamine (+0.2); glycine (0); threonine (−0.4); proline (−0.5±1); alanine/histidine (−0.5); cysteine (−1.0); methionine (−1.3); valine (−1.5); leucine/isoleucine (−1.8); tyrosine (−2.3); phenylalanine (−2.5); and tryptophan (−3.4).

It is understood that an amino acid may be substituted by another amino acid having a similar hydrophilicity score and still result in a protein with similar biological activity, i.e., still obtain a biologically functional protein. In making such changes, the substitution of amino acids whose hydropathic indices are within ±2 is preferred, those within ±1 are more preferred, and those within ±0.5 are most preferred.

As outlined above, amino acid substitutions are therefore based on the relative similarity of the amino acid side-chain substituents, for example, their hydrophobicity, hydrophilicity, charge, size, and the like. Exemplary substitutions which take various of the foregoing characteristics into consideration are well known to those of skill in the art and include: arginine and lysine; glutamate and aspartate; serine and threonine; glutamine and asparagine; and valine, leucine, and isoleucine. Changes which are not expected to be advantageous may also be used if these resulted proteins having improved rumen resistance, increased resistance to proteolytic degradation, or both improved rumen resistance and increased resistance to proteolytic degradation, relative to the unmodified polypeptide from which they are engineered.

Recombinant Vectors

Any of the promoters and structural nucleic acid sequences described above may be provided in a recombinant vector. A recombinant vector typically comprises, in a 5' to 3' orientation: a promoter to direct the transcription of a structural nucleic acid sequence and a structural nucleic acid sequence. The recombinant vector may further comprise a 3' transcriptional terminator, a 3' polyadenylation signal, other untranslated nucleic acid sequences, transit and targeting nucleic acid sequences, selectable markers, enhancers, and operators, as desired.

Means for preparing recombinant vectors are well known in the art. Methods for making recombinant vectors particularly suited to plant transformation include, without limitation, those described in U.S. Pat. Nos. 4,971,908, 4,940,835, 4,769,061 and 4,757,011. These type of vectors have also been reviewed (Rodriguez, et al. Vectors: A Survey of Molecular Cloning Vectors and Their Uses, Butterworths, Boston, 1988; Glick et al., Methods in Plant Molecular Biology and Biotechnology, CRC Press, Boca Raton, Fla., 1993).

Typical vectors useful for expression of nucleic acids in higher plants are well known in the art and include vectors derived from the tumor-inducing (Ti) plasmid of *Agrobacterium tumefaciens* (Rogers, et al., *Meth. In Enzymol,* 153: 253-277, 1987). Other recombinant vectors useful for plant transformation, including the pCaMVCN transfer control vector, have also been described (Fromm et al., *Proc. Natl. Acad. Sci. USA,* 82(17): 5824-5828, 1985).

Promoters in the Recombinant Vectors

The promoter used in the recombinant vector preferably transcribes a heterologous structural nucleic acid sequence at a high level in a plant. More preferably, the promoter hybridizes to a nucleic acid sequence selected from the group consisting of SEQ ID NO:1 through SEQ ID NO:57, 467, or any complements thereof; or any fragments thereof. Suitable hybridization conditions include those described above. A nucleic acid sequence of the promoter preferably hybridizes, under low or high stringency conditions, with SEQ ID NO:1 through SEQ ID NO:57,467, and any complements thereof. The promoter most preferably hybridizes under high stringency conditions to a nucleic acid sequence selected from the group consisting of SEQ ID NO:1 through SEQ ID NO:57,467, and any complements thereof.

In an alternative embodiment, the promoter comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO:1 through SEQ ID NO:57,467, and complements thereof. The promoter most preferably comprises a nucleic acid sequence selected from the group consisting of SEQ ID NO:1 through SEQ ID NO:57,467, any complements thereof, and any fragments thereof.

Additional Promoters in the Recombinant Vector

One or more additional promoters may also be provided in the recombinant vector. These promoters may be operably linked to any of the structural nucleic acid sequences described above. Alternatively, the promoters may be operably linked to other nucleic acid sequences, such as those encoding transit peptides, selectable marker proteins, or antisense sequences.

These additional promoters may be selected on the basis of the cell type into which the vector will be inserted. Promoters which function in bacteria, yeast, and plants are all well taught in the art. The additional promoters may also be selected on the basis of their regulatory features. Examples of such features include enhancement of transcriptional activity, inducibility, tissue-specificity, and developmental stage-specificity. In plants, promoters that are inducible, of viral or synthetic origin, constitutively active, temporally regulated, and spatially regulated have been described (Poszkowski, et al., *EMBO J.,* 3: 2719, 1989; Odell, et al., *Nature,* 313:810, 1985; Chau et al., *Science,* 244:174-181. 1989).

Often-used constitutive promoters include the CaMV 35S promoter (Odell, et al., *Nature,* 313: 810, 1985), the enhanced CaMV 35S promoter, the Figwort Mosaic Virus (FMV) promoter (Richins, et al., *Nucleic Acids Res.* 20: 8451, 1987), the mannopine synthase (mas) promoter, the nopaline synthase (nos) promoter, and the octopine synthase (ocs) promoter.

Useful inducible promoters include promoters induced by salicylic acid or polyacrylic acids (PR-1; Williams, et al., *Biotechnology* 10:540-543, 1992), induced by application of safeners (substituted benzenesulfonamide herbicides; Hershey and Stoner, *Plant Mol. Biol.* 17: 679-690, 1991), heat-shock promoters (Ou-Lee et al., *Proc. Natl. Acad. Sci U.S.A.* 83: 6815, 1986; Ainley et al., *Plant Mol. Biol.* 14: 949, 1990), a nitrate-inducible promoter derived from the spinach nitrite reductase structural nucleic acid sequence (Back et al., *Plant Mol. Biol.* 17: 9, 1991), hormone-inducible promoters (Yamaguchi-Shinozaki et al., *Plant Mol. Biol.* 15: 905, 1990), and light-inducible promoters associated with the small subunit of RuBP carboxylase and LHCP families (Kuhlemeier et al., *Plant Cell* 1: 471, 1989; Feinbaum et al., *Mol. Gen. Genet.* 226: 449-456, 1991; Weisshaar, et al., *EMBO J.* 10: 1777-1786, 1991; Lam and Chua, *J. Biol. Chem.* 266: 17131-17135, 1990; Castresana et al., *EMBO J.* 7: 1929-1936, 1988; Schulze-Lefert, et al., *EMBO J.* 8: 651, 1989).

Examples of useful tissue-specific, developmentally-regulated promoters include the β-conglycinin 7Sα promoter (Doyle et al., *J. Biol. Chem.* 261: 9228-9238, 1986; Slighton and Beachy, *Planta* 172: 356, 1987), and seed-specific promoters (Knutzon, et al., *Proc. Natl. Acad. Sci U.S.A.* 89: 2624-2628, 1992; Bustos, et al., *EMBO J.* 10: 1469-1479, 1991; Lam and Chua, *Science* 248: 471, 1991). Plant functional promoters useful for preferential expression in seed plastid include those from plant storage proteins and from proteins involved in fatty acid biosynthesis in oilseeds. Examples of such promoters include the 5' regulatory regions from such structural nucleic acid sequences as napin (Kridl et al., *Seed Sci. Res.* 1: 209, 1991), phaseolin, zein, soybean trypsin inhibitor, ACP, stearoyl-ACP desaturase, and oleosin. Seed-specific regulation is discussed in EP 0 255 378.

Another exemplary tissue-specific promoter is the lectin promoter, which is specific for seed tissue. The Lectin protein in soybean seeds is encoded by a single structural nucleic acid sequence (Le1) that is only expressed during seed maturation and accounts for about 2 to about 5% of total seed mRNA. The lectin structural nucleic acid sequence and seed-specific promoter have been fully characterized and used to direct seed specific expression in transgenic tobacco plants (Vodkin, et al., *Cell,* 34: 1023, 1983; Lindstrom, et al., *Developmental Genetics,* 11: 160, 1990).

Particularly preferred additional promoters in the recombinant vector include the nopaline synthase (nos), mannopine synthase (mas), and octopine synthase (ocs) promoters, which are carried on tumor-inducing plasmids of *Agrobacterium tumefaciens*; the cauliflower mosaic virus (CaMV) 19S and 35S promoters; the enhanced CaMV 35S promoter; the Figwort Mosaic Virus (FMV) 35S promoter; the light-inducible promoter from the small subunit of ribulose-1,5-bisphosphate carboxylase (ssRUBISCO); the EIF-4A promoter from tobacco (Mandel, et al., *Plant Mol. Biol,* 29: 995-1004, 1995); corn sucrose synthetase 1 (Yang, et al., *Proc. Natl. Acad. Sci. USA*, 87: 4144-48, 1990); corn alcohol dehydrogenase 1 (Vogel, et al., *J. Cell Biochem.*, (Suppl) 13D: 312, 1989); corn light harvesting complex (Simpson, *Science*, 233: 34, 1986); corn heat shock protein (Odell, et al., *Nature*, 313: 810, 1985); the chitinase promoter from *Arabidopsis* (Samac, et al., *Plant Cell*, 3:1063-1072, 1991); the LTP (Lipid Transfer Protein) promoters from broccoli (Pyee, et al., *Plant J.*, 7: 49-59, 1995); petunia chalcone isomerase (Van Tunen, et al., *EMBO J.* 7: 1257, 1988); bean glycine rich protein 1 (Keller, et al., *EMBO L.*, 8: 1309-1314, 1989); Potato patatin (Wenzler, et al., *Plant Mol. Biol.*, 12: 41-50, 1989); the ubiquitin promoter from maize (Christensen et al., *Plant Mol. Biol.*, 18: 675,689, 1992); and the actin promoter from rice (McElroy, et al., *Plant Cell*, 2:163-171, 1990).

The additional promoter is preferably seed selective, tissue selective, constitutive, or inducible. The promoter is most preferably the nopaline synthase (NOS), octopine synthase (OCS), mannopine synthase (MAS), cauliflower mosaic virus 19S and 35S (CaMV19S, CaMV35S), enhanced CaMV (eCaMV), ribulose 1,5-bisphosphate carboxylase (ssRUBISCO), figwort mosaic virus (FMV), CaMV derived AS4, tobacco RB7, wheat POX1, tobacco EIF-4, lectin protein (Le1), or rice RC2 promoter.

Structural Nucleic Acid Sequences in the Recombinant Nucleic Acid Vector

The promoter in the recombinant vector is preferably operably linked to a structural nucleic acid sequence. Exemplary structural nucleic acid sequences, and modified forms thereof, are described in detail above. The promoter of the present invention may be operably linked to a structural nucleic acid sequence that is heterologous with respect to the promoter. In one aspect, the structural nucleic acid sequence may generally be any nucleic acid sequence for which an increased level of transcription is desired. The structural nucleic acid sequence preferably encodes a polypeptide that is suitable for incorporation into the diet of a human or an animal. Suitable structural nucleic acid sequences include those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

Alternatively, the promoter and structural nucleic acid sequence may be designed to down-regulate a specific nucleic acid sequence. This is typically accomplished by linking the promoter to a structural nucleic acid sequence that is oriented in the antisense direction. One of ordinary skill in the art is familiar with such antisense technology. Using such an approach, a cellular nucleic acid sequence is effectively down regulated as the subsequent steps of translation are disrupted. Nucleic acid sequences may be negatively regulated in this manner.

Recombinant Vectors Having Additional Structural Nucleic Acid Sequences

The recombinant vector may also contain one or more additional structural nucleic acid sequences. These additional structural nucleic acid sequences may generally be any sequences suitable for use in a recombinant vector. Such structural nucleic acid sequences include any of the structural nucleic acid sequences, and modified forms thereof, described above. The additional structural nucleic acid sequences may also be operably linked to any of the above described promoters. The one or more structural nucleic acid sequences may each be operably linked to separate promoters. Alternatively, the structural nucleic acid sequences may be operably linked to a single promoter (i.e. a single operon).

The additional structural nucleic acid sequences preferably encode a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

Alternatively, the second structural nucleic acid sequence may be designed to down-regulate a specific nucleic acid sequence. This is typically accomplished by operably linking the second structural amino acid, in an antisense orientation, with a promoter. One of ordinary skill in the art is familiar with such antisense technology. The process is also briefly described above. Any nucleic acid sequence may be negatively regulated in this manner.

Selectable Markers

The recombinant vector may further comprise a selectable marker. The nucleic acid sequence serving as the selectable marker functions to produce a phenotype in cells which facilitates their identification relative to cells not containing the marker.

Examples of selectable markers include, but are not limited to, a neo gene (Potrykus, et al., *Ann. Rev. Plant Physiol. Plant Mol. Biol.*, 42: 205, 1991), which codes for kanamycin resistance and can be selected for using kanamycin, G418, etc.; a bar gene which codes for bialaphos resistance; a mutant EPSP synthase gene (Hinchee, et al., *Bio/Technology* 6:915-922, 1988) which encodes glyphosate resistance; a nitrilase gene which confers resistance to bromoxynil (Stalker, et al., *J. Biol. Chem.* 263:6310-6314, 1988); a mutant acetolactate synthase gene (ALS) which confers imidazolinone or sulphonylurea resistance (European Patent Application No. 0154204); green fluorescent protein (GFP); and a methotrexate resistant DHFR gene (Thillet, et al., *J. Biol. Chem.* 263:12500-12508, 1988).

Other exemplary selectable markers include: a β-glucuronidase or uidA gene (GUS), which encodes an enzyme for which various chromogenic substrates are known (Jefferson, *Plant Mol. Biol, Rep.* 5:387-405, 1987; Jefferson, et al., *EMBO J.* 6:3901-3907, 1987); an R-locus gene, which encodes a product that regulates the production of anthocyanin pigments (red color) in plant tissues (Dellaporta et al., Stadler Symposium 11:263-282, 1988); a β-lactamase gene (Sutcliffe et al., *Proc. Natl. Acad. Sci. (U.S.A.)* 75:3737-3741, 1978), which encodes an enzyme for which various chromogenic substrates are known (e.g., PADAC, a chromogenic cephalosporin); a luciferase gene (Ow, et al., *Science* 234:856-859, 1986); a xylE gene (Zukowsky, et al., *Proc. Natl. Acad. Sci. (U.S.A.)* 80:1101-1105, 1983) which encodes a catechol dioxygenase that can convert chromogenic catechols; an α-amylase gene (Ikatu et al., *Bio/Technol.* 8:241-242, 1990); a tyrosinase gene (Katz et al., *J. Gen. Microbiol.* 129:2703-2714, 1983), which encodes an enzyme capable of oxidizing tyrosine to DOPA and dopaquinone (which in turn condenses to melanin); and an α-galactosidase, which will turn a chromogenic α-galactose substrate.

Included within the term "selectable markers" are also genes which encode a secretable marker whose secretion can be detected as a means of identifying or selecting for transformed cells. Examples include markers that encode a secretable antigen that can be identified by antibody interaction, or even secretable enzymes which can be detected catalytically. Selectable secreted marker proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable marker genes will be apparent to those of skill in the art.

The selectable marker is preferably GUS, green fluorescent protein (GFP), neomycin phosphotransferase II (nptII), luciferase (LUX), an antibiotic resistance coding sequence, or an herbicide (e.g., glyphosate) resistance coding sequence. The selectable marker is most preferably a kanamycin, hygromycin, or herbicide resistance marker.

Other Elements in the Recombinant Vector

Various cis-acting untranslated 5' and 3' regulatory sequences may be included in the recombinant nucleic acid vector. Any such regulatory sequences may be provided in a recombinant vector with other regulatory sequences. Such combinations can be designed or modified to produce desirable regulatory features.

A 3' non-translated region typically provides a transcriptional termination signal, and a polyadenylation signal which functions in plants to cause the addition of adenylate nucleotides to the 3' end of the mRNA. These may be obtained from the 3' regions to the nopaline synthase (nos) coding sequence, the soybean 7Sα storage protein coding sequence, the albumin coding sequence, and the pea ssRUBISCO E9 coding sequence. Particularly preferred 3' nucleic acid sequences include nos 3', E9 3', ADR12 3', 7Sα 3', 11S 3', and albumin 3'.

Typically, nucleic acid sequences located a few hundred base pairs downstream of the polyadenylation site serve to terminate transcription. These regions are required for efficient polyadenylation of transcribed mRNA.

Translational enhancers may also be incorporated as part of the recombinant vector. Thus the recombinant vector may preferably contain one or more 5' non-translated leader sequences which serve to enhance expression of the nucleic acid sequence. Such enhancer sequences may be desirable to increase or alter the translational efficiency of the resultant mRNA. Preferred 5' nucleic acid sequences include dSSU 5', PetHSP70 5', and GmHSP17.9 5'.

The recombinant vector may further comprise a nucleic acid sequence encoding a transit peptide. This peptide may be useful for directing a protein to the extracellular space, a chloroplast, or to some other compartment inside or outside of the cell (see, e.g., European Patent Application Publication Number 0218571).

The structural nucleic acid sequence in the recombinant vector may comprise introns. The introns may be heterologous with respect to the structural nucleic acid sequence. Preferred introns include the rice actin intron and the corn HSP70 intron.

Fusion Proteins

Any of the above described structural nucleic acid sequences, and modified forms thereof, may be linked with additional nucleic acid sequences to encode fusion proteins. The additional nucleic acid sequence preferably encodes at least 1 amino acid, peptide, or protein. Production of fusion proteins is routine in the art and many possible fusion combinations exist.

For instance, the fusion protein may provide a "tagged" epitope to facilitate detection of the fusion protein, such as GST, GFP, FLAG, or polyHIS. Such fusions preferably encode between 1 and 50 amino acids, more preferably between 5 and 30 additional amino acids, and even more preferably between 5 and 20 amino acids.

Alternatively, the fusion may provide regulatory, enzymatic, cell signaling, or intercellular transport functions. For example, a sequence encoding a chloroplast transit peptide may be added to direct a fusion protein to the chloroplasts within a plant cell. Such fusion partners preferably encode between 1 and 1000 additional amino acids, more preferably between 5 and 500 additional amino acids, and even more preferably between 10 and 250 amino acids.

Probes and Primers

Short nucleic acid sequences having the ability to specifically hybridize to complementary nucleic acid sequences may be produced and utilized in the present invention. These short nucleic acid molecules may be used as probes to identify the presence of a complementary nucleic acid sequence in a given sample. Thus, by constructing a nucleic acid probe which is complementary to a small portion of a particular nucleic acid sequence, the presence of that nucleic acid sequence may be detected and assessed.

Use of these probes may greatly facilitate the identification of transgenic plants which contain the presently disclosed nucleic acid molecules. The probes may also be used to screen cDNA or genomic libraries for additional nucleic acid sequences related or sharing homology to the presently disclosed promoters and structural nucleic acid sequences.

Alternatively, the short nucleic acid sequences may be used as oligonucleotide primers to amplify or mutate a complementary nucleic acid sequence using PCR technology. These primers may also facilitate the amplification of related complementary nucleic acid sequences (e.g. related nucleic acid sequences from other species).

The short nucleic acid sequences may be used as probes and specifically as PCR probes. A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (on the Worldwide web at genome.wi.mit.edu/cgi-bin/primer/primer3.cgi), STSPipeline (on the Worldwide web at genome.wi.mit.edu/cgi-bin/www.STS_ Pipeline), or GeneUp (Pesole, et al., *BioTechniques* 25:112-123, 1998), for example, can be used to identify potential PCR primers.

The primer or probe is generally complementary to a portion of a nucleic acid sequence that is to be identified, amplified, or mutated. The primer or probe should be of sufficient length to form a stable and sequence-specific duplex molecule with its complement. The primer or probe preferably is about 10 to about 200 nucleotides long, more preferably is about 10 to about 100 nucleotides long, even more preferably is about 10 to about 50 nucleotides long, and most preferably is about 14 to about 30 nucleotides long.

The primer or probe may be prepared by direct chemical synthesis, by PCR (See, for example, U.S. Pat. Nos. 4,683,195, and 4,683,202), or by excising the nucleic acid specific fragment from a larger nucleic acid molecule.

Sequence Analysis

In the present invention, sequence similarity or identity is preferably determined using the "Best Fit" or "Gap" programs of the Sequence Analysis Software Package™ (Version 10; Genetics Computer Group, Inc., Center, Madison, Wis.). "Gap" utilizes the algorithm of Needleman and Wunsch (Needleman and Wunsch, *Journal of Molecular Biology* 48:443-453, 1970) to find the alignment of two sequences that maximizes the number of matches and minimizes the number of gaps. "BestFit" performs an optimal alignment of the best segment of similarity between two sequences. Optimal alignments are found by inserting gaps to maximize the number of matches using the local homology algorithm of Smith and Waterman (Smith, et al, *In: Genetic Engineering:Principles and Methods*, Setlow et al., Eds., Plenum Press, N.Y., 1-32, 1981; Smith and Waterman *Advances in Applied Mathematics*, 2:482-489, 1981).

The Sequence Analysis Software Package described above contains a number of other useful sequence analysis tools for identifying homologues of the presently disclosed nucleotide and amino acid sequences. For example, the "BLAST" program (Altschul, et al., *Journal of Molecular Biology* 215: 403-410, 1990) searches for sequences similar to a query sequence (either peptide or nucleic acid) in a specified database (e.g., sequence databases maintained at the National Center for Biotechnology Information (NCBI) in Bethesda, Md., USA); "FastA" (Lipman and Pearson, *Science*, 227:1435-1441, 1985; see also Pearson and Lipman, *Proceedings of the National Academy of Sciences USA* 85, 2444-2448, 1988; Pearson, *Methods in Enzymology*, (R. Doolittle, ed.), 183, 63-98, Academic Press, San Diego, Calif., USA, 1990) performs a Pearson and Lipman search for similarity between a query sequence and a group of sequences of the same type (nucleic acid or protein); "TfastA" performs a Pearson and Lipman search for similarity between a protein query sequence and any group of nucleotide sequences (it translates the nucleotide sequences in all six reading frames before performing the comparison); "FastX" performs a Pearson and Lipman search for similarity between a nucleotide query sequence and a group of protein sequences, taking frameshifts into account. "TfastX" performs a Pearson and Lipman search for similarity between a protein query sequence and any group of nucleotide sequences, taking frameshifts into account (it translates both strands of the nucleic acid sequence before performing the comparison).

Transgenic Plants and Plant Cells

The invention also includes and provides transformed plant cells which comprise a nucleic acid molecule of the present invention.

Preferred nucleic acid sequences of the present invention include, without limitation, recombinant vectors, structural nucleic acid sequences, promoters, and other regulatory elements, are described above. A promoter preferably comprises a nucleic acid sequence that hybridizes under stringent conditions with a nucleic, acid sequence selected from the group consisting of SEQ ID NO:1 through SEQ ID NO:57,467, any complement thereof; and any fragment thereof; or exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO:1 through SEQ ID NO:57,467, any complement thereof; and any fragment thereof. A promoter most preferably comprises SEQ ID NO:1 through SEQ ID NO:57,467.

Methods for preparing such recombinant vectors are well known in the art. For example, methods for making recombinant vectors particularly suited to plant transformation are described in U.S. Pat. Nos. 4,971,908, 4,940,835, 4,769,061 and 4,757,011. These vectors have also been reviewed (Rodriguez et al., Vectors: A Survey of Molecular Cloning Vectors and Their Uses, Butterworths, Boston, 1988; Glick, et al., Methods in Plant Molecular Biology and Biotechnology, CRC Press, Boca Raton, Fla., 1993) and are described above.

Typical vectors useful for expression of nucleic acids in plant cells are well known in the art and include vectors derived from the tumor-inducing (Ti) plasmid of *Agrobacterium tumefaciens* (Rogers, et al., *Meth. In Enzymol,* 153: 253-277, 1987). Other recombinant vectors useful for plant transformation, have also been described (Fromm et al., *Proc. Natl. Acad. Sci. USA,* 82(17): 5824-5828, 1985). Elements of such recombinant vectors are discussed above.

The transformed plant or cell may generally be any plant or cell that is compatible with the present invention. The plant or cell preferably is alfalfa, apple, banana, barley, bean, broccoli, cabbage, carrot, castorbean, celery, citrus, clover, coconut, coffee, corn, cotton, cucumber, garlic, grape, linseed, melon, oat, olive, onion, palm, parsnip, pea, peanut, pepper, potato, radish, rapeseed, rice, rye, *sorghum*, soybean, spinach, strawberry, sugarbeet, sugarcane, sunflower, tobacco, tomato, or wheat. The transformed plant or cell is more preferably rice, *sorghum*, maize, barley, wheat, canola, soybean, or maize; even more preferably a rice, *sorghum*, maize, barley, or wheat; and most preferably is rice. The rice plant or cell is preferably *Oryza sativa* L (*japonica* type), and more preferably *Oryza sativa* L (*japonica* type), cv. Nipponbare.

Typical vectors useful for expression of nucleic acids in cells and higher plants are well known in the art and include vectors derived from the tumor-inducing (Ti) plasmid of *Agrobacterium tumefaciens* (Rogers, et al., *Meth. In Enzymol,* 153: 253-277, 1987). Other recombinant vectors useful for plant transformation, have also been described (Fromm et al., *Proc. Natl. Acad. Sci. USA,* 82(17): 5824-5828, 1985). Elements of such recombinant vectors are discussed above.

Method for Preparing Transformed Cells

The invention is also directed to a method of producing transformed cells which comprise, in a 5' to 3' orientation, a promoter operably linked to a heterologous structural nucleic acid sequence. Other sequences may also be introduced into the cell along with the promoter and structural nucleic acid sequence. These other sequences may include 3' transcriptional terminators, 3' polyadenylation signals, other untranslated sequences, transit or targeting sequences, selectable markers, enhancers, and operators.

Preferred recombinant vectors, structural nucleic acid sequences, promoters, and other regulatory elements are described above. The promoter preferably has a nucleic acid sequence that hybridizes under stringent conditions with SEQ ID NO:1 through SEQ ID NO:57,467, or any complement thereof; or exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to SEQ ID NO:1 through SEQ ID NO:57,467.

The method generally comprises the steps of selecting a suitable host cell, transforming the host cell with a recombinant vector, and obtaining the transformed host cell.

There are many methods for introducing nucleic acids into plant cells. Suitable methods include bacterial infection (e.g. *Agrobacterium*), binary bacterial artificial chromosome vectors, direct delivery of DNA (e.g. via PEG-mediated transformation, desiccation/inhibition-mediated DNA uptake, electroporation, agitation with silicon carbide fibers, and acceleration of DNA coated particles, etc. (reviewed in Potrykus, et al., *Ann. Rev. Plant Physiol. Plant Mol. Biol.*, 42: 205, 1991).

Technology for introduction of DNA into cells is well known to those of skill in the art. These methods can generally be classified into four categories: (1) chemical methods (Graham and Van der Eb, *Virology*, 54(2): 536-539, 1973; Zatloukal, et al., *Ann. N.Y. Acad. Sci.*, 660: 136-153, 1992); (2) physical methods such as microinjection (Capecchi, *Cell*, 22(2): 479-488, 1980), electroporation (Wong and Neumann, *Biochim. Biophys. Res. Commun.*, 107(2): 584-587, 1982; Fromm et al., *Proc. Natl. Acad. Sci. USA*, 82(17): 5824-5828, 1985; U.S. Pat. No. 5,384,253) and particle acceleration (Johnston and Tang, *Methods Cell Biol.*, 43(A): 353-365, 1994; Fynan et al., *Proc. Natl. Acad. Sci. USA*, 90(24): 11478-11482, 1993); (3) viral vectors (Clapp, *Clin. Perinatol.*, 20(1): 155-168, 1993; Lu, et al., *J. Exp. Med.*, 178(6): 2089-2096, 1993; Eglitis and Anderson, *Biotechniques*, 6(7): 608-614, 1988); and (4) receptor-mediated mechanisms (Curiel et al., *Hum. Gen. Ther.*, 3(2):147-154, 1992; Wagner, et al., *Proc. Natl. Acad. Sci. USA*, 89(13): 6099-6103, 1992). Alternatively, nucleic acids can be directly introduced into pollen by directly injecting a plant's reproductive organs (Zhou, et al., *Methods in Enzymology*, 101: 433, 1983; Hess, *Intern Rev. Cytol.*, 107: 367, 1987; Luo, et al., *Plant Mol Biol. Reporter*, 6: 165, 1988; Pena, et al., *Nature*, 325: 274, 1987). The nucleic acids may also be injected into immature embryos (Neuhaus, et al., *Theor. Appl. Genet.*, 75: 30, 1987).

The recombinant vector used to transform the host cell typically comprises, in a 5' to 3' orientation: a promoter to direct the transcription of a structural nucleic acid sequence, a structural nucleic acid sequence, a 3' transcriptional terminator, and a 3' polyadenylation signal. The recombinant vector may further comprise untranslated nucleic acid sequences, transit and targeting nucleic acid sequences, selectable markers, enhancers, or operators.

Suitable recombinant vectors, structural nucleic acid sequences, promoters, and other regulatory elements include, without limitation, those described above.

The regeneration, development, and cultivation of plants from transformed plant protoplast or explants is well taught in the art (Weissbach and Weissbach, *Methods for Plant Molecular Biology*, (Eds.), Academic Press, Inc., San Diego, Calif., 1988; Horsch et al., *Science*, 227: 1229-1231, 1985). In this method, transformants are generally cultured in the presence of a selective media which selects for the successfully transformed cells and induces the regeneration of plant shoots (Fraley et al., *Proc. Natl. Acad. Sci. U.S.A.*, 80: 4803, 1983). These shoots are typically obtained within two to four months.

The shoots are then transferred to an appropriate root-inducing medium containing the selective agent and an antibiotic to prevent bacterial growth. Many of the shoots will develop roots. These are then transplanted to soil or other media to allow the continued development of roots. The method, as outlined, will generally vary depending on the particular plant strain employed.

The regenerated transgenic plants are self-pollinated to provide homozygous transgenic plants. Alternatively, pollen obtained from the regenerated transgenic plants may be crossed with non-transgenic plants, preferably inbred lines of agronomically important species. Conversely, pollen from non-transgenic plants may be used to pollinate the regenerated transgenic plants.

The transgenic plant may pass along the transformed nucleic acid sequence to its progeny. The transgenic plant is preferably homozygous for the transformed nucleic acid sequence and transmits that sequence to all of its offspring upon as a result of sexual reproduction. Progeny may be grown from seeds produced by the transgenic plant. These additional plants may then be self-pollinated to generate a true breeding line of plants.

The progeny from these plants are evaluated, among other things, for gene expression. The gene expression may be detected by several common methods such as western blotting, northern blotting, immunoprecipitation, and ELISA.

Methods for transforming dicots, primarily by use of *Agrobacterium tumefaciens* and obtaining transgenic plants have been published for cotton (U.S. Pat. Nos. 5,004,863; 5,159,135; 5,518,908); soybean (U.S. Pat. Nos. 5,569,834; 5,416,011; McCabe, et al., *Biotechnology*, 6: 923, 1988; Christou et al., *Plant Physiol.* 87:671-674 (1988)); *Brassica* (U.S. Pat. No. 5,463,174); peanut (Cheng et al., *Plant Cell Rep.* 15:653-657 (1996), McKently et al., *Plant Cell Rep.* 14:699-703 (1995)); papaya; and pea (Grant et al., *Plant Cell Rep.* 15:254-258 (1995)).

Transformation of monocotyledons using electroporation, particle bombardment and *Agrobacterium* have also been reported. Transformation and plant regeneration have been achieved in asparagus (Bytebier et al., *Proc. Natl. Acad. Sci.* (USA) 84:5354 (1987)); barley (Wan and Lemaux, *Plant Physiol* 104:37 (1994)); maize (Rhodes et al., *Science* 240: 204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995)); oat (Somers et al., *Bio/Technology* 10:1589 (1992)); orchard grass (Horn et al., *Plant Cell Rep.* 7:469 (1988)); rice (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)) and wheat (Vasil et al., *Bio/Technology* 10:667 (1992); U.S. Pat. No. 5,631,152).

Other Transformed Organisms

Any of the above described promoters and structural nucleic acid sequences may be introduced into any cell or organism such as a mammalian cell, mammal, fish cell, fish, bird cell, bird, algae cell, algae, fungal cell, fungi, or bacterial cell. Preferred hosts and transformants include: fungal cells such as *Aspergillus*, yeasts, mammals (particularly bovine and porcine), insects, bacteria and algae.

The transformed cell or organism is preferably prokaryotic, more preferably a bacterial cell, even more preferably a *Agrobacterium*, *Bacillus*, *Escherichia*, *Pseudomonas* cell, and most preferably is an *Escherichia coli* cell. Alternatively, the transformed organism is preferably a yeast or fungal cell. The yeast cell is preferably a *Saccharomyces cerevisiae*, *Schizosaccharomyces pombe*, or *Pichia pastoris*.

Methods to transform such cells or organisms are known in the art (EP 0238023; Yelton et al., *Proc. Natl. Acad. Sci.* (*U.S.A.*), 81:1470-1474 (1984); Malardier et al., *Gene*, 78:147-156 (1989); Becker and Guarente, In: Abelson and Simon (eds.,), *Guide to Yeast Genetics and Molecular Biology, Methods Enzymol.*, Vol. 194, pp. 182-187, Academic Press, Inc., New York; Ito et al., *J. Bacteriology*, 153:163 (1983); Hinnen et al., *Proc. Natl. Acad. Sci.* (U.S.A.), 75:1920 (1978); Bennett and LaSure (eds.), *More*

*Gene Manipulations in Fungi*, Academic Press, CA (1991)). Methods to produce proteins of the present invention from such organisms are also known (Kudla et al., *EMBO*, 9:1355-1364 (1990); Jarai and Buxton, *Current Genetics*, 26:2238-2244 (1994); Verdier, *Yeast*, 6:271-297 (1990); MacKenzie et al., *Journal of Gen. Microbiol.*, 139:2295-2307 (1993); Hartl et al., *TIBS*, 19:20-25 (1994); Bergeron et al., *TIBS*, 19:124-128 (1994); Demolder et al., *J. Biotechnology*, 32:179-189 (1994); Craig, *Science*, 260:1902-1903 (1993); Gething and Sambrook, *Nature*, 355:33-45 (1992); Puig and Gilbert, *J. Biol. Chem.*, 269:7764-7771 (1994); Wang and Tsou, *FASEB Journal*, 7:1515-1517 (9193); Robinson et al., *Bio/Technology*, 1:381-384 (1994); Enderlin and Ogrydziak, *Yeast*, 10:67-79 (1994); Fuller et al., *Proc. Natl. Acad. Sci. (U.S.A.)*, 86:1434-1438 (1989); Julius et al., *Cell*, 37:1075-1089 (1984); Julius et al., *Cell*, 32:839-852 (1983)).

Exemplary Uses

The presently disclosed promoter sequences may be used as genetic markers and employed in genetic mapping studies using linkage analysis. A genetic linkage map shows the relative locations of specific DNA markers along a chromosome. Maps are used for the identification of genes associated with genetic diseases or phenotypic traits, comparative genomics, and as a guide for physical mapping. Through genetic mapping, a fine scale linkage map can be developed using DNA markers, and, then, a genomic DNA library of large-sized fragments can be screened with molecular markers linked to the desired trait. In a preferred embodiment of the present invention, a genomic library is screened with the promoter sequences of the present invention.

Mapping marker locations is based on the observation that two markers located near each other on the same chromosome will tend to be passed together from parent to offspring. During gamete production, DNA strands occasionally break and rejoin in different places on the same chromosome or on the homologous chromosome. The closer the markers are to each other, the more tightly linked and the less likely a recombination event will fall between and separate them. Recombination frequency thus provides an estimate of the distance between two markers.

In segregating populations, target genes have been reported to have been placed within an interval of 5-10 cM with a high degree of certainty (Tanksley et al., *Trends in Genetics* 11(2):63-68 (1995)). The markers defining this interval are used to screen a larger segregating population to identify individuals derived from one or more gametes containing a crossover in the given interval. Such individuals are useful in orienting other markers closer to the target gene. Once identified, these individuals can be analyzed in relation to all molecular markers within the region to identify those closest to the target.

Markers of the present invention can be employed to construct linkage maps and to locate genes with qualitative and quantitative effects. The genetic linkage of additional marker molecules can be established by a genetic mapping model such as, without limitation, the flanking marker model reported by Lander and Botstein, *Genetics*, 121:185-199 (1989), and the interval mapping, based on maximum likelihood methods described by Lander and Botstein, *Genetics*, 121:185-199 (1989), and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990)). Additional software includes Qgene, Version 2.23 (1996), Department of Plant Breeding and Biometry, 266 Emerson Hall, Cornell University, Ithaca, N.Y.). Use of the Qgene software is a particularly preferred approach.

A maximum likelihood estimate (MLE) for the presence of a marker is calculated, together with an MLE assuming no QTL effect, to avoid false positives. A log 10 of an odds ratio (LOD) is then calculated as: LOD=log 10 (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics*, 121:185-199 (1989), and further described by Arús and Moreno-González, *Plant Breeding*, Hayward, Bosemark, Romagosa (eds.) Chapman & Hall, London, pp. 314-331 (1993).

Additional models can be used. Many modifications and alternative approaches to interval mapping have been reported, including the use of non-parametric methods (Kruglyak and Lander, *Genetics*, 139:1421-1428 (1995)). Multiple regression methods or models can be also be used, in which the trait is regressed on a large number of markers (Jansen, *Biometrics in Plant Breed*, van Oijen, Jansen (eds.) Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994). Procedures combining interval mapping with regression analysis, whereby the phenotype is regressed onto a single putative QTL at a given marker interval, and at the same time onto a number of markers that serve as 'cofactors,' have been reported by Jansen and Stam, *Genetics*, 136:1447-1455 (1994) and Zeng, *Genetics*, 136:1457-1468 (1994). Generally, the use of cofactors reduces the bias and sampling error of the estimated QTL positions (Utz and Melchinger, *Biometrics in Plant Breeding*, van Oijen, Jansen (eds.) Proceedings of the Ninth Meeting of the Eucarpia Section Biometrics in Plant Breeding, The Netherlands, pp. 195-204 (1994), thereby improving the precision and efficiency of QTL mapping (Zeng, *Genetics*, 136:1457-1468 (1994)). These models can be extended to multi-environment experiments to analysis genotype-environment interactions (Jansen et al., *Theo. Appl. Genet.* 91:33-37 (1995)).

Selection of an appropriate mapping population is important to map construction. The choice of appropriate mapping population depends on the type of marker systems employed (Tanksley et al., *J.P. Gustafson and R. Appels* (eds.), Plenum Press, New York, pp. 157-173 (1988)). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An F2 population is the first generation of selfing after the hybrid seed is produced. Usually a single F1 plant is selfed to generate a population segregating for all the genes in Mendelian (1:2:1) fashion. Maximum genetic information is obtained from a completely classified F2 population using a codominant marker system (Mather, Measurement of Linkage in Heredity: Methuen and Co., (1938)). In the case of dominant markers, progeny tests (e.g., F3, BCF2) are required to identify the heterozygotes, thus making it equivalent to a completely classified F2 population. However, this procedure is often prohibitive because of the cost and time involved in progeny testing. Progeny testing of F2 individuals is often used in map construction where phenotypes do not consistently reflect genotype (e.g., disease resistance) or where trait expression is controlled by a QTL. Segregation data from progeny test populations (e.g., F3 or BCF2) can be used in map construction. Marker-assisted selection can then be applied to cross progeny based on marker-trait map associations (F2, F3), where linkage groups have not been completely disassociated by recombination events (i.e., maximum disequilibrium).

Recombinant inbred lines (RIL) (genetically related lines; usually >F5, developed from continuously selfing F2 lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter, *Proc. Natl. Acad. Sci. USA* 89:1477-1481 (1992)). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci. USA* 89:1477-1481 (1992)). Information obtained from backcross populations using either codominant or dominant makers is less than that obtained from F2 populations because one, rather than two, recombinant gametes are sampled per plant. Backcross populations, however, are more informative (at low marker saturation) when compared to RILs as the distance between linked loci increases in RIL populations (i.e., about 0.15% recombination). Increased recombination can be beneficial for resolution of tight linkages, but may be undesirable in the construction of maps with low marker saturation.

Near-isogenic lines (NIL) (created by many backcrosses to produce an array of individuals that are nearly identical in genetic composition except for the trait or genomic region under interrogation) can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci. USA* 88:9828-9832 (1991)). In BSA, two bulked DNA samples are drawn from a segregating population originating from a single cross. These bulks contain individuals that are identical for a particular trait (resistant or susceptible to particular disease) or genomic region but arbitrary at unlinked regions (i.e., heterozygous). Regions unlinked to the target region will not differ between the bulked samples of many individuals in BSA.

It is understood that one or more of the nucleic acid molecules of the present invention may in one embodiment be used as markers in genetic mapping. In a preferred embodiment, nucleic acid molecules of the present invention may in one embodiment be used as markers with rice.

Nucleic acid molecules of the present invention can be used in comparative mapping (physical and genetic) and to isolate molecules from other cereals based on the syntenic relationship between cereals. Comparative mapping within families provides a method to the degree of sequence conservation, gene order, ploidy of species, ancestral relationships and the rates at which individual genomes are evolving. Comparative mapping has been carried out by cross-hybridizing molecular markers across species within a given family.

In a preferred embodiment, the nucleic acid, molecules of the present invention can be utilized to isolate corresponding syntenic regions in non-rice plants (Bennetzen and Freeling, *Trends in Genet.*, 9(8):259-261 (1993); Ahn et al., *Mol. Gen. Genet.*, 241(5-6):483-490 (1993); Schwarzacher, *Cur. Opin. Genet. & Devel.*, 4(6): 868-874 (1994); Kurata et al., *Bio/Technology*, 12:276-278 (1994); Kilian et al., *Nucl. Acids Res.*, 23(14):2729-2733 (1995); Bennett, *Symp. Soc. Exp. Biol.*, 50:45-52 (1996); Hu et al., *Genetics*, 142(3):1021-1031 (1996); Kilian, *Plant Mol. Biol.*, 35:187-195 (1997); Bennetzen and Freeling, *Genome Res.*, 7(4):301-306 (1997); Foote et al., *Genetics*, 147(2):801-807 (1997); Gallego et al., *Genome*, 41(3):328-336 (1998)). Gale and Devos, *Proc. Natl. Acad. Sci. USA* 95:1971-1974 (1998); Bennetzen et al., *Proc. Natl. Acad. Sci. USA*, 95:1975-1978 (1998); Messing and Llaca, *Proc. Natl. Acad. Sci. USA* 95:2017-2020 (1998); McCouch, *Proc. Natl. Acad. Sci. USA*, 95:1983-1985 (1998); Goff, *Curr. Opin. Plant Biol.* 2:85-89 (1999); Bailey et al., *Theor. Appl. Genet.*, 98:281-284 (1999); Zhang et al., *Proc. Natl. Acad. Sci. USA*, 91:8675-8679 (1994); Yano and Sasaki, *Plant Mol. Biol.*, 35:145-153 (1997); Leister et al., *Proc. Natl. Acad. Sci. USA*, 95:370-375 (1998); Lin et al., *Phytopathology* 86(11):1156-1159 (1996); Havukkala, *Curr. Opin. Genet. Dev.*, 96:711-713 (1996); and Lee, *The Society for Experimental Biology*, pp. 31-38 (1996). Synteny between rice and barley has recently been reported in the genomic region carrying malting quality Quantitative Trait Loci (QTL) (Kleinhofs et al., *Genome* 41:373-380 (1998)). Likewise, mapping of the liguless region of *sorghum*, a region containing a developmental control gene, was facilitated using molecular markers from a syntenic region of the rice genome (Christou et al., *Genetics* 148:1983-1992 (1998)).

In a particularly preferred embodiment, the nucleic acid molecules of the present invention that define a genomic region in rice plants associated with a desirable phenotype are utilized to obtain corresponding syntenic regions in non-rice plants. A region can be defined either physically or genetically. In an even more preferred embodiment, the nucleic acid molecules of the present invention that define a genomic region in rice plants associated with a desirable phenotype are utilized to obtain corresponding syntenic regions in corn plants. A region can be defined either physically or genetically.

One or more of the nucleic acids molecules may be used to define a physical genomic region. For example, two nucleic acid molecules of the present invention can act to define a physical genomic region that lies between them. Moreover, for example, a physical genomic region may be defined by a distance relative to a nucleic acid molecule. In a preferred embodiment of the present invention, the defined physical genomic region is less than about 1,000 kb, more preferably less than about 500 kb, even more preferably less than about 100 kb or less than about 50 kb.

One or more of the nucleic acids molecules may be used to define a genomic region by its genetic distance from one or more of the nucleic acid molecules of the present invention. In a preferred embodiment of the present invention, the genomic region is defined by its linkage to a nucleic acid molecule of the present invention. In such a preferred embodiment, the genomic region that is defined by one or more nucleic acid molecules of the present invention is located within about 50 centimorgans, more preferably within about 20 centimorgans, even more preferably with about 10, about 5 or about 2 centimorgans of the trait or marker at issue.

In another particularly preferred embodiment, two or more nucleic acid molecules of the present invention derived from rice plants that flank a genomic region of interest in rice plants are used to isolate the syntenic region in another cereal, more preferably maize, sorghum, barley, or wheat. Regions of interest in rice include, without limitation, those regions that are associated with a commercially desirable phenotype in rice. In another particularly preferred embodiment the desirable phenotype in rice is the result of a quantitative trait locus (QTL) present in the region.

One exemplary approach to isolate syntenic genomic regions is as follows. Nucleic acid sequences derived from rice of the present invention can be used to select large insert clones from a total genomic DNA library of a related species such as maize, sorghum, barley, or wheat. Any appropriate method to screen the genomic library with a nucleic acid molecule of the present invention may be used to select the required clones (See, for example, Birren et al., *Detecting Genes: A Laboratory Manual*, Cold Spring Harbor, N.Y., N.Y. (1998)). For example, direct hybridization of a nucleic acid molecule of the present invention to mapping filters comprising the genomic DNA of the syntenic species can be used to select large insert clones from a total genomic DNA library of a related species. The selected clones can then be used to physically map the region in the target species. An advantage of this method for comparative mapping is that no mapping population or linkage map of the target species is needed and the clones may also be used in other closely related species. By comparing the results obtained by genetic mapping in model plants, with those from other species, similarities of genomic structure among plants species can be established. Cross-hybridization of RFLP markers have been reported and conserved gene order has been established in many studies. Such macroscopic synteny is utilized for the estimation of correspondence of loci among these crops. These loci include not only Mendelian genes but also Quantitative Trait Loci (QTL) (Mohan et al., *Molecular Breeding* 3:87-103 (1997)). Other methods to isolate syntenic nucleic acid molecules may be used.

It is understood that markers of the present invention may be used in comparative mapping. In a preferred embodiment the markers of present invention may be used in the comparative mapping of cereals, more preferably maize, barley, sorghum, and wheat.

It is understood that markers of the present invention may be used to isolate promoters and other nucleic acid sequences from other cereals based on the syntenic relationship between such cereals. In a preferred embodiment the cereal is selected from the group of maize, sorghum, barley, and wheat.

The nucleic acid molecules of the present invention can be used to identify polymorphisms. In one embodiment, one or more of the nucleic acid molecules may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s). In a preferred embodiment, the plant is selected from the group consisting of cereals, and more preferably rice, maize, barley, sorghum, and wheat.

In an alternative embodiment, such polymorphisms can be detected through the use of a marker nucleic acid molecule that is physically linked to such polymorphism(s). For this purpose, marker nucleic acid sequences located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members may have the original sequence (i.e., the original "allele") whereas other members may have the variant sequence (i.e., the variant "allele"). In the simplest case, only one variant sequence may exist, and the polymorphism is thus said to be di-allelic. In other cases, the population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113-115 (1992); Jones et al., *Eur. J. Haematol.* 39:144-147 (1987); Horn et al., PCT Application WO91/14003; Jeffreys, European Patent Application 370,719; Jeffreys, U.S. Pat. No. 5,175,082; Jeffreys et al., *Amer. J. Hum. Genet.* 39:11-24 (1986); Jeffreys et al., *Nature* 316:76-79 (1985); Gray et al., *Proc. R. Acad. Soc. Lond.* 243:241-253 (1991); Moore et al. *Genomics* 10:654-660 (1991); Jeffreys et al., *Anim. Genet.* 18:1-15 (1987); Hillel et al., *Anim. Genet.* 20:145-155 (1989); Hillel et al., *Genet.* 124:783-789 (1990)).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263-273 (1986); Erlich et al., European Patent Appln. 50,424; European Patent Appln. 84,796, European Patent Application 258,017, European Patent Appln. 237,362; Mullis, European Patent Appln. 201,184; Mullis, et al., U.S. Pat. No. 4,683,202; Erlich., U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci. USA* 88:189-193 (1991). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069).

The "Oligonucleotide Ligation Assay" ("OLA") may alternatively be employed (Landegren et al., *Science* 241: 1077-1080 (1988)). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al. have described a nucleic acid detection assay that combines attributes of PCR and OLA (Nickerson et al., *Proc. Natl. Acad. Sci. USA* 87:8923-8927 (1990)). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., *Genomics* 4:560 (1989)), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Application WO 89/06700; Kwoh et al., *Proc. Natl. Acad. Sci. USA* 86:1173-1177 (1989); Gingeras et al., PCT Application WO 88/10315; Walker et al., *Proc. Natl. Acad. Sci. USA* 89:392-396 (1992)).

The identification of a polymorphism can be determined in a variety of ways. By correlating the presence or absence of it in an plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58-67 (1982); Botstein et al., *Ann. J. Hum. Genet.* 32:314-331 (1980); Fischer et al. PCT Application WO90/13668; Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996)); Orita et al., *Genomics* 5:874-879 (1989)). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205:289-293 (1992); Suzuki et al., *Anal. Biochem.* 192:82-84 (1991); Lo et al., *Nucleic Acids Research* 20:1005-1009 (1992); Sarkar et al., *Genomics* 13:441-443 (1992)). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos et al., *Nucleic Acids Res.* 23:4407-4414 (1995). This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on Salix (Beismann et al., *Mol. Ecol.* 6:989-993 (1997)); *Acinetobacter* (Janssen et al., *Int. J. Syst. Bacteriol* 47:1179-1187 (1997)), *Aeromonas popoffi* (Huys et al., *Int. J. Syst. Bacteriol.* 47:1165-1171 (1997)), rice (McCouch et al., *Plant Mol. Biol.* 35:89-99 (1997)); Nandi et al., *Mol. Gen. Genet.* 255:1-8 (1997); Cho et al., *Genome* 39:373-378 (1996)), barley (*Hordeum vulgare*) (Simons et al., *Genomics* 44:61-70 (1997); Waugh et al., *Mol. Gen. Genet.* 255:311-321 (1997); Qi et al., *Mol. Gen. Genet.* 254:330-336 (1997); Becker et al., *Mol. Gen.*

*Genet.* 249:65-73 (1995)), potato (Van der Voort et al., *Mol. Gen. Genet.* 255:438-447 (1997); Meksem et al., *Mol. Gen. Genet.* 249:74-81 (1995)), *Phytophthora infestans* (Van der Lee et al., *Fungal Genet. Biol.* 21:278-291 (1997)), *Bacillus anthracis* (Keim et al., *J. Bacteriol.* 179:818-824 (1997)), *Astragalus cremnophylax* (Travis et al., *Mol. Ecol.* 5:735-745 (1996)), *Arabidopsis* (Cnops et al., *Mol. Gen. Genet.* 253:32-41 (1996)), *Escherichia coli* (Lin et al., *Nucleic Acids Res.* 24:3649-3650 (1996)), *Aeromonas* (Huys et al., *Int. J. Syst. Bacteriol.* 46:572-580 (1996)), nematode (Folkertsma et al., *Mol. Plant Microbe Interact.* 9:47-54 (1996)), tomato (Thomas et al., *Plant J.* 8:785-794 (1995)), and human (Latorra et al., *PCR Methods Appl.* 3:351-358 (1994)). AFLP analysis has also been used for fingerprinting mRNA (Money et al., *Nucleic Acids Res.* 24:2616-2617 (1996); Bachem, et al., *Plant J.* 9:745-753 (1996)). It is understood that one or more of the promoter sequences of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res:* 18:6531-6535 (1990)) and cleavable amplified polymorphic sequences (CAPS) (Lyamichev et al., *Science* 260: 778-783 (1993)). It is understood that one or more of the promoter sequences of the present invention, may be utilized as markers or probes to detect polymorphisms by RAPD or CAPS analysis.

Promoter sequences of the present invention can be used to in a microarray-based method for high-throughput screening of plant genomic DNA. This 'chip'-based approach involves using microarrays of nucleic acid molecules as gene-specific hybridization targets to identify and quantitatively measure the corresponding plant genes (Schena et al., *Science* 270:467-470 (1995); Shalon, Ph.D. Thesis. Stanford University (1996)). Every nucleotide in a large sequence can be queried at the same time. Hybridization can be used to efficiently analyze nucleotide sequences.

Several microarray methods have been described. For example, microarrays of BACs may be prepared to sufficiently cover 3× of an entire genome. Such microarrays can be used in a variety of genomics experiments including gene mapping, DNA fingerprinting and promoter identification. Microarrays of genomic DNA can also be used for parallel analysis of genomes at single gene resolution (Lemieux et al., *Molecular Breeding* 277-289 (1988)). It is understood that one or more of the molecules of the present invention, preferably one or more of the promoter sequences of the present invention may be utilized in a genomic microarray based method. In a preferred embodiment of the present invention, one or more of the rice genomic promoter sequences may be utilized in a genomic microarray based method. For example, Genomic Mismatch Scanning (GMS), a hybridization-based method of linkage analysis that allows rapid identification of regions of identity-by-descent between two related individuals, can be carried out with microarrays. GMS is reported to have been used to identify genetically common chromosomal segments based on the ability of these DNA sequences to form extensive regions of mismatch-free heteroduplexes. A series of enzymatic steps, coupled with filter binding, is used to selectively remove heteroduplexes that contain mismatches (i.e., chromosomal regions that do not share identity-by descent.). Fragments of chromosomal DNA representing inherited regions are hybridized to a microarray of ordered genomic clones and positive hybridization signals pinpoint regions of identity-by-descent at high resolution (Lemieux et al., *Molecular Breeding* 277-289 (1988)).

It is understood that one or more of the nucleic acid molecules of the present invention may be utilized in a GMS microarray based method to locate regions of identity-by-descent between related individuals. In a preferred embodiment of the present invention, one or more of the nucleic acid molecules of the present invention may be utilized in a GMS microarray based method to locate regions of identity-by-descent between related individuals.

A particularly preferred microarray embodiment of the present invention is a microarray comprising nucleic acid molecules that are homologues of known sequences but elicit only limited or no matches to known nucleic acid molecules. A further preferred microarray embodiment of the present invention is a microarray comprising genomic nucleic acid molecules of the present invention that elicit only limited or no matches to known genes.

It is understood that one or more of the molecules of the present invention, preferably one or more of the promoter sequences of the present invention may be utilized in a microarray based method.

In a preferred embodiment of the present invention, one or more of the nucleic acid molecules of the present invention may be utilized in a microarray based method.

Computer Related Uses of the Invention

A nucleic acid molecule comprising SEQ ID NO:1 through SEQ ID NO:57,467, complements thereof and fragments of either, or a nucleic acid molecule that hybridizes under stringent conditions with SEQ ID NO:1 through SEQ ID NO:57,467, or any complement thereof; or exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to SEQ ID NO:57,467; can be "provided" in a variety of mediums to facilitate its. Such a medium can also provide a subset thereof in a form that allows a skilled artisan to examine the sequences.

In a preferred embodiment, at least 20, 50, 100, 500, 1,000, 2,000, 3,000, or 4,000 of the nucleic acid sequences of the present invention are provided in a variety of mediums. In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993)) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

As used herein, "a target structural motif," or "target motif," refers to any rationally selected sequence or combination of sequences in which the sequence(s) are chosen based on primary sequence'composition or a three dimensional configuration which is formed upon folding of the target motif. There are a variety of target motifs known in the art. Target motifs include, but are not limited to, transcription factor binding sites, repressor binding sites, inducible expression elements, transcriptional activation sites, transcription initiation sites, untranslated leaders, intron splicing sites, methylation sites, histone binding sites, RNA processing sites, non-histone structural protein binding sites, replication sites, sites which influence the stability of transcribed mRNA message and hairpin sites.

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration, and are not intended to be limiting of the present invention, unless specified.

Each periodical, patent, and other document or reference cited herein is herein incorporated by reference in its entirety.

EXAMPLES

The following examples are provided to better illustrate the practice of the present invention and should not be interpreted in any way to limit the scope of the present invention. Those skilled in the art will recognize that various modifications, truncations, etcetera can be made to the methods and genes described herein while not departing from the spirit and scope of the present invention.

Example 1

Generating a Genomic Bacterial Artificial Chromosome (BAC) Library

BACs are stable, non-chimeric cloning systems having genomic fragment inserts (100-300 kb) and their DNA can be prepared for most types of experiments including DNA sequencing. BAC vector, pBeloBAC11, is derived from the endogenous *E. coli* F-factor plasmid, which contains genes for strict copy number control and unidirectional origin of DNA replication. Additionally, pBeloBAC11 has three unique restriction enzyme sites (Hind III, Bam HI and Sph I) located within the LacZ gene which can be used as cloning sites for megabase-size plant DNA. Indigo, another BAC vector contains Hind III and Eco RI cloning sites. This vector also contains a random mutation in the LacZ gene that allows for darker blue colonies.

As an alternative, the P1-derived artificial chromosome (PAC) can be used as a large DNA fragment cloning vector (Ioannou, et al., *Nature Genet.* 6:84-89 (1994); Suzuki, et al., *Gene* 199:133-137 (1997)). The PAC vector has most of the features of the BAC system, but also contains some of the elements of the bacteriophage P1 cloning system.

BAC libraries are generated by ligating size-selected restriction digested DNA with pBeloBAC11 followed by electroporation into *E. coli*. BAC library construction and characterization is extremely efficient when compared to YAC (yeast artificial chromosome) library construction and analysis, particularly because of the chimerism associated with YACs and difficulties associated with extracting YAC DNA.

There are general methods for preparing megabase-size DNA from plants. For example, the protoplast method yields megabase-size DNA of high quality with minimal breakage. A process involves preparing young leaves which are manually feathered with a razor-blade before being incubated for four to five hours with cell-wall-degrading enzymes. A second method developed by Zhange et al., *Plant J.* 7:175-184 (1995), is a universal nuclei method that works well for several divergent plant taxa. Fresh or frozen tissue is homogenized with a blender or mortar and pestle. Nuclei are then isolated and embedded. DNA prepared by the nucleic method is often more concentrated and is reported to contain lower amounts of chloroplast DNA than the protoplast method.

Once protoplasts or nuclei are produced, they are embedded in an agarose matrix as plugs or microbeads. The agarose provides a support matrix to prevent shearing of the DNA while allowing enzymes and buffers to diffuse into the DNA. The DNA is purified and manipulated in the agarose and is stable for more than one year at 4° C.

Once high molecular weight DNA is prepared, it is fragmented to the desired size range. In general, DNA fragmentation utilizes two general approaches, 1) physical shearing and 2) partial digestion with a restriction enzyme that cuts relatively frequently within the genome. Since physical shearing is not dependent upon the frequency and distribution of particular restriction enzymes sites, this method should yield the most random distribution of DNA fragments. However, the ends of the sheared DNA fragments must be repaired and cloned directly or restriction enzyme sites added by the addition of synthetic linkers. Because of the subsequent steps required to clone DNA fragmented by shearing, most protocols fragment DNA by partial restriction enzyme digestion. The advantage of partial restriction enzyme digestion is that no further enzymatic modification of the ends of the restriction fragments are necessary. Four common techniques that can be used to achieve reproducible partial digestion of megabase-size DNA are 1) varying the concentration of the restriction enzyme, 2) varying the time of incubation with the restriction enzyme 3) varying the concentration of an enzyme cofactor (e.g., Mg2+) and 4) varying the ratio of endonuclease to methylase.

There are three cloning sites in pBeloBAC11, but only Hind III and Bam HI produce 5' overhangs for easy vector dephosphorylation. These two restriction enzymes are primarily used to construct BAC libraries. The optimal partial digestion conditions for megabase-size DNA are determined by wide and narrow window digestions. To optimize the optimum amount of Hind III, 1, 2, 3, 10, and 5-units of enzyme are each added to 50 ml aliquots of microbeads and incubated at 37° C. for 20 minutes.

After partial digestion of megabase-size DNA, the DNA is run on a pulsed-field gel, and DNA in a size range of 100-500 kb is excised from the gel. This DNA is ligated to the BAC vector or subjected to a second size selection on a pulsed field gel under different running conditions. Studies have previously reported that two rounds of size selection can eliminate small DNA fragments co-migrating with the selected range in the first pulse-field fractionation. Such a strategy results in an increase in insert sizes and a more uniform insert size distribution. A practical approach to performing size selections is to first test for the number of clones/microliter of ligation and insert size from the first size selected material. If the numbers are good (500 to 2000 white colony/microliter of ligation) and the size range is also good (50 to 300 kb) then a second size selection is practical. When performing a second size selection one expects a 80 to 95% decrease in the number of recombinant clones per transformation.

Twenty to two hundred nanograms of the size-selected DNA is ligated to dephosphorylated BAC vector (molar ratio of 10 to 1 in BAC vector excess). Most BAC libraries use a molar ratio of 5 to 15:1 (size selected DNA:BAC vector).

Transformation is carried out by electroporation and the transformation efficiency for BACs is about 40 to 1,500 transformants from one microliter of ligation product or 20 to 1000 transformants/ng DNA.

Several tests can be carried out to determine the quality of a BAC library. Three basic tests to evaluate the quality include: the genome coverage of a BAC library-average insert size, average number of clones hybridizing with single copy probes and chloroplast DNA content.

The determination of the average insert size of the library is assessed in two ways. First, during library construction every ligation is tested to determine the average insert size by assaying 20-50 BAC clones per ligation. DNA is isolated from recombinant clones using a standard mini preparation protocol, digested with Not I to free the insert from the BAC vector and then sized using pulsed field gel electrophoresis (Maule, *Molecular Biotechnology* 9:107-126 (1998)).

To determine the genome coverage of the library, it is screened with single copy RFLP markers distributed randomly across the genome by hybridization. Microtiter plates containing BAC clones are spotted onto Hybond membranes. Bacteria from 48 or 72 plates are spotted twice onto one membrane resulting in 18,000 to 27,648 unique clones on each membrane in either a 4×4 or 5×5 orientation. Since each clone is present twice, false positives are easily eliminated and true positives are easily recognized and identified.

Finally, the chloroplast DNA content in the BAC library is estimated by hybridizing three chloroplast genes spaced evenly across the chloroplast genome to the library on high density hybridization filters.

There are strategies for isolating rare sequences within the genome. For example, higher plant genomes can range in size from 100 Mb/1C (*Arabidopsis*) to 15,966 Mb/C (*Triticum aestivum*), (Arumuganathan and Earle, *Plant Mol Bio Rep.* 9:208-219 (1991)). The number of clones required to achieve a given probability that any DNA sequence will be represented in a genomic library is $N=(\ln(1-P))/(\ln(1-L/G))$ where N is the number of clones required, P is the probability desired to get the target sequence, L is the length of the average clone insert in base pairs and G is the haploid genome length in base pairs (Clarke et al., Cell 9:91-100 (1976)).

The rice BAC library of the present invention is constructed in the pBeloBAC11 or similar vector. Inserts are generated by partial Eco RI or other enzymatic digestion of DNA. The 25× library provides 4-5× coverage sequence from BAC clones across genome.

Example 2

Sequencing Genomic DNA Inserts from a Genomic BAC Library

Two basic methods can be used for DNA sequencing, the chain termination method of Sanger et al., Proc. Natl. Acad. Sci. USA 74:5463-5467 (1977), and the chemical degradation method of Maxam and Gilbert, Proc. Natl. Acad. Sci. USA 74:560-564 (1977). Automation and advances in technology such as the replacement of radioisotopes with fluorescence-based sequencing have reduced the effort required to sequence DNA (Craxton, Methods, 2:20-26 (1991); Ju et al., Proc. Natl. Acad. Sci. USA 92:4347-4351 (1995); Tabor and Richardson, Proc. Natl. Acad. Sci. USA 92:6339-6343 (1995)). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, Nucleic Acids Res. 18:1415-1419 (1990); Smith, Nature 349:812-813 (1991); Luckey et al., Methods Enzymol. 218: 154-172 (1993); Lu et al., J. Chromatog. A. 680:497-501 (1994); Carson et al., Anal. Chem. 65:3219-3226 (1993); Huang et al., Anal. Chem. 64:2149-2154 (1992); Kheterpal et al., Electrophoresis 17:1852-1859 (1996); Quesada and Zhang, Electrophoresis 17:1841-1851 (1996); Baba, Yakugaku Zasshi 117:265-281 (1997)).

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., Genome Analysis: Analyzing DNA, 1, Cold Spring Harbor, N.Y. (1999)).

PHRED is used to call the bases from the sequence trace files (on the Worldwide web at mbt.washington.edu). Phred uses Fourier methods to examine the four base traces in the region surrounding each point in the data set in order to predict a series of evenly spaced predicted locations. That is, it determines where the peaks would be centered if there were no compressions, dropouts, or other factors shifting the peaks from their "true" locations. Next, PHRED examines each trace to find the centers of the actual, or observed peaks and the areas of these peaks relative to their neighbors. The peaks are detected independently along each of the four traces so many peaks overlap. A dynamic programming algorithm is used to match the observed peaks detected in the second step with the predicted peak locations found in the first step.

After the base calling is completed, contaminating sequences (E. coli, BAC vector sequences>50 bases and sub-cloning vector are removed and constraints are made for the assembler. Contigs are assembled using CAP3 (Huang, et al., Genomics 46: 37-45 (1997)).

A two-step re-assembly process is employed to reduce sequence redundancies caused by overlaps between BAC clones. In the first step, BAC clones are grouped into clusters based on overlaps between contig sequences from different BACs. These overlaps are identified by comparing each sequence in the dataset against every other sequences, by BLASTN. BACs containing overlaps greater than 5,000 base pairs in length and greater than 94% in sequence identity are put into the same cluster. Repetitive sequences are masked prior to this procedure to avoid false joining by repetitive elements present in the genome. In the second step, sequences from each BAC cluster are assembled by PHRAP.longread, which is able to handle very long sequences. A minimum match is set at 100 bp and a minimum score is set at 600 as a threshold to join input contigs into longer contigs.

Example 3

Identifying Genes within a Genomic BAC Library

This example illustrates the identification of combigenes within the rice genomic contig library as assembled in Example 2. The genes and partial genes that are embedded in such contigs are identified through a series of informatic analyses. The tools to define genes fall into two categories: homology-based and predictive-based methods. Homology-based searches (e.g., GAP2, BLASTX supplemented by NAP and TBLASTX) detect conserved sequences during comparisons of DNA sequences or hypothetically translated protein sequences to public and/or proprietary DNA and protein databases. Existence of an Oryza sativa gene is inferred if significant sequence similarity extends over the majority of the target gene. Since homology-based methods may overlook genes unique to Oryza sativa, for which homologous nucleic acid molecules have not yet been identified in databases, gene prediction programs are also used. Predictive methods employed in the definition of the Oryza sativa genes included the use of the GenScan gene predictive software program which is available from Stanford University (e.g., at the website: gnomic/stanford.edu/GENSCANW.html, and the Genemark.hmm for Eukaryotes program from Gene Probe, Inc (Atlanta, Ga.) on the Worldwide web at geneprobe.net/index.htm). GenScan, in general terms, infers the presence and extent of a gene through a search for "gene-like" grammar. GeneMark.hmm searches a file containing DNA sequence data for genes. It employs a Hidden Markov Model algorithm with a species-specific inhomogeneous Markov model of gene-encoding regions of DNA.

The homology-based methods that are used to define the Oryza sativa gene set included GAP2, BLASTX supplemented by NAP and TBLASTX. For a description of BLASTX and TBLASTX see Coulson, Trends in Biotechnology 12:76-80 (1994) and Birren et al., Genome Analysis, 1:543-559 (1997). GAP2 and NAP are part of the Analysis and Annotation Tool (AAT) for Finding Genes in Genomic Sequences which was developed by Xiaoqiu Huang at Michigan Tech University and is available at the web site genome.cs.mtu.edu/. The AAT package includes two sets of programs, one set DPS/NAP (referred to as "NAP") for comparing the query sequence with a protein database, and the other set DDS/GAP2 (referred to as "GAP2") for comparing the query sequence with a cDNA database. Each set contains a fast database search program and a rigorous alignment program. The database search program identifies regions of the query sequence that are similar to a database sequence. Then the alignment program constructs an optimal alignment for each region and the database sequence. The alignment program also reports the coordinates of exons in the query sequence. See Huang, et al., *Genomics* 46: 37-45 (1997). The GAP2 program computes an optimal global alignment of a genomic sequence and a cDNA sequence without penalizing terminal gaps. A long gap in the cDNA sequence is given a constant penalty. The DNA-DNA alignment by GAP2 adjusts penalties to accommodate introns. The GAP2 program makes use of splice site consensuses in alignment computation. GAP2 delivers the alignment in linear space, so long sequences can be aligned. See Huang, *Computer Applications in the Biosciences* 10 227-235 (1994). The GAP2 program aligns the *Oryza sativa* contigs with a library of 42,260 *Oryza sativa* cDNAs.

The NAP program computes a global alignment of a DNA sequence and a protein sequence without penalizing terminal gaps. NAP handles frameshifts and long introns in the DNA sequence. The program delivers the alignment in linear space, so long sequences can be aligned. It makes use of splice site consensuses in alignment computation. Both strands of the DNA sequence are compared with the protein sequence and one of the two alignments with the larger score is reported. See Huang, and Zhang, *Computer Applications in the Biosciences* 12(6), 497-506 (1996).

NAP takes a nucleotide sequence, translates it in three forward reading frames and three reverse complement reading frames, and then compares the six translations against a protein sequence database (e.g. the non-redundant protein (i.e., nr-aa database maintained by the National Center for Biotechnology Information as part of GenBank and available at the web site: on the Worldwide web at ncbi.nlm.nih.gov).

The first homology-based search for genes in the *Oryza sativa* contigs is effected using the GAP2 program and the *Oryza sativa* library of clustered *Oryza sativa* cDNA. The *Oryza sativa* clusters are mapped onto an assembly of *Oryza sativa* contigs using the GAP2 program. GAP2 standards for selecting a DNA-DNA match are ≥92% sequence identity with the following parameters:

gap extension penalty=1
match score=2
gap open penalty=6
gap length for constant penalty=20
mismatch penalty=−2
minimum exon length=21
minimum total length of all exons in a gene (in nucleotide)=200

When a particular *Oryza sativa* cDNA aligns to more than one *Oryza sativa* contig, the alignment with the highest identity is selected and alignments with lower levels of identity are filtered out as surreptitious alignments. *Oryza sativa* cDNA sequences aligning to *Oryza sativa* contigs with exceptionally low complexity are filtered out when the basis for alignment included a high number of cDNAs with poly A tails aligning to genomic regions with extended repeats of A or T.

The second homology-based method used for gene discovery is BLASTX hits extended with the NAP software package. BLASTX is run with the *Oryza sativa* genomic contigs as queries against the GenBank non-redundant protein data library identified as "nr-aa". NAP is used to better align the amino acid sequences as compared to the genomic sequence. NAP extends the match in regions where BLASTX has identified high-scoring-pairs (HSPs), predicts introns, and then links the exons into a single ORF prediction. Experience suggests that NAP tends to mis-predict the first exon. The NAP parameters are:

gap extension penalty=1
gap open penalty=15
gap length for constant penalty=25
min exon length (in aa)=7
minimum total length of all exons in a gene (in nucleotide)=200
homology>40%

The NAP alignment score and GenBank reference number for best match are reported for each contig for which there is a NAP hit.

In the final homology-based method, TBLASTX, is used with cDNA information from four plant sequencing projects: 27,037 sequences from *Triticum aestivum*, 136,074 sequences from *Glycine max*, 71,822 sequences from *Zea mays* and 68,517 sequences from *Arabidopsis thaliana*. Conservative standards for inclusion of TBLASTX hits into the gene set are utilized. These standards are a minimal E value of 1E-16, and a minimal match of 150 bp in *Oryza sativa* contig.

The GenScan program is "trained" with *Arabidopsis thaliana* characteristics. Though better than the "off-the-shelf" version, the GenScan trained to identify *Oryza sativa* genes proved more proficient at predicting exons than predicting full-length genes. Predicting full-length genes is compromised by point mutations in the unfinished contigs, as well as by the short length of the contigs relative to the typical length of a gene. Due to the errors found in the full-length gene predictions by GenScan, inclusion of GenScan-predicted genes is limited to those genes and exons whose probabilities are above a conservative probability threshold. The GenScan parameters are:

weighted mean GenScan P value>0.4
mean GenScan T value>0
mean GenScan Coding score>50
length>200 bp
minimum total length of all exons in a gene=500

The weighted mean GenScan P value is a probability for correctly predicting ORFs or partial ORFs and is defined as the (1/SS li)(SS li Pi), where "l" is the length of a exon and "P" is the probability or correctness for the exon.

The GeneMark.hmm for Eukaryotes program uses the Hidden Markov model for species *Oryza Sativa*. Minimum total length of all exons in a gene is 500 bp. Except for the model selection, there is no specific run-time parameter for GeneMark.hmm.

The gene predictions from these programs are stored in a database and then combigenes are derived from these predictions. A combigene is a cluster of putative genes which satisfy the following criteria:

All genes making up a single combigene are located on the same strand of a contig;

Maximum intron size of a valid gene is 4000 bp;

Maximum distance between any two genes in the same combigene is 200 bp, as measured by the bases between adjacent ending exons;

If an individual gene is predicted by NAP it has at least 40% sequence identity to its hit;

If an individual gene is predicted by GAP2 it has at least 92% sequence identity to its hit;

If an individual gene is predicted by Genscan the weighted average of the probabilities calculated for all of its exons is not less than 0.4. The gene boundaries of a Genscan-predicted gene are determined while taking into account only exons.

Since TBLASTX-predicted genes are standless the combigene which is made up of such genes can be assigned a strand only if there is a gene in the cluster that was predicted by a strand-defining gene-predicting program.

Example 4

Identifying Promoters in the Genomic BAC Library Using Bioinformatic Techniques

Candidate promoter sequences are selected by identifying the regions of DNA located immediately upstream of "combigenes" as described and defined in Example 3. The length of the region to be extracted from the corresponding contig's sequence is set to be 1500 nucleotides plus the very first nucleotide of a combigene. Thus, if a combigene is sufficiently far from the edge of a contig a 1501 nucleotide sequence is obtained, otherwise the sequence will be shorter. Only coding region predictions are considered when building combigenes. Therefore, the 5' UTR of the putative cDNA is included as part of the combigene upstream region.

If there is an AAT/NAP-predicted component in a combigene, then the putative promoter sequence is extracted upstream of the beginning of that component, otherwise—the sequence is extracted upstream of the beginning of the combigene (which may correspond to Genscan, AAT/GAP or a TBLASTX prediction).

Promoter candidates are further selected using bioinformatic analysis of the candidate promoter sequence.

The candidate promoter regions listed in SEQ ID NO:1 through SEQ ID NO:57467 are analyzed for known promoter motifs listed in Table 2.

The identification of such motifs provides important information about the candidate promoter. For example, some motifs are associated with informative annotations such as "light inducible binding site" or "stress inducible binding motif" and can be used to select with confidence a promoter that is able to confer light inducibility or stress inducibility to an operably-linked transgene, respectively.

Putative promoter sequences are also searched with matrices for the TATA box, GC box (factor name: V_GC_01) and CCAAT box (factor name: F_HAP234_01). The matrix for the TATA box is from the Eukaryotic Promoter Database (on the Worldwide web at epd.isb-sib.ch/) and the matrices for the GC box and the CCAAT box are from Transfac (on the website transfac.gbfde/TRANSFAC/).

The algorithm that is used to annotate promoters searches for matches to both sequence motifs and matrix motifs. First, individual matches are found. For sequence motifs, a maximum number of mismatches is allowed (see Table 2). If the code M, R, W, S, Y, or K are listed in the sequence motif (each of which is a degenerate code for 2 nucleotides) 1/2 mismatch is allowed. If the code B, D, H, or V are listed in the sequence motif (each of which is a degenerate code for 3 nucleotides) 1/3 mismatch is allowed. p values are determined by simulation with a 5 Mb of random DNA with the same dinucleotide frequency as the test set is generated and the probability of a given matrix score is determined (number of hits/5e7). Once the individual hits have been found, the putative promoter sequence is searched for clusters of hits in a 250 bp window. The score for a cluster is found by summing the negative natural log of the p value for each individual hit. Using 100 Mb simulations as described above, the probability of a window having a cluster score greater than or equal to the given value is determined. Clusters with a p value more significant than p<1e-6 are reported. Only the top 287 hits are taken and are ranked by p value. Effects of repetitive elements are screened. If the 287th ranked hit has the same p value as the first ranked hit, no results are reported for that factor.

For matrix motifs, a p value cutoff is used on a matrix score. The matrix score is determined by adding the path of a given DNA sequence through a matrix. P values are determined by simulation; 5 Mb of random DNA with the same dinucleotide frequency as a test set is generated to test individual matrix hits and 100 Mb is used to test clusters; the probability of a given matrix score and the probability scores for clusters are determined as are the sequence motifs. The usual cutoff for matrices is 2.5e-4. No clustering is done for the TATA box, GC box or CCAAT box.

Candidate promoters are also selected based on the expression characteristics of the gene that is cis-associated with the candidate promoter, (i.e. the native gene). For example, a promoter region located 5' to a gene, which is expressed during a specific stage of development, likely plays a key role in the temporal regulation of that gene. Thus the promoter, when operably linked to a heterologous coding sequence, may similarly regulate the heterologous coding sequence.

Combining the motif analysis with the expression analysis, the list of candidate promoters having desired properties can be narrowed. This decreases the overall number of candidate promoters that must be screened to confirm the promoter's function. For example, one can start with seed-expressed transcription factors, identify candidate promoters that match the consensus regulation sites for seed-expressed transcription factors, and then test the identified candidate promoters to confirm the promoter sub-set which are capable of conferring seed-specific expression to a gene.

Example 5

Identifying Promoters in the Genomic BAC Library Using an Expression Assay

Promoters may also be identified based on quantitative analysis of genes that are cis-associated with candidate promoters, (i.e. the native genes). In this method, the native genes associated with SEQ ID NO:1 through SEQ ID NO:57,467 are analyzed on a digital northern blot. Digital northern data can be generated from EST sequencing, SAGE and other methods, which in effect count RNA molecules expressed in cell. This data can be generated as needed, or is generally available to the public on a number of web sites (e.g., on the Worldwide web at tigr.org). Data can be obtained from any plant species, although data on rice gene expression is particularly preferred. Promoters are selected based on the expression information of the digital northern. For example, identifying genes expressing genes under stress-related conditions would provide a group of promoters able to confer such stress-inducible expression to other genes.

Example 6

Identifying Promoters in the Genomic BAC Library Using Microarray Analysis

Promoters may also be selected based by transcriptional profiling or microarray analysis. Transcriptional profiling can be completed on large scale for each cis-linked gene associated with SEQ ID NO:1 through SEQ ID NO:57,467. Transcription profiling data can be obtained on RNA prepared from any plant species using a chip comprised of sequences from any plant species, although data generated from rice using a rice chip is preferred.

A comprehensive database of transcription profiling data narrows down the list of promoter candidates that confer a desired expression pattern. For example, a promoter that confers drought-specific expression can be selected by identifying a cis-linked gene that is induced under drought conditions (on the microarray), but is not expressed at other stages of plant growth and development. Such a promoter is likely to confer drought inducibility to an operably linked transgene. Public databases of transcript profiling data are becoming more comprehensive and thereby enabling this type of analysis.

Example 7

Functional Screening of Promoters in an Expression Assay

Promoters are screened in an expression assay. The promoters in SEQ ID NO:1 through SEQ ID NO:57,467 are amplified by PCR from rice genomic DNA and cloned into an expression vector containing a reporter transgene (e.g., GUS or GFP). The individual promoter or a collection of promoters ("promoter library") are then screened in an expression assay for the ability to express the reporter transgene. In a common expression assay for leaf promoters, the promoters are transfected into rice or maize leaf protoplasts. Reporter gene expression in the protoplasts indicates a promoter capable of conferring gene-expression in the leaf. The promoters are also transfected into protoplasts from other tissues or plant species to identify other regulatory features of the promoter.

Alternatively, promoters may be screened using a particle gun technique to bombard the cells, tissues or plants. The bombarded samples are visually inspected for reporter gene expression. Reporter gene expression observed in any bombarded samples indicates the presence of a promoter able to confer expression of a transgene in that cell, tissue or plant.

The promoters may also be screened in plants where transformation protocols have been greatly enhanced to facilitate the screening of large numbers of promoters. In this approach, the individual rice promoters or "promoter library" is transformed into *Arabidopsis* plants. The resulting transformed tissues or progeny are scored for reporter expression. Again, reporter gene expression in a given tissue indicates that a promoter is able to confer transgene expression in that tissue.

For some promoters, such as those providing constitutive expression, a reporter transgene can be replaced with a selectable marker transgene, such as a gene conferring glyphosate tolerance. Transformed cells, tissues or plants expressing the selectable marker are selected, rather than visually scored. For example, the promoter is linked to a selectable marker, such as glyphosate resistance, and then screening for male sterile plants. The selected plants, in this case male sterile plants, may contain a promoter for male reproductive tissues.

The promoters described herein can also be used to ablate or kill cells expressing a gene from the promoter. In such cases, the promoter is operably linked to a negative selectable marker gene, including but not limited to the diptheria toxin gene, or to a conditional lethal gene, including but not limited to the phosphonate ester hydrolase gene (pehA). The negative selectable marker gene is transformed into cells, tissues or plants. The cells, tissues or plants which express the negative selectable gene from the promoter are selectively killed. In the case of the conditional lethal gene, the transformed cells, tissues or plants which express the conditional lethal gene are only killed in the presence of the negative selective agent or negative selective condition. In the example of the phosphonate ester hydrolase gene, the transformed cells, tissues or plants which express the conditional lethal gene are only killed in the presence of glyceryl glyphoste.

Table 1

The data in Table 1 of U.S. Pat. No. 7,365,185 [U.S. application Ser. No. 09/815,264 filed Mar. 23, 2001] (the entirety of which is incorporated by reference herein) provides features relating to the putative promoter sequences.

*Column Headings

Seq Num: Provides the SEQ ID NO. for the rice contigs on which the putative promoter sequences are found.

Contig ID: unique identifier of the rice contig

CmbGID: name of the putative promoter sequence. Putative promoters are named as cg_"no". The "no" refers to the combigene from which the putative promoter is selected.

CNTG LEN: The length of the contig

BEGN POS: starting position of the putative promoter sequence;

STRND: DNA strand on which the combigene is located

LEN: length of the putative promoter sequence

Table 2

Table 2 lists the sequence motifs that are searched in the putative promoter sequences

TABLE 2

| SEQ ID NO: | Transcription Factor Name | Sequence Motif name | Sequence Motif | Sequence Motif Length | Maximum mis- matches allowed | Reference for transcription factors and sequence motifs |
|---|---|---|---|---|---|---|
| 109670 | Fac006 | ABADESI1 | RTACGTGGCR | 10 | 1 | PLACE |
| 109671 | Fac007 | ABADESI2 | GGACGCGTGGC | 11 | 2 | PLACE |

TABLE 2-continued

| SEQ ID NO: | Transcription Factor Name | Sequence Motif name | Sequence Motif | Sequence Motif Length | Maximum mismatches allowed | Reference for transcription factors and sequence motifs |
|---|---|---|---|---|---|---|
| 109672 | Fac010 | ABFOS | GCATCTTTACTTTAGCATC | 19 | 6 | PLACE |
| 109673 | Fac016 | ABRE3OSRAB16 | GTACGTGGCGC | 11 | 2 | PLACE |
| 109674 | Fac016 | ABREATRD22 | RYACGTGGYR | 10 | 0 | PLACE |
| 109675 | Fac020 | ABREOSRAB21 | ACGTSSSC | 8 | 0 | PLACE |
| 109676 | Fac021 | ABREOSRGA1 | CCACGTGG | 8 | 0 | PLACE |
| 109677 | Fac021 | ABRETAEM | GGACACGTGGC | 11 | 2 | PLACE |
| 109678 | Fac022 | ACGTABOX | TACGTA | 6 | 0 | PLACE |
| 109679 | Fac031 | AMYBOX1 | TAACARA | 7 | 0 | PLACE |
| 109680 | Fac032 | AMYBOX2 | TATCCAT | 7 | 0 | PLACE |
| 109681 | Fac060 | DREDR1ATRD29AB | TACCGACAT | 9 | 1 | PLACE |
| 109682 | Fac064 | EREGCCNTCHN | TAAGAGCCGCC | 11 | 2 | PLACE |
| 109683 | Fac066 | GARE2 | RTAACARANTCYGG | 14 | 2 | PLACE |
| 109684 | Fac068 | GBOXRELOSAMY3 | CTACGTGGCCA | 11 | 2 | PLACE |
| 109685 | Fac070 | GLUTAACAOS | AACAAACTCTAT | 12 | 2 | PLACE |
| 109686 | Fac071 | 1OSGT2GLUTEBOX | ATATCATGAGTCACTTCA | 18 | 4 | PLACE |
| 109687 | Fac071 | 1OSGT2GLUTEBOX | ATATCATGAGTCACTTCA | 18 | 4 | PLACE |
| 109688 | Fac071 | 1OSGT3GLUTEBOX | TATCTAGTGAGTCACTTCA | 19 | 5 | PLACE |
| 109689 | Fac071 | 1OSGT3GLUTEBOX | TATCTAGTGAGTCACTTCA | 19 | 5 | PLACE |
| 109690 | Fac072 | 2OSGT2GLUTEBOX | TCCGTGTACCA | 11 | 2 | PLACE |
| 109691 | Fac072 | 2OSGT2GLUTEBOX | TCCGTGTACCA | 11 | 2 | PLACE |
| 109692 | Fac072 | 2OSGT3GLUTEBOX | CTTTTGTGTACCTTA | 15 | 3 | PLACE |
| 109693 | Fac072 | 2OSGT3GLUTEBOX | CTTTTGTGTACCTTA | 15 | 3 | PLACE |
| 109694 | Fac073 | GLUTEBP1OS | AAGCAACACACAAC | 14 | 3 | PLACE |
| 109695 | Fac074 | GLUTEBP2OS | ATGCTCAATAGATATAAGT | 19 | 5 | PLACE |
| 109696 | Fac075 | GLUTECOREOS | CTTTCGTGTAC | 11 | 2 | PLACE |
| 109697 | Fac079 | GT2OSPHY | AGCGGTAATT | 9 | 1 | PLACE |
| 109698 | Fac105 | MYBGAHV | TAACAAA | 7 | 0 | PLACE |
| 109699 | Fac129 | PROLAMINBOX | CACATGTGTAAAGGT | 15 | 4 | PLACE |
| 109700 | Fac135 | RGATAOS | CAGAAGATA | 9 | 1 | PLACE |
| 109701 | Fac136 | RNFG1OS | GATCATCGATC | 11 | 2 | PLACE |
| 109702 | Fac137 | RNFG2OS | CCAGTGTGCCCCTGG | 15 | 4 | PLACE |
| 109703 | Fac139 | RYREPEAT4 | TCCATGCATGCAC | 13 | 3 | PLACE |
| 109704 | Fac139 | RYREPEAT4 | TCCATGCATGCAC | 13 | 3 | PLACE |
| 109705 | Fac139 | RYREPEATGMGY2 | CATGCAT | 7 | 0 | PLACE |

TABLE 2-continued

| SEQ ID NO: | Transcription Factor Name | Sequence Motif name | Sequence Motif | Sequence Motif Length | Maximum mismatches allowed | Reference for transcription factors and sequence motifs |
|---|---|---|---|---|---|---|
| 109706 | Fac139 | RYREPEATGMGY2 | CATGCAT | 7 | 0 | PLACE |
| 109707 | Fac139 | RYREPEATLEGUMINBOX | CATGCAY | 7 | 0 | PLACE |
| 109708 | Fac139 | RYREPEATLEGUMINBOX | CATGCAY | 7 | 0 | PLACE |
| 109709 | Fac139 | RYREPEATVFLEB4 | CATGCATG | 8 | 0 | PLACE |
| 109710 | Fac139 | RYREPEATVFLEB4 | CATGCATG | 8 | 0 | PLACE |
| 109711 | Fac149 | SITEIIAOSPCNA | TGGGCCCGT | 9 | 1 | PLACE |
| 109712 | Fac150 | SITEIIBOSPCNA | TGGTCCCAC | 9 | 1 | PLACE |
| 109713 | Fac151 | SITEIOSPCNA | CCAGGTGG | 8 | 1 | PLACE |
| 109714 | Fac163 | AACAOSGLUB1 | CAACAAACTATATC | 14 | 3.5 | PLACE |
| 109715 | Fac165 | ACGTOSGLUB1 | GTACGTG | 7 | 0 | PLACE |
| 109716 | Fac180 | GT1CONSENSUS | GRWAAW | 6 | 0 | PLACE |
| 109717 | Fac201 | PYRIMIDINEBOXOSRAMY1A | CCTTTT | 6 | 0 | PLACE |
| 109718 | Fac218 | ABREMOTIFAOSOSEM | TACGTGTC | 8 | 0.5 | PLACE |
| 109719 | Fac219 | ABREMOTIFIIIOSRAB16B | GCCGCGTGGC | 10 | 1.5 | PLACE |
| 109720 | Fac220 | ABREMOTIFIOSRAB16B | AGTACGTGGC | 10 | 1.5 | PLACE |
| 109721 | Fac223 | CE3OSOSEM | AACGCGTGTC | 10 | 1.5 | PLACE |
| 109722 | Fac267 | POLASIG2 | AATTAAA | 7 | 0 | PLACE |
| 109723 | OS A-box | OS A-box | TATCCATCCATCC | 13 | 3 | PlantCARE |
| 109724 | OS A-box2 | OS A-box2 | AATAACAAACTCC | 13 | 3 | PlantCARE |
| 109725 | OS AACA | OS AACA | TAACAAACTCCA | 12 | 2.5 | PlantCARE |
| 109726 | OS ABRE | OS ABRE | GACACGTACGT | 11 | 2 | PlantCARE |
| 109727 | OS ABRE2 | OS ABRE2 | ACGTACGTGTCGCGC | 15 | 4 | PlantCARE |
| 109728 | OS AP-2-like | OS AP-2-like | CGCGCCGG | 8 | 0.5 | plantCARE |
| 109729 | OS AP-2-like2 | OS AP-2-like2 | CGACCAGG | 8 | 0.5 | plantCARE |
| 109730 | OS ATGCAAAT | OS ATGCAAAT | ATACAAAT | 8 | 0.5 | PlantCARE |
| 109731 | OS CE3 | OS CE3 | GACGCGTGTC | 10 | 1.5 | PlantCARE |
| 109732 | OS GATT | OS GATT | CTCCTGATTGGA | 12 | 2.5 | PlantCARE |
| 109733 | OS GCN4 | OS GCN4 | TGWGTCA | 7 | 0 | PlantCARE |
| 109734 | OS GCN4 2 | OS GCN4 2 | CAAGCCA | 7 | 0 | PlantCARE |
| 109735 | OS P-box | OS P-box | GCCTTTTGAGT | 11 | 2 | PlantCARE |
| 109736 | OS P-box2 | OS P-box2 | CCTTTTG | 7 | 0 | PlantCARE |
| 109737 | OS Prolamin box | OS Prolamin box | TGCAAAGT | 8 | 0.5 | PlantCARE |
| 109738 | OS Skn-1 | OS Skn-1 | GTCAT | 5 | 0 | PlantCARE |

TABLE 2-continued

| SEQ ID NO: | Transcription Factor Name | Sequence Motif name | Sequence Motif | Sequence Motif Length | Maximum mismatches allowed | Reference for transcription factors and sequence motifs |
|---|---|---|---|---|---|---|
| 109739 | OS TATC-box | OS TATC-box | TATCCCA | 7 | 0 | PlantCARE |
| 109740 | OS TGGCA | OS TGGCA | GACACCAAGTGGCA | 14 | 3.5 | PlantCARE |
| 109741 | OS light | OS light | AACCAATCTCATCCATCC | 18 | 5.5 | PlantCARE |
| 109742 | AS RF2A 01 | AS RF2A 01 | CCAGTGTGGCGCTGG | 15 | 4 | TRANS |
| 109743 | AT RS1A 01 | AT RS1A 01 | CTTCCACGTGGCA | 13 | 3 | TRANS |
| 109744 | PV GRP18 01 | PV GRP18 01 | TGGATGTGGAAGACAGCA | 18 | 5.5 | TRANS |
| 109745 | RICE ACT_01 | RICE ACT 01 | GCCCAACCCAACCCAAC | 17 | 5 | TRANS |
| 109746 | RICE AGB 01 | RICE AGB 01 | GCCACGTAAG | 10 | 1.5 | TRANS |
| 109747 | RICE AGB 03 | RICE AGB 03 | GCCACGTCAG | 10 | 1.5 | TRANS |
| 109748 | RICE EM 01 | RICE EM 01 | TACGTGT | 7 | 0 | TRANS |
| 109749 | RICE EM 02 | RICE EM 02 | GACGTGT | 7 | 0 | TRANS |
| 109750 | RICE GL51 01 | RICE GL51 01 | AAGTCATAACTG | 12 | 2.5 | TRANS |
| 109751 | RICE GL51 02 | RICE GL51 02 | CCATGTCATATT | 12 | 2.5 | TRANS |
| 109752 | RICE GL51 03 | RICE GL51 03 | AATGATGTGTCAAT | 14 | 3.5 | TRANS |
| 109753 | RICE GL51 04 | RICE GL51 04 | TTCCGTGTACCAC | 13 | 3 | TRANS |
| 109754 | RICE GL51 05 | RICE GL51 05 | TGAGTCA | 7 | 0 | TRANS |
| 109755 | RICE GLU2 01 | RICE GLU2 01 | CCTTTCGTGTACC | 13 | 3 | TRANS |
| 109756 | RICE GLUB1 01 | RICE GLUB1 01 | CTGAGTCAT | 9 | 1 | TRANS |
| 109757 | RICE NITR 01 | RICE NITR 01 | CACGTCAC | 8 | 0.5 | TRANS |
| 109758 | RICE RAB16A 01 | RICE RAB16A 01 | TACGTGGCNNNNCCGCCGCGCCT | 23 | 6 | TRANS |
| 109759 | RICE RAB16A 03 | RICE RAB16A 03 | GTACGTGG | 8 | 0.5 | TRANS |
| 109760 | TAF-1AS | TAF1 01 | GCAACGTGGC | 10 | 1.5 | TRANS |
| 109761 | TAF-1RICE | RAB16B 01 | GGTACGTGGCG | 11 | 2 | TRANS |
| 109762 | WHEAT H3 01 | WHEAT H3 01 | CCACGTCA | 8 | 0.5 | TRANS |
| 109763 | Seed sp | Seed AACA motif | AACAAACTCTATC | 13 | 3 | lit1 |
| 109764 | Seed-sp | Seed GCN4 | GTGAGTCAC | 9 | 1 | lit1 |
| 109765 | SugRep | ACGTABOX | TACGTA | 6 | 0 | lit2 |
| 109766 | SugRep | TCmotif | TATCCAY | 7 | 0 | lit2 |
| 109767 | Amy3 | DAMYBOX2 | TATCCAT | 7 | 0 | lit3 |
| 109768 | Amy3 | DGBOXRELOSAMY3 | CTACGTGGCCA | 11 | 2 | lit3 |

Transcription Factor Name: Name of the transcription factor which binds to a sequence motif within a promoter region Sequence Motif name: Name of the sequence motif to which the transcription factor binds Sequence Motif: sequences searched to further annotate putative promoters Maximum mismatches allowed: Number of mismatches that are permitted when searching for motifs to annotate putative promoters Reference for transcription factors and sequence motifs: Motifs and transcription factors are found in one of three databases: PLACE, PlantCARE or TRANS (respectively, on the Worldwide web at dna.affrc.go.jp/htdocs/PLACE/, on the website sphinx.rug.ac.be:8080/PlantCARE/index.htm, on the website transfac.gbf.de/TRANSFAC/or, Yoshihara et al., FEBS Letters 383, 1996, pp 213-218; or Toyofuku K et al. FEBS Lett 428:275-280 (1998) or lit3 (Huang et al Plant Mol Biol 14:655-668 (1990))

Table 3

Table 3 of U.S. Pat. No. 7,365,185 [U.S. application Ser. No. 09/815,264 filed Mar. 23, 2001] (the entirety of which is incorporated by reference herein) describes those putative promoter sequences containing TATA boxes, GC boxes or CCAT boxes as determined by matrix motifs.

*Column headings for Table 3 of U.S. Pat. No. 7,365,185 [U.S. application Ser. No. 09/815,264 filed Mar. 23, 2001] (the entirety of which is incorporated by reference herein)

Seq Num

Provides the SEQ ID NO. for the listed sequences.

Seq ID

Arbitrarily assigned identifier for each putative promoter sequence

Start

Indicates the start position of the TATA box, GC box or CCAAT box.

End

Indicates the end position of the of the TATA box, GC box or CCAAT box.

p-Value

Probability value is determined by simulation as described above.

−ln (p-Value)

Indicates the negative natural log of the p-Value.

# of Hits in Cluster

No clustering is done in Table 3. Therefore, all entries in this column are listed as "1".

Factor Name

Transcription factors associated with the TATA box (TATA-plant), GC box (V_GC_01) and CCAAT box (F_HAP234_01) are listed under this column heading when the matrix motifs for the TATA box, GC box and CCAAT box are identified.

Site Name

List whether the search is done for the TATA box, GC box or CCAAT box. Table 4 of U.S. Pat. No. 7,365,185 [U.S. application Ser. No. 09/815,264 filed Mar. 23, 2001] (the entirety of which is incorporated by reference herein) describes those putative promoter sequences containing specific sequence motifs as listed in Table 2.

Column headings for Table 4 of U.S. Pat. No. 7,365,185 [U.S. application Ser. No. 09/815,264 filed Mar. 23, 2001] (the entirety of which is incorporated by reference herein)

Seq Num

Provides the SEQ ID NO. for the listed sequences.

Seq ID

Arbitrarily assigned identifier for each putative promoter sequence

Start

Indicates the start position of a sequence motif. Note that if multiple motifs are present in a window of sequence, the start position, the first time it is indicated, lists the start position of the first motif in a window. The second or subsequent times a start position is listed, this heading refers to the start position of the subsequent individual sequence motif within the window of sequence.

End

Indicates the end position of a sequence motif. Note that if multiple motifs are present in a window of sequence, the end position, the first time it is indicated, lists the end position of the first motif in a window. The second or subsequent times an end position is listed, this heading refers to the end position of the subsequent individual sequence motif within the window.

Strand

The strand of genomic DNA on which the sequence motif is located (+/−)

p-Value

Probability value as determined by simulation as described above. Note that if multiple motifs are present in a window of sequence, the p Value, the first time it is indicated, lists the p-Value position for all of the motifs in a window of sequence. The second or subsequent times a P-value is listed, this heading refers to the p-Value of the subsequent individual sequence motif within the window.

−ln (p-Value)

Indicates the negative natural log of the p-Value as described in the column heading above.

# of Hits in Cluster

Clustering is described above. The number of hits in a cluster refer to the number of times sequence motifs appear in a window of sequence.

Factor Name

Transcription factors associated with the sequence motifs listed in Table 2 are included under this column heading.

Site Name

Lists the sequence motif for which a search is done on a putative promoter sequence.

Table 5

Table 5 of U.S. Pat. No. 7,365,185 [U.S. application Ser. No. 09/815,264 filed Mar. 23, 2001] (the entirety of which is incorporated by reference herein) lists the putative promoter sequences for which sequence or matrix motifs are not identified.

Column headings for Table 5 of U.S. Pat. No. 7,365,185 [U.S. application Ser. No. 09/815,264 filed Mar. 23, 2001] (the entirety of which is incorporated by reference herein)

Seq Num

Provides the SEQ ID NO. for the listed sequences.

Seq ID

Arbitrarily assigned identifier for each putative promoter sequence

Table 6

Table 6 of U.S. Pat. No. 7,365,185 [U.S. application Ser. No. 09/815,264 filed Mar. 23, 2001] (the entirety of which is incorporated by reference herein) lists the contigs, combigenes and description information associated with each gene prediction.

*Column Headings:

Seq Num

Provides the SEQ ID NO. for the listed sequences.

Contig Id

Arbitrarily assigned name for each contig.

CDS.

The location of the exons found within the gene as determined by the gene-predicting program (Method).

CG ID

Arbitrarily assigned name for each combigene.

CG Start

Indicates the start position of the combigene gene.

CG End

Indicates the end position of the combigene gene.

Strand

Indicates the strand location of the gene (+/−).

Gene

Indicates an arbitrarily assigned gene name based on the method used to predict the gene.

Method

Indicates the gene-predicting program used. These programs are GenScan, AAT/NAP, AAT/GAP, TBLASTX or Genemark.hmm.

Gene Start

The start position of the putative gene making up a combigene as predicted by the particular gene-predicting program used.

Gene End

The end position of the putative gene making up a combigene as predicted by the particular gene-predicting program used.

Hit Score

The aat_nap score (under Hit score in the rows where the method is AAT/NAP) is reported by the nap program in the aat package. It is an alignment score in which each match and mismatch is scored based on the BLOSUM62 scoring matrix. The aat_gap score (under Hit score in the rows where the method is AAT/GAP) is the alignment score for each hit sequence, as reported by AAT/GAP.

For TBLASTX the Bit score for BLAST match score that is generated by the sequence comparison of the genomic contig with the Monsanto cDNA sequence named under the GI column is listed. The E-value corresponding to a given bit score is E=mn2−S'. "m" and "n" are two proteins of length "m" and "n", "E" is the E value and S' is the bit score.

GI

Each sequence in the GenBank public database is arbitrarily assigned a unique NCBI gi (National Center for Biotechnology Information GenBank Identifier) number. In this table, the NCBI gi number which is associated (in the same row) with a given contig or singleton refers to the particular GenBank sequence which is the best match for that sequence. If the hit is based on cDNAs from Monsanto's SeqDB, the name of the cDNA sequence it hit to is named.

Description

The Description column provides a description of the NCBI gi referenced in the "GI" column.

SEQUENCE LISTING (109768 sequences)

SEQ ID NO: 1 - DNA, 1501 bp, Oryza sativa
gtccgctgtaaccacggggataaattcaccacgtggtgatcgggactggagaaatgtagccccgttatggttgacggggcggggatggtgaaattttatcaccatggggacggggacgtggatgtgacccctgacggtgaattccccgttgccatctctaaacactacaaatattttaaatatgtaaagataaagataaagaaaaattgggatcatgatgaaagaaaatatgaccgatgtggtgagacatgttttcgtctttttttattatagatcactgtccttttttaattagaaatttaaattgtttgtttattttatagaaaccatcaagaaaaaaagagatcggaagggaaagaagcgaagcaagcgcagccgctcagggtggggtggtcttttggtggttagatcttttgtccttctgtgattaggaatttagatggtttatttccactactaaaaaaaacccatatagggaccggtcttataggtgccggttcatttaaaaccgacacctataggccttttccaacctagcttcgcactatgaataaaataaagaatcgacacctttaagcattataagtaccagttctcaagaaaaaccgataacaataatatgagtgccagttctagcacaaaaaccggtacaaatattataggtgccggtttttttaaaagaaccgacacctataatataaatataggtgccggttctacttagaaaaaaccgaccggtcgacgtccttatccactcgcatctcttgatcggtcgctctacctcatccactcgctcctctcactcctcactccatccactcgcatccccctcccctctcgccctctcccgcctcctcctccttctcctggcagcgatgcgctgacagcggcagcgatcgcaaggaggcagcggcagtggccccttctccagcggcggctacccccttctccttgcagcggtaccttctcccggtagcggtggcggctgcaaggagacagcggcggcggccgcaaggaggcagtggtggaggtccccttctcattgcagcggcggtggccccttcttctggtagatatcatgccaacgtcagcgagatgtcagcatgaaacctaggcacagatgccatgcttcttccatgttctcatgttgaaaattcatgccaattatttctatcacactcaatgacgattgcggcggcgaagcctgcaattaacactacatattgccttgtgcaggtgatatcatcaccaattcaccattagctatcttacttgcctcctataaataccctcagccggaagggttattcgtatgcatcaaaaacacacaacgctaactcatcacgagtttgatacacatagtaatcctacgtaatcaagcttagattgtgttaatcaactcaatactgcaaaaaatcgtttttgcaggcggtcaaattagggtaaattaagtgactgtaagctttgttaaacgccatggatttgatgaagagtaatccgc

SEQ ID NO: 2 - DNA, 1501 bp, Oryza sativa
aaaatagacttatttccggcccttgccggtcggtccacggccttttgtgcacgcgcaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacggcgcctctcttcccgcgagcggcggcggcggcgccctcccccacaaccaacggcgcggcgccctctccccgaacaacggcggtgtggaggcggctgcggcccggcgggagtgggaggggcggcaggccggacctcgcctccgccagatctggcggcatggaagcggctgtggtccggcgagggcaggagaggcggcggcgtcgtctctttctctctctctgtgcatggtggggaggtgcggcagtggtggtggtggcggacgtcatggaacgccggtcgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcatcgtctctttctctctctctgtgaatggtgtcggttctcctggtgatgctaaccgaataggacttggtataacagatggaagtttgtttcctatttttatggaatcggacatattctttttttttcccgatttttcttttaccgcgttgatgaatcggattcgttccggttttttttcacccggtttttttgacggacgatggaagcacctcttattttttaagtagtagtagatagatattatttattcctcccatttcatattgattagttttttcacaaaaaaaaacttaagtaagtggtggtgaagaataaggaaacatgcacacttttaactcccccccccccaacaagaaaagagagctttactacctcaaatacctatatgcatgcatgcaaacccaattttcatgcttagatgtagtaactacaccaacattacataataatcaacttgaaatttttgattttagtcaattgatgatcaatatataacggatggaatatttcatattggctggtgcattgtgcggcaaggccgcatctattttctagtaattaattattccaaaattagagatacaataaaacgctttatccaaacggcgtcggtgacgccaacgacactggttggagttggacacgccgaccccacacgcagcgacacacaaacggcggggattacttcgccgttaaggcgtacactaaaccaaaccgcgtggtcgactggtcgtctcctcctcgaatcaaatcaaacggaaccgaat

SEQ ID NO: 3 - DNA, 1501 bp, Oryza sativa
tttaatattttgatgtatcaacttggctaaacatatgctaggtgagcttttttttacgatgtcagtatgttattgcatagtaatcatatggatattaccttataatattaaatttaatctttaagaattattatactacacatagtagtacaatttacatccaattacctttaagattttttttgtggtcttcaccttctcaaatatcaactgaaatataaaaatttctacatccagtttagttgaccttcagttattagttattaggataaaaatataaatatacttatacaaatatgcgctagtatattttcaaaataagtacttaaaaattgaatttattgaaaaaatactccaaataattaagttgtcacataactttttaatttattgtatcaaaatcgtacctatcttgcaagttgttgtatttatacaatcacttataaagtttttatactaaattgcacctacctgccaagttattgtgctagaatgctaatttcttaagttattataccaaattgcacccacctgccaagttgatgcaccatggatgcaatttactcttgatattttttgggtgagaatgtggaggggtatactcaccacctctaatgaaagggtgattgcaaccactcatccatcccactcccccaaccaaacaaaaaaaatggattaccatatccactttcatccctacaaccaagggtgtgtttagttcacaccaaaattgaaagtttggttgaaattggaacaatgtgacggaaaagttaaaaatttatgtgtgtaggaaagttttgatgtgatgaaaaagttagaagtttgaagaaaaagtttggaactaaacaaggcccaaacaaaaaactggatcgccatattcactcaaaaaaaaaactggatcgccatatccagcaaaatatggaccgccatatcccatccaaccttgaccgggagccaaacacaccgtcaggatggaagaggctccaaccttctcaaataaatgctgccttaggagttaggtctgatttatggtttagttcccaactttttcttcaaactttcaacttttctgtcacatcgtttcaatttcaatcaaattttcaattttggcgtgaactaaacacaccattacaggtctcgaaaccacgtacaaactggttaagtgtttaaaaaatatatttaaaaatcgaattctaacaaattttattgaatttcgtggttagagttgtattcaacgaccagtggcgtccctgtgccggaccttcttgctcagcaagaagcccaagttgggcctcaaaagcccactgcgtgagctcctcctcctccgattctcctcctcgacttcgaacctcgacgcctgcatccgcatccgcctccgcctccgcctccgcctccgccgcgaactcgccgccgcgccggccatgtcggtgagtgccccccgccgccccgctccctggccggccgggccgcccgccccacggatcttaattctcccatgcct

SEQ ID NO: 4 - DNA, 1501 bp, Oryza sativa
ttgtttagttccaaactttttcttcaaacttctaactttttcatcacatcaaaactttcctacacacataaatttttaacttttccgtcacattgttccaatttcaaccaaactttcaattttggtgtgaactaaacacacccttggttgtagggatgaaagtggatatggtaatccattttttttgtttggttgggggagtgggatggatgagtggttgcaatcaccctttcattagaggtggtgagtatacccctccacattctcacccaaaaaatatcaagagtaaattgcatccatggtgcatcaacttggcaggtgggtgcaatttggtataataacttaagaaattagcattctagcacaataacttggcaggtaggtgcaatttagtataaaaactttataagtgattgtataaatacaacaacttgcaagataggtacgattttgatacaataaattaaaaagttatgtgacaacttaattatttggagtattttttcaataaattcaatttttaagtacttattttgaaaatatactagcgcatatttgtataagtatatttatatttttatcctaataactaataactgaaggtcaactaaactggatgtagaaatttttatatttcagttgatatttgagaaggtgaagaccacaaaaaaaatcttaaaggtaattggatgtaaattgtactactatgtgtagtataataattcttaaagattaaatttaatattataaggtaatatccatatgattactatgcaataacatactgacatcgtaaaaaaaagctcacctagcatatgtttagccaagttgatacatcaaaatattaaattgttaagttcttgtactagaacacactcacatgtcaagttgttgcattcggacgttcaattctcaagttcttatactatatcgcacccacctgccaagttattgtaccgtaggtgcaatttattcaaatatcaatctactaaaaaaatctagatagaaataaaaaaacagaaataaataaaagggaaaggagaaaaaggaaaaaaaattcttctcgaaatcgccggccgcccctcgccaaaggtcttcgtcggcagcccctcgcctcctctctcgccggcaaccccaccgccgcacttcctatctctcccgccaccgccttgcctcctctctccccggccgccgccgctcaccctctctcgccggcgcccaccagatccggtcgtcgccggctcgcctcctctctcgtcgccggctcgcctcctctctcaatgccgagctcgcctcctcccgctggccgcaggcgccgccgcctcccgccgacgcagctctcggtgcctgcactgtcgtcatcgtcgggtccagatcgtcgtcgtcgtcaccggcatgcatgaggcattaaatgtgtcgatgtttgatgtcgtggttctggtatttgcatggtatggggatcgtcggtgctagggtatatgcgagactgaggtaaaagaga

SEQ ID NO: 5 - DNA, 1501 bp, Oryza sativa
aaaaaagagttcaaataggagtacaatttaaaattagctgaaattcggaattaaaaaaaataatattgaaagaagaatccacataagaacccaatatgtgattaattaaaattcagaataaaaaataaataatatccaaaattagaaaaattaaaagagagttcaagtaggaatacaattttgaaacaactgaaatctgtactattaaaaattgaagatgtttttgccggtataaaaaaacagaaaaaaaggagaaaaagaacttctatgtaaaaaaaaacgtccgactccataaaaaaagtccgactatctgtggagaaaaaaaggcaagaaaaaataaaaaaaagagaaaaaaaaacttctaccgtataaaaaaataaaaaggtccgattcctgtacgattgcctcgaaaaaggactttttgtccgtaatcttctcttctcttctacttctactatttttttaaaagaaacctctactattataaaaaatttaagatgttcttttgtcggtattttggtatgtcatccgtgtatgagtcggtttataaatttgttcgcttttgaaaaaatatatatcctttgagttgatttttaagttcgtccgcttttggaaatataggagtcgtataaaaaaattcgcatgctgactttagacaaacagactcctaaccacagcttatgattttatagaaatatatagatccaagcgaattctcacagtgaattaagactaaaatagttgtcacccgttgcagcgcacgggcttttctcttgaaaataaaaaataaaaatattaaaagaacacaatacgatattaattaaaatttgaaaaaaaaattctaaaattacaaaatgaaaaataagttttcaatttggaatacaatttataaatagctaaagtttatgataaaaataaagactattgaaagaaaagaccatctaaaagacatgacgagataaattaagtaacaggcctataatagagtagagtggtggcggttgatacaacatataaaaactgttaataaaacaccaaatagaatactaataacgattaaaacaagggacggtagaaaggccgtgaagcaaacgaacaaggtgattgctgggacttctaaaaagtaaaaaaaaaaaccccaatgataatcatattcgatttttaaaatctcaatgataataaaaaggagaagcagtgggcggggtgtacaggagtatagttgcagagccgccaacggttgacgggacttctaggaaataaaaaatgaattccaacgatagttatgttcaatttttaaaatcacaatgacaataaagagtaggcggcatacgggccatagaggagcatagtggcatcgtgtgacgagacttctaaaaattataaaaaataaaacccaacaagacaatatactctaaaaactacaaggttcaatttttaaaggttcggaacttctaaaaagtaaaaaaaacaatgataatcatgtttgattttaaaatctcaa

SEQ ID NO: 6 - DNA, 1501 bp, Oryza sativa
cagcaaaatatgctaaaacttggtattaccgaattctggtaaattttggtatcatatgacgtgttacagtatttgagacatgtttatgttgttacttacgaaaatttgggattgtcaatgccagagaaaatggatatttagccatgttcaaaacacggtttcgctagaatgccatcccgaaaatgcgattcgataaaatgccaatatgaagcgtgcgtctaccgccactttggcatttttgccattttattcattttcgaaaagattttctctcatctactaggtgatgagataaaattgccccttatcaactcagtcgaagctcgtcattgtcggggaaggtggcggcggtgggcaccggaggtcgcgccgttgcccgtgcccatcgtcgaagaagtggttggtagagggcgccgccgtccggctgtggatgcggctgcccaaggccgtggtggctctcagcggcggccttcctcactggctccaccgacgaagtcgtcaccaccgccccaatctcccactacctccacctcctccgctcccttcaagccgtccccaccgaccgcctccaccatgcggcgccaccgttacgttgcccactgccaccgcccgcggccccaatcttgtcgagctccggtgagttgcaagtggcggtggaccttgccatgcctatgctgcgcgtcgtcgccgccgccgccgccatgctctcgctcgccgcctcctctgctccggccacgtggacccaccatcgggacgccacctcgcactcctcgttcgtccgcctccaacgctcactcgcgcgatcccgccgcgtggacctcgtacaccgggcgctcctgcagcggccttcctctcggctctcctcgagggccgccagctgcacgcactcgccgccaagctcggcctcgccccgtcccacaccatcgtcgacgcccttgtcagcaacgaagaccacctcgccgcgctcgatctcgatcccctttcagccgacgagcaggggcaatttggtctcatcaagctgaattctagcgaaaatggaattgaaaatgacgaaaatagagaaaatgacaaagtggctatgattgcgtgtttcatattagcattttagtgaaacacgtttttaggatggcattccaactaagccgctttttgaacgtggccaaatatccattttctcgtcaatgccacggcatgtttgagttagcaaaaactgaacacgataaaaatagagcaatttgtacaaatgcgacaaatagaggtgtcgaaatgaaaatttcccttctagcgaagagaaggagaagcacgcacgcagcacgtgaacttccagctctaaacccttccccctctcttgttccaagcccctcctccccttacccccccgccgccgccgccgccgccgcctcatcacccgaaaccctagccccattcgccgcggtcgccgcctcacccgaaaccctagccccattcgccgccggggtcgcggcctcaggagcggaggcca

SEQ ID NO: 7 - DNA, 1501 bp, Oryza sativa
tccacgtctaattttagaaacttttatattttaaaacggagatggtgtactgctactactgtaattaacgcgaaatcggcacgaacaatgcgagtcaaaattgtaccgtgccgtgtgtcccgtgtgcggatttaggttgatgagaaaaaataaagatgttcgttattcaaaccagatgtctgtaaccggtcaatttcaccattaaactaactcatgatcgagtcgagtcagtgatgagtcatcaccggccagaagatcacctcgatcaacgatgattatctcccattctttaggctattaggccgaattattcaacgagttggtgtacgagagaaattaaccaagctttctgcacgtactccgatgtcttcgtctcgtaatctctcgtagtaaaatattttcgttaagtgtcattcgagagaaaaaaaatagggagaaatctccgggaaagaaggaagagctttgccggtgtgtttatccattatccacttccttatcctaaaacacggtaaaaaaaaacagtattcctacacgctaatacacgtcagattaggtgagacgtagtacaaggtttgtttgaacggcaggagttcaaaccaaccaactcaattgatattgaaaagttaaagaagttgagaaacaaagtaattctgatgcaatacgattaattaaattatttacgagagaccagtgatcttattacgcgtttatgccaaaataaggtcatacaaatgttcattgctgatacgataaacccacaaacctatcgtacgtgcttcaactcaaaacaacactacgtatcactacgataaaaccatactcacttagtactagtactgtttataaaaagtactactggtactactagggcccctttgaatcacatgaataaaaaaacagagaaataggaaaaacataagattctgatagaatgtaagtggaaaacagaggattgtaaaacacaggaaaaacaggaaaaataccggaatttgagaagagataaagactcaaatgatttttttcatgaggttctacctcttgttaaaattcctccaaaacttatattgaaagagtcatttcatagaaatttcataggattccatagggttcattcctttgattcaaagagttttatagaaaaaattcctatagaaataaaatcgtctaaaatttatatgaatttccgttgaatcaaatagcttaaattataacccccgaattgctccgtttcatccggataaacacgagaaatcacccactaaaaaatacagtcaaattagtcaagaatccgaacgactgaaaaattacgaaaataccctccaccttccccaccgtaggagtagtactactacagtacacttcttctcccccttcctctccttataaaaccccgcctcctcccacctcctctcctctcctctcctcctcctcttcgcgtcgaatcctcctccgagaagaggagagtacatgaatcctagcgcgaggatctcgcaggtagcaa

SEQ ID NO: 8 - DNA, 234 bp, Oryza sativa
tgttgagtggagtttttggatatatttgatataatgtgattgtgaatatgttgtttaagcggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccaga

SEQ ID NO: 9 - DNA, 1501 bp, Oryza sativa
ttttaaatcgttaagaacatacgtagaaaacttttactcacaaattattacaattttgcttgtatggcgtatcatccgtacatgcccaaacgataagggggctaattgtacctgcggctaatgtgtgcattcagcctagctacctctcctgtcgaatactcgaatcacgttcgtgcatcattgtaacacgcgaaaattcagtatccgacctctttgggactgtttgataagtcactcgtaactcatttcatccgatcctaaacatcgtcctatttccattttccctttcctaatcattattttaccggttctaaaaaaactctcggagtatgatgttttatttatagagtggactgaaatactatttttcttcttactattttgttttgcataaggctatgttgggaagtgagttttgattttgctatattctgagcatacttctcgaactattaaacaatacgttttttctaaaaaaaatacatgtaggtgtttattaaaaaaccaaatattttttaaaaatatataataattgttatttagttaatcaacatatttgtcctcagctctatcgaactgagcttggatttggagggaataataatcggagtgaggtgcgggagcgagagtctttccatgatgacatgcgtgtaacaacttgggtcaacgtggctttcttctggctcactcgtactccctccgtttttaaaaagatgatatcattaacttttaactacatatttaattatttatctttttccaaaactttataattacataattttttttaataataagaacgttaaatgtgtgataaaaactcaacaacgtcatctatctaacaacgattgaccccgccgtgggcgcctgtgctggccgtcgatggtccgtactagcatcgtatccaccggcagtcaagacatgatctattgatctccgagtccagtttggtttggagaaaattgatagagagtatatatgggtctgggagctttggatgttcatattccagtacctgacgaatcgaattttgagtccgagtcggaattgggaacacatctgtccagccaatgaatacaatcgtgcagtctcattggtacgtgtacccaaccaagtgacaccaatcgttgatcttaagagaagtttaatattatagcccactattagctccaatttatctatagtcaatctaatagccaatttatataatagttgattactttactactaatatatggtcccacctatcatatacacattatgtcttggaatccgtgctgtagctggctacatatctgtagcatgctgctcttctctctcatcttttatctcattaaaatatatttacagctggctaatagcctgctattgtacctgctctaatttgtctgctgctgccatctcatcatggctggaaaaaagaggcagaacaaaaagagaggagacgtgtcgaagccatcgcaacgacggcaagcaaatcagcgcagtaacgcactacccg

SEQ ID NO: 10 - DNA, 1501 bp, Oryza sativa
gtgtgattgccttttgctagccaaattgtggttttatttcattggccaaaactgtagataagttaaggcatacaattattataaatattgacaacctcagtataccaaccaaacaacagtaactaatgcctgccataattttataaatatctattgaaatcttaagttaatacactgctacaagttgattacataggaaaactattcgagtgatttcgtaaagaaattagtaatacatcaaagctttaaagataagagattgacacacaaccgataaaataatatgattatagaaatttaattctaaaattataaattagacatcttttgagctaaatgattttaaaacgatcattaattgctactacttccatggacggaagtagtaacagatatttagatatttcagtgtgtccggtacaaaaccatcaacaaccacggaaacaaaaccatccatccaacccatctcgcaaacgaggaaaactagcaactcgaactgaaaaatgaagatactaccaatcacactactatgttatttattttccaacccatctctcttctttctgcgcacacgtttttcaaactgttaagcgatatattttttaaaaaatatataagaaagttgtttcataaaatttatattaatctattttttctaaaaaataactaatatttaattaattatgcgctaagtaggaaaggtcccaactaacagccgtctcgtaacaccaaacatgatcctctctctctgtctccgtccccaacccagcgcgagacgatcccctcccctgcacggtaagcgaatcctcccaccctttttccagcttcgcttcgaatcatcctcctcctcgtctcgacttcgaatcagtagatcctctgcgatcctacgctttctcctccattttctcgccaccaccgtagtagacgagccgtgcggtatacttgtactacagagtttgcttccgtgaggtgtcagctttgctacgccgccttcactcctcgcctccgctggtgggtggtgggcttctctcccgctcgccatcctctccgtcgtcttcgccggcgaggcggcgcggcggcgcggcccccattccaccggcgcgtccgtctcgggaggttcgaatcaggtattcgtttcttcctcctccgcgcttcgcttggtgagcgggcgcgaggcgtggattgaagatccatccgaacttggggtgtgcttggattgggtgccctctggtagtacagcgccatagctgttcgtgtttattctgtacgaatctctgctggttgtaccagggaggtccaggacgacacaccatagccatgtggctgattcatgtgcacaatttttttatttttttaaaaaaacgtttaatccctcatttcgagtattttctgtggtcatactcgtatgaatctcaatatctcataggtgtttgttttggtctcaattgaacatgtaacaggttcaaaacggggatcggtagtgttctgcatcagtgatggg

SEQ ID NO: 11 - DNA, 1501 bp, Oryza sativa
ttgtgacaggtgggaagacggagggatggatggccagctgacacctacaacatagacgggtcaaaacttcagaaatggacccggagcaaacaacagctacctaattctatttcaaagcactttctttatgctgtcaatttgaagaaaaaaaaaaccctctactactccctccgtcccaaagaaaccaacctatagtactaatattgacacattttagtatgtccattggttttatatgagatggaggaaggatataacaacggaagggagcgtaaatatacttttataatgagagtgttatatccttggtctctttacaccgtgaatgtacacaattatatattcatgtaagtgcaaatacgtggtgtggttaaagtgataatgagcttgctatactatttggtgaaagaaaatataccgcctcctatcattaatatttgacgtcatataatatcgacataagtttgtgtgtagcgtcaaatataatgttagggggggggcatatttttgtaatgaaaaggttttatatctttattctctctacatcgtagatgcacatagtcatacatgcatgtaagcgtaaatatgttgtgtggtgaaagtgataatgaacttgctagactttttttgacacctagttatgctccctttttatgcactgccgcaccatctcttttctcctcttctctgttatcatcgtatatactacatattttacattgaacctattgttggctacgccattatggcatccaccactgctgtcaaactgtgtaaaagatgacataccactattaagagtgttaactataaaccaataccctcaggctatataaaaaatgatttcaacaatattgatgctgagcaataatgcagacacatcgaaattcttgagttaggtgtccaaaggcatttaatcaatatttcactggtatttgacatggacttttatagaagaaaaatacatcactgtagtagtagtatctttttccaagccctgttagcaacagtattgatgtggttgtcctcctactctacctgtatttgtcctcttccacctcataccaaataaaaccccccctctccattgttctcgcagcgtataatctcacccaaaatacacgcaatctcacgccatttgcacctacaaatctcatcatctcatcaatatccatttctacaaaaaaaaaatccatttcagtatttcattgctgtagcatcaaatttattggcattatttgctgatattgcatgctgcattgagaagaaaattaaagaaactgacttggatagcactgcactctagctaccattttcttggcttgtttgcgaaagctgctccatctcctgtgtcctaggctctttccctttttaaccccgtgccacagctagccagccaagcactgcacaaacctttcccctgaagaggccaagaagttatgggagaggaggcagccatggccaccatggagagcgcctaccatgatgagcttgctccggc

SEQ ID NO: 12 - DNA, 1501 bp, Oryza sativa
caaaaacatcacatcgaatctttggacacatgtgtggagcattaaatatagataagaagaaaaactaattgtacagtttgcatgtaaatcgcgagataaatcttttgagcctaattagtccatgattaaccataagtgctacagtaacccacatgtgctaatgacgacatgattaggctcaaaagattcgtctcgttgtttccaggcgagtaatgaaattagttttttcattcgtgtccgaaaaccccttccgacatctggtcaaacgtcctatatgacaaccaaaaatttttatttcaccaattaaacaggcccataagaacccaacataatgcaattagacacacgtatttaatacacgtcgccacacgtgtttgttcagcgttagtagtattattctgatttgaggatatcatttttgaatagtcgaatcgaatagggtacgggccgtgggggttcataaatggccgacctgtgatgtgagtcgtccacaccccacaccccacccaacccgagcctcagccgaccgactcgacgacgtctcgcgctaatcgcaacgccgacgcccatttatgaccagccttcgcttggctgcacgtctccgtcccgtatcatattgccgtctcagcgacccagccgccgcgccccctaccactgccaacccaatccatctctctctctctctactgctctccccgaacgcgctaccgttgttggacccgacgacgacacacgcggtgggtgcgtgcagtgcagccaagaagccaggtggtacgcgagagaaccagacgaggcccgtgaatctccgcgatttccatcgcgcgcaccggcccgcgcgcgggcaaaatcccagcggcggccacgcggaggcgaactacaccgtgcgcgcgcgcggcgcctcttccgcttgggccgcgcgaaatttacgtgcgctcacgtacgcgaacgggacgaaacgaaacgaggcaaaaacaaaaaaaaggccacaacactgcggcgggcgctgcttctgctgccgcttgggttgggccacgcgagcggctcagcctagtacacgcggctcagcaaaggggataagttttttgacctcccttaactcttgctgttgattgaattgcatccctcaaccataatagcagagaacaggtgagagagagggagaggagaaataggtgagaaaaaaagagatgagattaggatgattggcatgtgagctgatatttttatctttttcctggctaatatgtgagtcctatgagcgtcacgtaggatgaaaccgctatcaaaatagctgaggtacttttatttactccggtttttgaaaatggagaggccttatacctggtattatagttaagggtcaaagattcaatatatagcaagagttgagggaggccaaatagacttactgcacaaatcaatggtagtggtggtgaacttgagggggcaggggaggaggtaggtttggtttggggtttgggggagggggagggggagggga

SEQ ID NO: 13 - DNA, 322 bp, Oryza sativa
tcatgaggctcttttaggatgaagcaagatgaacaccaacatgcgcccgagttgcaacgtcgttgcttaataaggcttccgcttctcaatcttcaggattggggccatcatctcagctctcccatgggttcacatgtgcttctaggacaagttgataacaaatataatattaatgagaatgacaatcccattcatttggaggatgtcacattttgaggtctagttcttggtcgttgtaatgtcttgtctattaattatgttttttcggaaagtttattaattatgttgtactaaggttgtgacttcttgttttatttataga

SEQ ID NO: 14 - DNA, 1501 bp, Oryza sativa
cacgccgaggatgtctggatgtgggctttctttacatgggctttgtgatgggcctggcccatcaccgtcagcttctccatccgtgcggcctctcttcccttcccttctccacacgaatcggacttcgggggttcttccgccgccgccgccccgccctcgccgccggcggcccggacgatgttgggccacctccggcgatcctcccaccgagtactcattgccaacctcgccgtctactcataagagcgattccttttcgctgttcctgtgctaaagccctttctctttttattccgcccctctttctttctccaaatctactagttgccggactactgcttgcctgcttgtgttcttgctccatttaccaacccagataatgtcatgatgcagccttgttttgactgtaggcacgccccaagtctgctcaacattctattatttgttttactgggcactagttgaactagtgaaaaacataggggtttttattgtctttcctctaattctccaagcagtgtgaacactttaagtaactaacccctaccctttggaggtcttcaagattctcacatcgacagattaatgtaacaagcactttgctaacggtagtttagcagtgtctgagagattagtctaacatgtttaagttgttattgatccaacatgcattcttaaactggagaataaatcaggagtttttagcctttctgtcactgtaatttcttgaagagattgcttcttgctacctttgagccattggctaattctattactaatctcactgctctctacattgtgcaggatacagagttcacaaattgaggtactattctcctttgtcctttccttcggacaacattttacacccattttacaaagtcatccttccatttatacacctgtttttagttcatagcaggctggtgtagcaaccataccaccagaaatttctctgcagatacaagtaatagagtttcaaatgatcgagggcatcaatcaaggagttgaaaccaagtcttgtgaaggtatgtacacaaagttaaaactgtatacttatctttgtgtgtctttcatccacaagtttttaactttatgggtatttcttagttgcttagtgtgccaaattggtccagttacatattcctgtcatccttatggagttttgggataattttctatttcttcacagttaatctacatcccatgttaccatggcacattcccttgtttatgttccaggttactcccctaaggcttaacattcaacccgtttcatttttctaatccaacagtttcactaagatttctgtcattacgatggttttgtttttgtctatattatgactcgtcttttgagactgctaaatggttgtttttagacaataggcatagactgctggatgtttcacagtcctagagttctaaaagatcgatgattgattattgaagaaattgtctttgtattgcaggatgatgttgcaatcatcgaacgcataca

SEQ ID NO: 15 - DNA, 1501 bp, Oryza sativa
agtggtttttgcaattttcccttaaaaataaaacacagtgttgcccatatgacaggcagcaagctagcagtaaccaaatgatatatacgtgtggcataagacttatgtgcaaaatttagctacttcaatataatacttctgcaatcactatgctcagtacatatactccatctgtttctaaatatttgacgtcgttggcttttttaaatatgtttgatcgttggtcttattcaaaaaatttaagtaattattaattcttttcatatcatttgattcattgttaaatatacttatatgtatacatatagttttacatatttcacaaaattttttcaataagacgaacgataaaatatgtgctaaaaagttaacggtatcaaatatttagaagcggagggagtaactaattattttgatcggcactaatttctggtagaaagatgaaacaatgtacgtacattcagtgcttcagtgagcagtgggctaatataaattgagtggttatcagggcaaatgaggcttgctacaggtgcttgactgagaatttatcaagtttctagggtgcacgggttgacagatcagtttatgctgctataaatttgaggagttagagctagcaaaaggaaataaggtatgtttgtacttagtttcctaattatgattgtgtatgcattgatgaatttgggaaacctatgcattgatgaatctggtgagcatagtggacttctctttttcttgacacaaattcatccatgtccatccattcggtttctcatctcagtggatttagagaacatcatcatagtttgtaaaaactccttacagataattctctatgaatgcttttagagttcaatttatacattggatttagcttgcatggtgtgtcgatgcattgtagagtgcttcgtaagttcttcgaatgattctttaccaatatgttatttgattgccccatagagttttcaaggttaactatgctccacatgatacacaaactcaattttccctctttcattgtatatcatttgttttgcgaacgcaattgtatatcttttatggcttttgaaaattttggcccaaccaatccaaatccaggtctttttcgtagactggctctatcttttctcgtcaaaaagaaagtatttatataataatatatatatatgttgcttgctctacctttattcttctttttttacgtagactgattctacctttttccgtcgaaaacaaagtatttatgtgacaacatgcagctagctagcttcacattgatagcactcccactccataacaaacacaatagttggctttggactgtttgctaagctactttattaattatagacaaaattacagagtgaactcttttatcaggtgccatgcatgtgaaagttccactccatccacctctttaaaatccaccctcttcattagtctttgcactccagaattgggcaataatagcttgcaatggcggctcatcatgtcatgagca

SEQ ID NO: 16 - DNA, 1501 bp, Oryza sativa
ttgagatacttgctccatgtttgacagtttgcctatgtgtgaccactttttgttcaataggtttttatttctggaaagatactttcaatgctaaaatcaagccttgttgttacaagtataaacaattgtaattatcaacttgcttcctaaaaacactaaggtcttaaaagcatgtgttgtacactaaagactaccgcagatgaaagggaggaggtatcagtcaagataaaatatcaaattcactatgtgaaatttgtatatattttgttgaataaatttcaagcaaattactttgactgtgactattctactgccaaaagaggggtataaatacaacacaagaaacactttcaactttctgatgacagagaactgtagtaggttatgttggattaggtgtgccttgcatatcttggcaaatccctgggctccacgttcatgtggttagttgaatgtactctacaaagcttgttgtgacaacagcctgcacctctctgagactgaagtctgaacctaatactcatcccatcatttttcttacttgaaacaaattaagctcttaagacaattttgtaaataatgcgcttctctttttaggacaagtagttgatctgccattattcgtcttaacaaatgatgatgggatgatacaagatgctgttggtgtctttttaccaaagtgggggggtgaactgcagcttgataaacttcacatacaactaaaaggcaaacaaagaagtagtcttgctccatgagttatttttcttgaaaggattgaattgatgccaaatggagtaaaattccaactcctacatggctaataataggctaatagcatagaagaaaaggtcttagcgaaatctggtcagaaccatcaccgtgtacggtacagctacgaaagaacagaaacgtacatgtatgctttagaaaattcaattctccacattacataccaacgaaagctacggatccacttgctcaaggactctcaaatccccccagacgagtgcaaacctgaaaagaaacgcgtaggctcacttggtatgcgaacaaacgaacagcaaatgcagcagcagcatctctccccgaccttaagaatattgggaaaagaaggggaagaaaaactccttacccccaggcctgagcggagcataccaaccttacctaccaggctaccatcgcccgcattgacgacgccgagccgtgcggccgcaccctgcaccgcccccggaagctcaccgccgtttgtggaagtggaactcaaccctgaaagaggcaaactgcttccggtccgtgacactgccggcaacgatggtgatgccaccagacaaatcaaacggcccaaaatttccgaggaggagtaggcctttgtgggccttcttgtaagagagacccattagaactattttatatatatataatataatgaaaatatattacatctctggccttctactcatggatacacagccaacaaatctatctatctatctatctatct

SEQ ID NO: 17 - DNA, 1501 bp, Oryza sativa
aggcgccgaatatggcgtgcgtgccccctgcgtccgccaccagcgccgcaaccatgacgccgatcagaatccagcactcgcggtcctcgccgaccgcctccccctcggcggcgcgcctcgccagccgcaggagcatggggcggagcaggaggtagctggcgccgaagatgacgacgcccgacgtgagcgtccacgtggtctgcgtgatggtgcagcgcgagtggccgagcaccgtggcgacggtgaggccggtccaggcgaaggtgtcgttgatgagtgatgcggagagcgtgagctggccgacgtcggtgccggcgagcttgagctcggcgatgttgcgggcgaggacggagaaggcggtggaggagaaggtggagccgaggaagatggggaaggagagcttgttcaggaaagtgtcacccttgcgtttgtcgtcagtgctgagcgcgacgtagccggtgagggcgccgacgaggaagggcgggagcgcgcagccgacagcgaagccgaagctatggatgccggcacgggtgatggcggagacctcgatctcgacgccgacgatgaaggtgtagtagacgaggccgaggagggccatggactcaaggacgaagaggctacggacagggaagacgaggttggagaagtgagggaggtggccaaggatggaggggccaaggaggaagctagcgaggatctgggagatgtaggtggggaggcggagaggggagaggaggagggtggcggcgcgggtggtggaggtgatgaggaggatctggaagaggaggagaggtatggagaagtcgagcgggttgtcgcccgtccagacgccacccatggtgatcttgctcgggtagaagcacatcaggtgcgtcttgtccatcgacattgtgtgattccatagctcctctagtggatccgtcaccgtatgcgttgccattgatgaattccttgtttggtatcaactccggcaatgggtggtgttctcaggtaaggtgaggtgaggggaggagtgataagatacaccatcgatcactcgttcgatgtgagggaagggaaagaggagtgtgctatttttggatttctgcatgtagaggtttagatgggttgcatgcctatcaaaggaccacaatgggaggtacaaggtaccactaaaaatcaaagtgtttacgttgttgcttcacaaaaaataatcttaacgaaagataatctcacatagagaaaatggaggggaacaagtaatgttgtttattttttactccaacatcttttttttactgtcatgttgcatgttttgcttggcgatgtatcctttgcctttaatatccctctccccgcaacgcaaaaaatattttgggtaattggctacggttgtgttctttcccgtaagtttcttactcacatccctcattttccacgtgcacgtttttcaaaatattaaacaatacaattttttgcaaaaactttctatatgaaagttgctttaaaaattcatattaat

SEQ ID NO: 18 - DNA, 1501 bp, Oryza sativa
acactttggaagtcatatcaaaatccaatttggggatgtattttatttttaattttatttttaataaatatttttaataagtagatggactctgcttctaatattctttatttttaattctgaattttagtaatttctaaattgcattcctacctgaactctttcgaattcgtagaattcatattgaaatcaaaatttgggatttattttattcataattctaaaatttaattaatcctatgttgtgttctaaatgcactctcttccaatattttttaatttagaattttagtaaattctaaattgttttcctacttgaactctttgaaaatcgtattgaaatctaaatttgggatttattttttaaattttaaattttaattattttgtctttgtttctagatgaactcttttttcaatactacttatttttaattctgaattttattaatatttaaattgtattcttactttaacttttatttttatttttctcaaacttattttttaatttcgtttgataatatactcagtaaggggcaggtgtggactgcatggatgtcatgtgcggttgattgcgcattagacatactccaatcaaacagttgatatttttttttatttttctctaattaacgtggtaatttcttaaaggtttagacatcatagcaaaactgataagctcctatgcggtatacaggagccgggtttgatattttttaggtgcatgtatgttagttttttttacgatctagattatatttccaatttgccgtgctagtcatcaatctatcaaaaaaatgtatgacatttaattttctccaggagtgctaggctagctatttacgaatgcatatggcagtgtatagacatggaggcatgcactatttatttttcttagtactctacttttcctttttttttcttcgatggttaatcggatctactctacagttcaatcactcattctttcattgctcagggaacggaaattgtgtcgtgtattcgtatttctcgtcaagtgagtcgagactgcggctgcatcctggagactgggacggaaatcagcaacagctagcagcacgagccacgctcacgtgtggaggcagcagtagcttagttgggagcttttctcgatgaaagaaagaaatgaaacaagaaatagaggaataagatcccaattttctagcatccatccaggaacaagaccccaattttctagcatccatctatcactgttaaataaaacataggtagtttgctaaatttcatgtatttgatggactatgagatattaaagttggatgcagaatcatatagcgtgcaactctttttcgatatcatattattactttgtagttttttcgctatatattccatgtttgtaacatgaacattgatctattatatataactttgatctattataagtgcaatctcgaatgacaaggattttagccctcgcagcctcgcaatgcctcattttttgtccgtcctctgc

SEQ ID NO: 19 - DNA, 673 bp, Oryza sativa
ttcagtgtccaaaaaaggtgtagatccgcatacaacctatgcaatgtacctttgagaacgaataccatgagcatgtattggctaagctagatacacacactaaaatccagtggccgccttatgaatggatggatgcattcaaacaagtacgcaatttggccactaaactcgctcgaccgatcgagattagccaatggctcgctgacttaatctctgtagcactctcacttcacttgtaacccttcctatttaaattccatggggggtaggggaccctgaatcccacttcccatttcttttacaccccaatctcaccctctccatctctctctctcaagctctaaactcaatggtaatgggcacttaatagtagcactaatactagctactgttttagcagcagcatccaagcccaatcaaatcaagctgcctcactgaaagtctgaaactggccaatcagagagctcctgcaaaaacaaccctgaaactactctggtttgctatcatccagctagattctgttgcctcctaacatcgtcgtttcgccgccgtcactttgctcgaatcatcagagctctagggctacctgctaattaaccatagccatgggggtaagtaagctcgatcaagtgcatgttaggtttcagtaaattatgtgttttcatatgagata

SEQ ID NO: 20 - DNA, 1501 bp, Oryza sativa
tatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaagacataaaatctataatatatatattccttcaacttgtgcttcgagtattttttttccttggagtgatgctataaatcgaaaataataatgtaatactacaaaccgcaatttagatgtaccaagaattttctatggtgaggctcgctttgccaaaaacgagtgaccatgtggggtagcctctgcctccaaacatgctgaactagcagtgtaacttcaagaagatccccaaggaatcatatccctttcatctgatgctctacaaaacctagaagcagtgtgggagcaaaagtcactagccacccatggttttggctatacgcctagaatatgcttcttgtatgcttagaattttagtcaccactctttctctatccgtgctctagggaccccccatgtcacaccttttaccaaaaatcactaaatccacactagccatcctgcctattgcgacattcttactctactttggagtttggaggtgctgctaaagttaaaacacaccaaataaaaccatacacagaaaccctaatgatctggaactacttttaaccctaatgatctggaactacttttatcaagatttttgtcaagttcaagaaaactttatattcaaacaagaaaattggggcaaatacaaggagttaattccatttgatgttcttataagatggaatttcattcaatactttgggtctagatattttcatatatggtatatttattatgcaacaattgtgcacgaataaagataggtttttttatgaaatttcatgatggaacaatatgttacctgaaattataaattataagattacgtgatgacaaataaccctcggtattttcaaaaaaaaaaggaaagagagagagaactcgatctatattgtaataatattactctatctcaaatccatgctacaaatcatacgcatgtataataaaaccacaaacttaaaacgtgacacccgacgcgcaaatagatccacggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagaga

SEQ ID NO: 21 - DNA, 1501 bp, Oryza sativa
tagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatggaaaccacagattacaaagggaacagtggaactcgacgataccgacaagatcgtagtcgagttgatccgactagatctcccagcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttc

SEQ ID NO: 22 - DNA, 165 bp, Oryza sativa
gcagctcctcctcctcccccgctggaggccgctgtcgtcgcccctgtccttcgcgcgacccgccacggaacgcgtggccgcgaggcgagcccgcgccgccgccgtggcgatgaagttggtggaggacgccacccctcccgcggcgggggcggtgcttctcgccgg

SEQ ID NO: 23 - DNA, 1501 bp, Oryza sativa
ttctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggtgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgccccggcatccagcccagagaaggacggcttcgccaggtccagttcgcccccgcgagggccgaagtagccttctcggcccaccaagcttagagaccatagggccggcgatcgcccgatggcccatcaagagcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtgga

SEQ ID NO: 24 - DNA, 1501 bp, Oryza sativa
ccacctctgctcaccccttgtgctcgacgtcgggctcggcatccaattcaacatgtgtctcttggagctccggtcaccatgtttgtgaatttcaccatagagaagatcacgggaggctgaggctagaggctcttagtagtgcttgcttgacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcga

SEQ ID NO: 25 - DNA, 1501 bp, Oryza sativa
gttgccacagcagagaggcaccccaccgccgcggcagcaagaggagccacgctccccggggacagcgcaatgtcaaagagcaagggaacaaacacgtcattcgcgaccagggagacatcgatccaggagatgcacctccgcgccgcatcgagggctactgcggcgacggcggggtcggcggcgcggagggacacggcggcctcgtgccagtggcgggcgatctggggcacgcactgcgcgcgcatggcgtccttgaccctcccggcatcggaggcctcctcggcgttgcgcgggtagtcctgggagagcaggtcatcgtcgagggagacgaggacgcgggcgaacatgtcggtgggtcccggcagcggcggcgagggcgggatgagatcgaggaagtaggaagggtagacatgggggtactcgaagcggacgaggagggcgaggagctgggcgagcttgttgcggaggaagggaggggaggcggcgttggaggagacggcgagggagagcagcgaggagcggaggagggcgaggtcgtcggggagggcgaggcggcggcggaagaggagcgcgtcgtggatggtctggaggcaccagaagtggacgtgggcgtgcggggaggaggcgaggccgtagaggcagaggtggaggagcgacgacggcggggtctcgtcgcgggcgcgcgcgcagtaggcgagcgcctcggcgcgcacggccggggaggcggcggccgcggcgggggaatccgaggcgagcaggatggcctgctcgaggtcgtccatggcggtggcggtggtggcggaggaatctggggcggggcggaggggggaaaggaagagggggccaaagggaaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatg

SEQ ID NO: 26 - DNA, 1501 bp, Oryza sativa
taagggaaaccctgcccaccacgccccccgtgctagattatgggtcatgggtcatcttgcccccgcaacgttcctaggcagttgacccatgggtcgacccataacccaaaagttgaataagcatatgcatgagtactggcactgcaaaaggttcgatctcgtctagttacatggctttcatagtggcgatattgtccaacttgtcgcccacaacgccgatgcccctgatcctctggagcaacatcttgattttgtcatagtctatgccttgttggatctctagcagaaagacgatgctagcaatgaggaacacgatgaggacactgggccgtcaagcaagcactactaagagcctctagcctcagcctcccgtgatcttctctatggtgaaattcacaaacatggtgaccggagctccaagagacacatgttgaattggatgccgagcccgacgtcgagcacaaggggtgagcagaggtggagatatagatgatgaggtaatgagcatgagaagtaggctaccgattttgctgtagtgttgacgcagatgcacgccgtcgtcgcctccacccaccaacatctactggagcctgtgagtgcgtaaacgtggtgtaagatatgggtcaaccccatgcgtggtccgtgcgtcacgaggccaccaacccatgttagcctaggtgaaattgtgggttgacccatatggtttttgccccatagatcgtgggttgggtcactgggtaaatgggttgacccagcccatctacatccctactaattgtgtcatgtatcaataatgatatgcacaaacaaggaatctctgaccgtccaaaaatatgatttaaccaacaccaaaataaatacatgtcaaatcttgaatgttttcatagaaacgataggtttggtatgttgtaattaaggaaacacgtaacttctataccccgagcaataattattccatgcacataacgtcccaaccagctgaggagtcgaaaccctaaggattgcaattgtcaacttggagcctgcataaaaacttcaaaactcatattatatatgtaatgcgcaaaaaatacttgcataataatgtctgagagtgacacatgatcaattcatatgtatacgacattgttatttttttcaagtattgctaatattcctttaatatttcttttagagctagatatttctcaaaggacaatgcaaaataatttatttttagattaaaaaaatatcaaaagaccctcccctccctagtcctaaacctaaaaacccaaacccaaacccaaaaccaaaaccgtccataaacccacgaaatccggcaaaaacggaagattagacaggaagaaagaagggaagggaaagaaaagcaccgcagtggagaggaagaggagcaaaccctctcctctcctatatcaaccccaactccgccttccctttggccccctcttcctttcccccctccgccccgccccagattcctccgccaccaccgccaccgcca

SEQ ID NO: 27 - DNA, 637 bp, Oryza sativa
aagtatgacacgtagggccatgcatgccatccaaatattctatcaaatttgtcatcatcccccattcaggtcctatttggcagggctcttaactcctaaatctaactctaggagcagtgtgtggagtggagctgtggagtggcctgaaccccgctccacccctttacttcatttttttcagatcactccagcccgctctgctccctttttgggtggagctgaaaccgtttggttgagctctagctccagtagaggtggagctggagctgtagccctgccaaacagggcctcagtcaggatgcaaggagttgtccagagtgtgataccatgcattctgacattcatgagttcagtgcactgctatcccattggagtgctgcggactgcggtgctgcctctcagctatcgatgatgattgcttctaccgcattcctgtcctctcccaaggatgttttccttagagccaattgtagaaatgatcatatggcaactggagattgttaaatatacagaacagaattctaaaataagatgttcatccatctgtcttattcgaccatatttgttttgccgccttgttaggtttactggtttagctatgatgcaagcctgatcagaacaatcaatgtgatgcagg

SEQ ID NO: 28 - DNA, 915 bp, Oryza sativa
ccacgtggggctcggccgtcagccgcccgcgccctcgggtgcggctgacgcctggggcccacggcgccggtcggcgtgagccgcgtgcacccggtccaccgtgggccgtgaggctgccgcgtgggccccgctcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggt

SEQ ID NO: 29 - DNA, 1501 bp, Oryza sativa
agtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgattcaagtgctaccagttccttcttcaactccaggccaggcaagagccgagaagggcttcccaaatt

SEQ ID NO: 30 - DNA, 1501 bp, Oryza sativa
  unsure (1)..(1501): unsure at all n locations
ctgaagggaaatcatgggacaaatgatgagggaggagcggggaatcgacttaagacagatcaacatggtggtggcggtagggtttggcacgcgcagtggctggaggcaccctgtgtgctagcggatcgaatcagatgaggacgacgttcggaaaaacagaaacattgctattttttattaggtatagatatagataggtatgatctattagcttaactatcgtagataaataataaaagtcttataaaatcaagctcgttagaagctcgagcttagcccggtaaagctcacgagctttagctcggtaaagttcgtgttgagctcaagccgagctcaagtcgagcctgccacccatcaagcttgagtgacttgtgagcctcgcatgtttttcattacagccctagcgattcactatggcctagtttagttcccaactttttcttcaaacttccaacttttccatcacatcaaaactttcctactcacacaaacttccaacttttccatcacatcatttcaatttcaatcaaacttctaattttggtatgaactaaacacaccctaggtcagccctcaaaataaaaaatatcaatagcaacttcgcttatacactatgtaccgtgccaccaactaactagattacacatagaaaaacctactccctccatatataacagggaaatgctacataattattctgactattcgatcagaatgatacgtttgatatctggtaggtatcaactaatacaccgtctgaacaagatgatacctctaaggtattgtctgatatttggtatgtattggctgatattaaggtatcaggtgatattttagaggtatcatttaatcttaatgggataccactacgtagcattcctccgcataatatagaggcagtaaaaaaaaagaaaagaaaaactcatgagttggaagggtcccatctcatcgtgccggtgctccataccaattttctcgaatctacaaatacacaggagacgaccaccagccgcgtcacggccaagcacaccgaaattccaacgagaaccccacgcattattccgcgacgcgaccacgggaagacacgggacacggaagaggggagagagcgagagcgagatagagttcgagttctacgcccaaaaccctagcaagctcccccgccccgccccgcgtctccagtaccttacanaagcttccaaccccccaccccccaccaccaggtgagtggatctcccatttccccccctctccccgcgagctcgccccgggcgggggatcctagtcttgacccgtgtgcgtgtgtgattcattccgccgcaggaagagcgtgcttggatcgcgcgggggaggcaacgctggcggcgcgcaggtgatggcggatccgcctggcggtgggggatctagcgcttgcgtctgtgagcggagggaggcggaggcggtggtggtggtggtggtgccggagctggggagaagaggaggagagcagcggaggggagga

SEQ ID NO: 31 - DNA, 1501 bp, Oryza sativa
tccattagagcaccccacatatattttgcatttcagcaccttctattattaatttatgtagtgatccaacattttgcactaaacaccctaaaatctagaaataatataaaatctcaccctatccccactcatgcgtcatgccctcctcgctcctcagccaattcccacccgatccctctcccctcgcctcctcaccagtggcggtgccagcatcgtctctcccttccacctttcgccggcgccacctcacccctccttcctctcgtcaacgcctctccctcccccaactcgcctccaactccggctgccaccgcctattgcctcttcgggctctccgaagcaaggaagcctccccactctccagtacggccgtcgtccccctcctcgttgcttggatagggcagattgagccaccctttcggagcaggtgcatatcaaggtggcggtagtagacatggagctcggtggcgacaaacttggagctcggcaacgatggatatggagctcagtggcgacaatctcgttgtccgtggcactttcactggctccttcttcctctctctcgtagggagatgaggttcttcttgggagcttacgccagttgcctacgtggagtgaaatctcctcgatgagactaaatgtcacctaggtgcattctgaatgagcttatgaaaagtagtgcgaaggtaacgatttggccgttggatcttgcgatcgtatagggtagaattaagtttgtctgtcaaggttaaaatcaccaccaccaatcttcattttttttaagtactaaatttgtttcatattataaattgtttgattttttttcttagttaaagttctttaggtttaacaaagtttatataaaaaaattagcaacatatataacatttagttttattaaatttaacattgaatatattttaataatatgtttattttatattacaattattagtatatctctcaataaactgattaagaaaaaatccaaacaacttgtaatataaaatggagtgcgcactgggggcagtattcattgccgggcacacaccaggcccacgcctgaacgccctcatctcctcctctctctccccgactgaaaagtagggcccacacaaaattccctccctccgactgacaagtgggtcccacataaaagttcctccctctgactgacaagtgggccccacataaaaatttttccgctctctcttccacttctccagttccaatccaaccgcattcctctgccccccccccgcgacactgacacgcgggccccacccccgacccccccggctcgatcgcttccccccgcatttggctgcctgccctgcccttgcaccatctccctccccctcgcgccccccaaccgcatctcaatctctctcctctctctctctctccagctcgcctccccctcgccggcgacgagctctcccccggctagggttagaccaggtgcccctcttgtctgcggcgtaggaggtgggaggaagga

SEQ ID NO: 32 - DNA, 1501 bp, Oryza sativa
cgttcgctttcgcgaaggtcctacatcgtcgtccgccttgtgggggttcacccgtggaggcaattcgccgttgtaaacccggttcgcctggccagctgcttgtcgcgtcagcagctggctatactcgacgactgacacgtcgccgatcatcctacgggcttcggcgtcagcctggtcgagggtcaacactacaaaaataataggtgtagccacatcaagcgtcgaacaaagcaaaataacaaaagcaggagtgcgtagcgaaagagcactcttaccgttcgttccctcggggagaaccaacttcggcaaaccatcaacctcttcgccttgatctactgcgacttgccatgattgagagaggggaaagatgcgaagcatgcagaattcctccaccaagtcgcggcaactaaggcggaagcaaaccttacgcagcagagcgaatcacgcctccatagcgccgtccacagcgatcttgggttttcggttcggcgcaatcgccctacgccggcaccggagggccttcgctgagtcagaaccagcctcgaaggggatggtgtggtaaaaccacctcgccatccaatggcggtcccacttcgacatggcggcattcactggccagagatcggaccgctcggggcgaacattaaagtttacgctcccgaacactgatttcttcgtcccagccggggtaatcaccgtcttcgaattcacggtggcgaaaaatatggcgccaaaaagttcggcgctaggctcaaaactggaagtccggcacgcccagtcgaagatagcgatccggaccagcgtcgatgggcttaactgtgggagctctacctggaaaaggcgaagaatctccggcaacaacgtgttgcacggaaaccggagccccgcctcgaaaaacacggcgaacaccaccgtccagttgtcgacgggcttcggtacaacggctttccccggggcgaaagcctgtccctcgactaacgccccagagctgaccaacttcgccagctcactgtcatctatgagagaaatccctaagtaggcggtggtgtcgtcgtcaatccggccggggtcaagccctttcgccgaagaggggttaggcttgcggggagccatgacgaaggatgtatgcagtgacgaagggtgtgtgcagtggtgaacaaaggaaacgaacgaaaggtctaaagggccaaagggtgccgtgagagcaagaacggaggaagagagcgcgagcggtgaaagtgacaagtctggtggtgaaaagaggacgggggagaatatatagcccacccaagcaacggttcacctacccaccagtaataaagcaccacgtgtcgcgagggtaggcgaaacggtaaattcctatcgaccgagctacatagtaaaaagcccacaaagagaaggcccattactgttcctttcggcccgggaaagataaaaataatatacaaccgcctgcaggaggcgaagagcggcaaaacaataccagccgcaaagacaataa

SEQ ID NO: 33 - DNA, 1501 bp, Oryza sativa
tctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagcgcgtcgtccctcgccgccacctccgcacgcagctcccgcgtctcccgacggtgcccctcctccgcctccttccatctctgctcaaattccacaccaaaacccccaccacgcatcagcaaattcgacccaaaaccctaatccccagcaaacagagaatccaatcacagtccgtagagtaagagagagagagacttggctggcggcgtggagctcctcgcgcgccgcacgctcccgctcctgcgaaaccgtaaaatggaagaggaatcagcactacgagaggaagaggaagatccgacaaggcattggatgatcggcaagcaaagctcacgcggaggagccggtgctcggagacgagcgagagaagctgcagctgcagctgcggcagcgccgccgcctccgcctccgccgccatcgccgccgcgccggtgagctcccgcttcctcttcctctccactcgacgagccaaaaaaaaaaaaaactcccacggggccatatactgggccttgccagcccaaacccttccggcccaaaaggcccatccgcggaagccgaatctccatcgaacgaactcgaccgtcgattcagatccgacggctgagatcccacccaaaccctagcccccactccgccgcctcccttataaatagctcctctctccctcctcccccaaaacctctgccctaatccaccctcgccgccgccgccgccgcaagtagccacccgcgccgccgccgccgccgtcgccggagaaggagaggagcagcca

SEQ ID NO: 34 - DNA, 915 bp, Oryza sativa
tttttgttcgcatatattttctgaaggaaaaagtctagttctgttcgctcgactcctcacgtggtttgatttttgtccgtcaacttcaatcccatgccataactatcatagctacctaaataatgaccctaggccagttttgcaatcagtatttagtgaggtggactgccatatcatccttcttttgccatgcctaccacatcatctccctaaccctaatttcctaaaaatgattagaaaaaaaaggtgaaaatgatatttataaatggataatctagtgggtcccactattttttttaattcttttgttcacttattcgccatgtaggctgtctaataggatgctacttacctctacttaagtcttatactagtcactgcaaaactttaaatatattcgttgttagtagtcgaaatacaatattcgtagttattagtagttgaaaacttgaaatagaatacttaattcttatactactcaccgcaaaactttaaatatattcattgttagtagtcgaaatggaatattcgttgttagtagttgaaatagaatatttaattcttatactactcaccgcaaaactttaaatatattgattttcctataaaaaatggtttcttgcatcccctatacaacaaagaataacagatgcacggttgatatacctacaattgctttcagtgaattaatttaaatatctagttatctgtacaaacttaccgtctgtttttttttgtcaacagtggtgtgtttattaatgagaaatatttctatcttggcttgcgtggaaaagtggaggaccagtttaatcctaagaacaaatttgtggtacatactatttctgatatatatactatagcttgtttgctgcatgtggccttatatcctatttctgttgcaggtcaccattttaa

SEQ ID NO: 35 - DNA, 1501 bp, Oryza sativa
gtgtcaactggcacgcctattttctagttgaacttattatcggatggagcaaatttcatagtattacgaatctagctatgccgatcatatgttcttataatttaggacaggtagtatatcatatagcgtgtgagtaattgtgtgttggggcacagcacctaaattatgagaacgtagtcctggataggacatatcctaatacttcaaatatctccgtccaaattaacagtactacatcacacataacataggttcttatattttgatacgcgagagagtagataattgacagtaggttcctgagctagccgatcgatggctttatatataccaagcgccggccgtcagcgaactcgcgccggttagttcgtcgatgtttctttctgcgtgcgagctaccatctgactacctcctcctgcagctctcttgcctttcttttttcattttcttttttgttgttcatcggatcatcctgtgagtcctctctctctctctttctttgcatgcacgattagttcttaggagcagggaacacattgctacctccggtctaaatgacgttttagacaatggatgaatcaattccttgggattacgacggtatcaaatgtgcatcgtgcatgcaaggtgtttgtggaaaagccgacttgatctgcttctcttgcagggctcactgtcagttccccgtttgcattgtgaaagcagttctttattattattattattattttccgaagcaaacctccgaaagggtagtggtagtgagttcttgtttttcattgagaagagagaaaccgagcataaataccttacagttacacggctaattgaaggaaaaccggccgaacccacacaggatacccaagcaacttgtgtttaatttggtgtatggggttttgaggatttttcttgttatctctaagggttccttttatgtaatcaggaatggaaggatcaactagtaaacatgattccctggtgcaaaaacatgtggattttggtatactggagaacaacatacaagatccaactgcgacgccaatgtatctgccaatggaattcttgaaaaccattacatgtgacttctcaaaggaacaagagcttggcaggggtgggtatggagtggtttacaaggtatgctccccttttttcccctctggttatcaagggtgcgtttggatccaaggctagcaggggcctagcctggcctggcaaggacagtcgtttggaatcagaaaaaaatcctagcccatgggggcgagctagcccataggagcgagaaaaggatagctcacaagggagagccgaatcggctcgcctccgacggcaagctcctcgcgtgaaaaaagttgttgataaggatgaagcgatttttctcaaaagttgttaccttcttcaacaaccagccccccaatttcgtcctactcctccactcttcgccaaagaatcgggcttgcagatctcgtcgctctcttcccccactcttggctgaactataggg

SEQ ID NO: 36 - DNA, 1501 bp, Oryza sativa
gcatgcaacaggggaatttaatgttctgcaaacaccatatgaccatccaatgactgaagatgatgattttattggtgataaaaatggcagtcctggtgatgttgacccttcatcaaattatgactcagattgtcttccagatcaagagaacaatactggaagtagctcatcttctaggcgtgcaaaaggtagaaaatctgataaaggtaaaagagttagaactgatgataatgtggtttatgagataacaggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaagccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttagttcgaacttgtaataaagtagttcaaaaagatgtttgattgtttcaaggaattcttttagcatatagctttgccctttttactacttctatccgtattattcttgtggccaagttaactgtggaagaatctatagtgttcttgtgacaaagccataagttaaaaaaatttgatctgtgtgcaatattattttgctcaatatgaaaagaagcggcacaaaatactctaaagagaaagatgattcgttgaagcaaccaaacggctagccactaattcttgccatagaaagcacaccaaccaaacaaagggtatatggcaagcctggcaagctggcaacgagttggcttgcccttacccagctaggctagctgggcaatggaaccaaacagaccctaccataccaaagaccagcaattcagaacaaaaatgctcttagaattctacagattttggcacgagaattcaacagatatgacagtttagttcctccaaagaaggaaaatataagtatgataggtgcaaactaaggagacctagctactccaaatccaaaagcattttagatcaggaaaatcaagaacatcagagtatagaatttcgcaaggcaattgcagtcatagatggatagcactgtaccaactcaaatgatcaaagaatcacaacctgcataattgttcaccaatttctaccctattctagagacaacaatgaaaccaattctcctatattaaggttcattgagttaatagaattctaccctattccacagacaataaaaccaactctaagctctcccatatgttacactcaatgaaacgaaatcctatgttaaggttcattgggttatatagtctatagtaacactaattatcaacaactttaacaaaccaatcaaacattttctacgcgata

SEQ ID NO: 37 - DNA, 1501 bp, Oryza sativa
acctacaacatactactctaatgctctcacctaatactccgtcttcatctgctacatcgccaacagacttttaattataccatttctgaatattttttccacttactctacgtgttatatatgacaaacagtcttcgtgtacccatcagttcacccaagagagcctcatatccatgacgaaacatgaatgattcacctacacttcataagagaccgctgttcaccactgtcctctccctatgcctctctcaagtcctttttctttgagaaccaaagagaccattactaaaatgtgggttaattggatccatgccattgcaactttaccaaatttataaaatgacactactatttgtcatatcggctatatgccactggaagtttctaaaattggaaccatgccactccagccaccttttccgtcctcctctctcacgccgtctctgttcccgtcctcatccccctatggtgcatgcatgcagtttttgttactgcattcatcaattttgttaccgaagtaaatgtactacgaaagagtttttacttctattggtctcgatgcactcatgttatgtgtgatcaactggaacaaagccacagaggaagtatgacaataatgtttaacaaaaattataacattgtaggagtacttacaaagaaaaagcaacacatctggttttaatgttttcaaatcaaatatgttgagaactattcagggtcagtttttgaaagtttgatccaaaaaaccatcggacttgctaaaaatatgatgccacagtttttactaaattttagtcactgttttccacagaggaaataggaaagatactggcatatttaaatacagagagtagttagtttttatacatccattagttattaaaaacacatatccatccatgacaaggtgtctcttgtaacttcactgatcccaaaatatattgtcatggtctctcttagagatgctcgtaaagacaaggtgtatatttatatgaacaagtatacccgtatgtatataaacgcttacgtttgtatcatattttcttaaaaaaaaaataacgaaacatgaatgattcacctacacttaattaggagaccactgtcctcctcccctctctcaactccttgcctttgaaaaccaaggtgaccaccattttcttttttttttctttttgcagtactttgtaccagtaattaatcaactaactaatcatgggattaaccaaaactaattcttgtgtaaatgtagtgtgcaatgcccagctgccccttacctctcaccaaccaaccatatgtttcgcccactcacacacactgacactgccacctcactctccactccactatatataccctcgctcgcgcgcgcgcactccactcgcgcactcgcgctcgctcgcacgaacgcacgcacgcacgcacgcacgacgcgcggcgcggcgcggcgaggcgaggctagctcaattggcggcgatggaggcggtggcggaggcggtggcgg

SEQ ID NO: 38 - DNA, 1501 bp, Oryza sativa
ggatttcccacctgtgtgttgttctcggtgtgacttcaagcggtgcacataaacaagtagtgttattacccactctgttaatatacaaacacatgatattgtttggaacaattgcaaacaaactaagttttaataacaattatatataatttgaatatttaagttctcattaaagggatttgtacagaaatcgtgtgaatagtattatttttccaagcaaaactgcttgtaaactgtggtcgaatggatttaaatcggacggcttagattcatcaacagatatggctatatatagaacacttcaaccctagcaagccacctctgacccactctggttctccaccgaaccgccgccaccccccttgcatcaaccaaataatatgttcctagctattgtaactttggctattgctttaactgacatgaaccatgaattgcttgtatgctaattattaattgtaacctctttactgaaatatatatttatgttggaatgtgttgtgctcttgtgtgcttgttggtggtttatattgtgatggaaataagctctgatggatatagtaaacaaattgcaaatagcatatatttttttttattaacacatgttctcatagcgggtgcttcaaacacggtaacgcaccacatgttaccaggtgtgaatgaatcacggtaacacaccaaatgttaccgtgtgtgaaggacactcggtaagccaccgttccgttaggagctccgttacacaagagtccagctatgacggcagccttaccgtgtgattcagcacactcggtatgtgttttggccttcccgtgcgcataatcgtaaaacacccgggaagtgcgcacggtaaactgatgaagcctccgagtatatgttcccgtgcactagcacccggtaacgtcgttaccgtgtgtttttggcctgttaccgtaggttttgagcacacgggagccttccggtctccagtagtgtcgagggcttctcggtgactctgaccccctcgccaccgcggccaacgacggccagtcctgttgcttcgagatgaaggcatgcgccgcggtggtgcccgttgacaccgtcgctacctcgctagcagtgtcaaagtggttgtgcaagtcgtgtggcgagggcgatgccactgtgttgcttctcccatgtcaccaccgttgcctctgcagggagtgcgagcccaagctggacgcttgccacgtctgcctcgccaccaagaattcctctgcttccatccgcatcgtcgtgtctaccacgcccaggtcatcgccgcctccgtctacaaggtggtgggcctctaggaccacaaccccggcgccaaggtgctcaccgtcgccatctatgggctggaggggaaatgaaagggatgtgaggctaactactgggtcccacattattttctatccttgtttgtcatgttggcatgccacatagataaaagtgacaaatagttaagaaaaccaccatcttagaggagaaaaaaaactttaaa

SEQ ID NO: 39 - DNA, 1501 bp, Oryza sativa
ttgtaaaagtatagaaaatgaggaaaattgtgaaaataaatttggcatgacgtgtgctacaatctagacactcccaatatagtagacgataaaattcacataatacaactaattttgatttattattattagattgaatttcactttacgctaacttttattaccgatgttttctctttggatcatccttttaaccaatatttttattttggattggttaatcttacccactactaaaaggcattttccatatattccaaaacctttttttcgtgtggttgagccgtccatttgcccaaaagtgtatgtgaaaatcgctttccacatgggtagcgcacctgcatgccaaaatcagatttttgtgtgtggatggacgcaaaaataaaaatccaaaaaaaaactcgaaaaccctagctaggtcatcgttgcggtccatcaccgcttgtcattgtcgccgtcaagagttctttccacatgggtggcgcatctgcatgccaaaatcagatttttgtgtgtggatggatgcaaaaataaaaatccaaaaaaaaaactcgataattttcatcgttgcggtccatcaccgcttgtcattgtcgccgtcaagagttcatagacaagtaggagataatgtacctgtaatagccctcccttcagaaccgcgtagcccagcccatccgacgggcggacccacttacacacaccactcgacttatatttcttcatcgcttcgtataaaagggttaacccggaagtggcatggttggagggaagatgccttgtaaattggttcaactcgtgctaaactagtaaggtgatactaaacatgcgcacacagctcacaggagccacataggccaaatcctaattgggctaggatgtcacagtacccaagatggctcaaatgattgagaagagagccggatggttaaaagtgcaagaaaggtattattatcttttaaatagaaaggcaacgtcagttgtgatcgcactagctagtcaagaccaacagaactagatgaaccatatcctggcttgattcccatgttctacttggatagggacacagatgagtataaatacgaacacaaaaccacatatcgttttggatgagattaattgagtaggttataattaggatttcccacctgtgtgttgttctcggtgtgacttcaagcggtgcacataaacaagtagtgttattacccactctgttaatatacaaacacatgatattgtttggaacaattgcaaacaaactaagttttaataacaattatatataatttgaatatttaagttctcattaaagggatttgtacagaaatcgtgtgaatagtattatttttccaagcaaaactgcttgtaaactgtggtcgaatggatttaaatcggacggcttagattcatcaacagatatggctatatatagaacacttcaaccctagcaagccacctctgacccactctggttctccaccgaaccgccgccaccccccttgca

SEQ ID NO: 40 - DNA, 1501 bp, Oryza sativa
ctcaatcaactccaaacttttcaaagcagaatgaagcctggcttctgcaatgtccttgttgcacatctggcacagactggtgacttgcaaacagatcttcaacatccctagggcttcctcaacattcttattcactgaatacaactcaagaagctcatcaagcttcaacagcagggagctagcaacctcttgcaggcgcaggttttcgccggacagcatacccttaagctcatcggcgtcaaccaacacgccgcggagctcatcgactgcaaggatgaactcctcgtagtggaccctacagagctcctcaatctcaacctccttcattttcacgatgctcctgaggccttgcaggagggactcgggcttcccggactcgaacgcgtggcggacgatagggcccagatcctcgccgttggcgatgaaggcagcaaggcccaagccagcgccaccgttcccgctctccccgccacccctcttcttggtctgagcagtcattgttcaactgcaaaacacacacacacaaaaaaaaaaatggcatgctgcacacagtaagacatgcgtccaccttaagaaatcgggtaccccctaaatttagagtgctacaaatgattagcatatgaagaacgcagtaataattagtgaaaattaattagcaagccaagaaattagcacaagcgttgaagtgtaaaccaccaaatttgttaaaataaaccgacctaacgtggggcgtgggggttcagcattttttcaaaaaaaaaactactattatactaagaaatacggaagaaactgaatgggttaattggaggcaaagtagtcaatccaggtcgggatggatttccaaatccacgccacgacggctcatgaagcggcggggagggaggaagggagagagtgctacgggagaagaacgagtaccttgggggttcgattcgagccggggatggaggcgagtggaatgaggccggccgcgtcgcgtctccggaccttgctgcgccggccgtgcgcgcgaggaggccgcgcaggggtgggggagaaggggaggaggaggaggccgcacacgccgtgtgcctcaggggcagctcgccggcggcgcgcggcggggagggggaggaggcgaggcggggcttgcgggggagaatgccggcggtgcctctgcctccgccggcggagagagagagagaagagagagggatggagagtggagtggaggcgagtgatgagtgatgggaggagagagaagaaggggcaggggagtcatttctccatttcccctcaatttttcttaaactaaaattccaaagaacgatttttctccgaactaaaattcaaacttcctctatcccttcaatacaagagattttagctatgcaccgtctttcttttggcttatgagccgtagacaaaatttaaaattttaaaagtgattttagagttaatttagagatttattttttcgtagtttttttcgtgtgcttttaaattaaaggaaaaaata

SEQ ID NO: 41 - DNA, 1501 bp, Oryza sativa
agtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgatccaagtgctaccagttccttcttcaactccaggccaggcaagagccgagaagggcttcccaaatt

SEQ ID NO: 42 - DNA, 1501 bp, Oryza sativa
tcatgctaaatcgagaagttatcaaatagaaatgtggtgttcatccaatgctaaccagaattcagacatttagactgcaggttttccatcacttaatgattttttcaaacggttttgctatttcacttgtgatagatttttggttcccgtctttcgatttttcgtcagtaagatcttgcatccagattcatgctcatgtatatccaatttatagttaccctcgattacagagcacttatacttggctatagagaatttgtacttagttacaatttactaaaattagattttacaagtgtttttttttatctctagatatacggtttttttttacatttttgtcatttttcattcaaaatgggttatatccattgattaaaagttctgtaagatttgaagctccaatttatccaaagatcaataggtactcccctttttcaaaggttttgctattttacttgtgacagattttatttttactttgtaggatcttgcatcaagattcatgttgctgtatatccaacttacactttcgctacttcttgttgggatcaaatccctcttgcacggaaaatggagcgatccattagagcatgattaattaaagagtaaattgcattgctggtacacaaacttgttagaatggtacaatttagtatataaacttgtaaaatgcccgttttagtatacgaacttgcctagttcgtgcgaacgaggaccaaaatatcattgctcgtttttttttcatcttttttctactatcactatgtcatattctattttttattggagaggtgtatgtctaatagcaatcttctcagatatatgtttacatagtatcctaattagtccatgaatcaataagattagccatataatgtccttttcgccttcatccgcatgcattaaacaagttcatgcaccaaaacgagcattttacaagttcgtgcactagattgcacccatctgacatgttcgtgtaccgacgatgcaatttactcttaattaaatattagctaattctttttgaaaaatggatcaaaatgatttttaagcaactttcgtatggaaaattttttgcaaaaaatagactgtttagtagtttgaaaagcgtgcccataaaaacgagaagagtgagtagggaactcatgcaaagaaactccgccttacattcagttgttttgcacttacacttagttacagtgcatcaaaaaaaattttagaaacatgttttttttctagatttacgattttagacatgtttgtctcttttcttttttattttacttataatttgttatatccattctttgaaattttcgcaagatttgaaactataaatttatcgaaagatcgataggtaaaaagaaaatgaaactaaagaaaagtagcttatctgatgggccgagtcagccggcctggcccggcctaacaggccaccaacccactcagctcagctccctctatataaaccacccgagacgaaccctagggttttcac

SEQ ID NO: 43 - DNA, 1501 bp, Oryza sativa
gcatgcaacaggggaatttaatgttctgcaaacaccatatgaccatccaatgactgaagatgatgattttattggtgataaaaatggcagtcctggtgatgttgacccttcatcaaattatgactcagattgtcttccagatcaagagaacaatactggaagtagctcatcttctaggcgtgcaaaaggtagaaaatctgataaaggtaaaagagttagaactgatgataatgtggtttatgagataacaggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaggccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttagttcgaacttgtaataaagtagttcaaaaagatgtttgattgtttcaaggaattcttttagcatatagctttgccctttttactacttctatccgtattattcttgtggccaagttaactgtggaagaatctatagtgttcttgtgacaaagccataagttaaaaaaatttgatctgtgtgcaatattattttgctcaatatgaaaagaagcggcacaaaatactctaaagagaaagatgattcgttgaagcaaccaaacggctagccactaattcttgccatagaaagcacaccaaccaaacaaagggtatatggcaagcctggcaagctggcaacgagttggcttgcccttacccagctaggctagctgggcaatggaaccaaacagaccctaccataccaaagaccagcaattcagaacaaaaatgctcttagaattctacagattttggcacgagaattcaacagatatgacagtttagttcctccaaagaaggaaaatataagtatgataggtgcaaactaaggagacctagctactccaaatccaaaagcattttagatcaggaaaatcaagaacatcagagtatagaatttcgcaaggcaattgcagtcatagatggatagcactgtaccaactcaaatgatcaaagaatcacaacctgcataattgttcaccaatttctaccctattctagagacaacaatgaaaccaattctcctatattaaggttcattgagttaatagaattctaccctattccacagacaataaaaccaactctaagctctcccatatgttacactcaatgaaacgaaatcctatgttaaggttcattgggttatatagtctatagtaacactaattatcaacaactttaacaaaccaatcaaacattttctacgcgata

SEQ ID NO: 44 - DNA, 1501 bp, Oryza sativa
gtgtcaactggcacgcctattttctagttgaacttattatcggatggagcaaatttcatagtattacgaatctagctatgccgatcatatgttcttataatttaggacaggtagtatatcatatagcgtgtgagtaattgtgtgttggggcacagcacctaaattatgagaacgtagtcctggataggacatatcctaatacttcaaatatctccgtccaaattaacagtactacatcacacataacataggttcttatattttgatacgcgagagagtagataattgacagtaggttcctgagctagccgatcgatggctttatatataccaagcgccggccgtcagcgaactcgcgccggttagttcgtcgatgtttctttctgcgtgcgagctaccatctgactacctcctcctgcagctctcttgcctttcttttttcattttcttttttgttgttcatcggatcatcctgtgagtcctctctctctctctttctttgcatgcacgattagttcttaggagcagggaacacattgctacctccggtctaaatgacgttttagacaatggatgaatcaattccttgggattacgacggtatcaaatgtgcatcgtgcatgcaaggtgtttgtggaaaagccgacttgatctgcttctcttgcagggctcactgtcagttccccgtttgcattgtgaaagcagttctttattattattattattattttccgaagcaaacctccgaaagggtagtggtagtgagttcttgtttttcattgagaagagagaaaccgagcataaataccatacagttacacggctaattgaaggaaaaccggccgaacccacacaggatacccaagcaacttgtgtttaatttggtgtatggggttttgaggatttttcttgttatctctaagggttccttttatgtaatcaggaatggaaggatcaactagtaaacatgattccctggtgcaaaaacatgtggattttggtatactggagaacaacatacaagatccaactgcgacgccaatgtatctgccaatggaattcttgaaaaccattacatgtgacttctcaaaggaacaagagcttggcaggggtgggtatggagtggtttacaaggtatgctccccttttttcccctctggttatcaagggtgcgtttggatccaaggctagcaggggcctagcctggcctggcaaggacagtcgtttggaatcagaaaaaaatcctagcccatgggggcgagctagcccataggagcgagaaaaggatagctcacaagggagagccgaatcggctcgcctccgacggcaagctcctcgcgtgaaaaaagttgttgataaggatgaagcgatttttctcaaaagttgttaccttcttcaacaaccagccccccaatttcgtcctactcctccactcttcgccaaagaatcgggcttgcagatctcgtcgctctcttcccccactcttggctgaactataggg

SEQ ID NO: 45 - DNA, 1075 bp, Oryza sativa
tgactattttttcatttcccaaataagtctttatatttgtgagcacaaaatatagagctgctgtataataatttattttattagtcataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatgtaaacagcatttataaatattacatgactttaaatgggaaagccataaacagctaacttgtacagctaatcaagatctacaacttttattttggtcacttcttcatctgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggatcaactttgttgttgaccatatttccatttgaaatcatttagtatttacaaatgttgattatatttgtcatattgtcaaaatcaatttcaagctgttagaaacaaagttatatagataaatgaccgaaataaaagttgtagatcttgataacctctacaattttgttgttgaccatatttcgatttgaaatcatttactatccgaaagtgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcccgtcacagatgagtcatccgtgacgggcctgaatgtcatctcaatcggacattagtatggagcccgtcaccgatgagtcatctgtgacgggctctacgacaaagcccgattgagatgactcatcactctaatataactagggtttctcagatcggatcgaaaatttttctaagtcccgctacagtttcccacctccttaga

SEQ ID NO: 46 - DNA, 1501 bp, Oryza sativa
ttttgacaactataccaaaattttagcaggatttcttattaagttaccaaaatttgatagcaaactaaatgtagccacttttttagcaactttaccaaaatttgataaggttgaaaatggcatcaaagtgaacaggccctaaattccttcggaatgcttcaaggatgactagtgtgaattgtgaaagcttcttaatccatgcttgcatgtcataagctcatagctagtaatctaaatgttgttatatataaatacaatttttaactcaccgaaattgtcagtgaccttttttttccatttgacaccactgggatggccccaagttttgctttgttatttataggcttgaggagatttgaggcaagctgccctcagctcttgcaacctttccttccttctattctatggctatggccctatttatgtttggctgctcctgaatctcctcctattgcccttctgtctcacatccctgtctcataattaaagtcataattaaggagcttctctaaggtgattgggacttgttgcagggatcaggaggaaaacaacaaggtagagctctctgttcttgattcttgttgtcttttgtttttctgttcatatgttgtgcagattataacattctatatgttgagggggaaaaaagaagggaaagagatgattggtgcattttgggaacaggtttggtgctttcatgaagaaacaagaaattggatgtgtgaatgtgttcttgcttagtttttttatgctctctttcccttgattttcttcagttcttgcatgattgcatcttgttatgttgctcatttgtcctatcatgggatgttttcttgaacaaatatatactatcaagaaagaatgaaaaggtgttcttcaaaaaaaaaatgaatgaacaaggaacatgaaatttgttctgaaaatgtcaaattctttccctggaacttacatttgatgcccattaaaaattagctttgatctgcacaggataacttaaattttggattaacaacaagaggaagtggatcaaccagacaagaggaaaacgtgcaaacaagacaggcttgcaacatcaccttgagtccaaagccaagaaagatggggctgtcaatctcatacccaccagacgactacctgccagcaatggaggacaacatgggcaggctgttcatccggtccctcagcttcgacgacgacatggaggccgccgccgatgactcgccgtcgacatcaccgatgccatcaccgtcggcgacattgctgccggcattcggctccggggggaagctgatcatagagggctccctgagcttcaagagaagagaggctgacccggttcagatggagaccatgatatccatcaggagtcccaagtctgacaaggagagctgcagcagcaagccaaatgctactgctggtgcatcgagatttgcgcttgccggagaccagacaccggaggattctccggtgatcgccggagttgccagccccaagcaccagg

SEQ ID NO: 47 - DNA, 1501 bp, Oryza sativa
agaaaaaattgttctttttggtcgcattttgatctatacgtgaaaataaactaaaattattatttccggtcacgttttgatctgtacgtggaaaaaaaagttgaccgttttcttaatgattttaatacggtatcgattaattgttctctcacgtgtgagcctggcctgccgcgtgcaactactatggaaggccatttgagacattttttatcactgtttgtttttctatagaattcacgtcgtcctttttctgtttttatgttctcgagaaatatacacacgcttagatttttctgtttctcgcgtatgttctttatcgtgaaaataatgtttacttttataaaaaaataaactgtacacgttaaaaggtgaaacggttgattttcgacctatagtgtttgggacttttttcccccagatcatagttttcataaaatattttagaaagaaaattatgaaccactattttagttttgacaaatggacacatatgatattaaaaaacatttatatatgtatgtataaatgatttatttattatgtagaaaaacatatttgtttaaaaaatataaaacctttatgccatgttaagtaaaagtataaaatttaatgtgtcattttatacataattttttaaaaaatccaaacaagtaaagtaaattttgagatttatcaaaattaattagtttaaatatattttcttttggatttgaatatttgaaagatcaattatttagtatatttagagttgtttttaacatatcatgtgtaacaaaaatataattttggctcaggaggtattaatgatcctattccatgacataagaaagcaaggtttctttctttatttctttgttttggattttctttgtataatagtttcagatttactgtatattctagagttataggagtagtactgagtagcgtggtatatttaaagaaggaaaataaatgcaaattcgttgttttagatttattttttgcttaacaattttgggtttactatatactctagttataaaagtagtaccgagtaggcgtggtatatttatagaaggcaaatgagtagaagttcgtgtgattggaaaaggaagatagttttggaaacctctagaatccatatgtgatatttttctctagatttttcctcacatatgattgttaggttttttttctctagtataaatttatgatttccttcaaaataagaggtaccacgtgtaccaattgaaagctagcaaaagagccagttttagattattagataggacgtgctaatgagcgttattgggctaggtcgctaggaggacagatcttgggttttctttcttttggctcttttttttcgccacgtggccacttctagtcacctctactaagccacatattttctctaccattataaaagttgaagtttatctcactttggaacgttcgactcctacatggtgttcgcctcttcccattcctatatacgtgcatcgtcttccatcacctc

SEQ ID NO: 48 - DNA, 1501 bp, Oryza sativa
tatgttacaattaatttgtagctaatgtgattttttatttgatataacaaagtttaaataatggaagttctatttgtagtacatatacagaaggtttctcatatatatttactaatgagccttaaaaactaatgctattatcacatgttgttaattcatgcaaatatacaagtaattaacttaataatcagtacattactgtttccgtctggctaatttggaaagcaaagcgcggtctcgcaaatcagacaagcgacagcgctgtcacatcgctcgtgttcggcgcagtggcgagcctgtgctgtgcactatcgcattcccactccgcgagaccgccgtgtggcgctatcgcattcccaccgcgcgagaccgcccggcgctctcgcattaccttcgtgcaagactgcgcgtcccgtcgctgctttcctagacccgcggcacccgctcgctctcgcacttcccaggcgcgagaccgccgccgctctcacgtttcggcgccaggaaactggtagcaacgctgggccccatcgcactcgctaacgcatactgcgagagtgctgacgctctcgttactccaagccgcgagacggccggcacttcgtcctcgcttatctaaacagcgataccgctctcgttctcacgcatcccgcgtgcgacgccgcgctctcgctaaaccaaaccgcgacggtggtatattttcacaaatcttctcatgttcagtactttcttacaaattccacggaaaaaatgtatatttctaaatttttttcagcagacagaagccgctgtcatgcccgtgataaattcatcctgaaataaaaatcattctctaaaagaaataatagaattaattaaaattcgaaaagaaattggcaaacactaaaatacgtacaagaaaaattcgaatgttgtccggagattttttgttaaattcccgtggtctaaaaagagccctcaaattttacttgaattttcagagcaccgaaaatattattaagcaacaaaaacaattatcagagtttactaaaaagaaaacataaaaataaatcctccttcctcctttgggccaagtccgaagtcctcccactctctcccggcccgcggccaaagtcctccctttttccctctctttctctccctctctttctctccctccttctcttgggcctacccttcccctcccggcccactccctcctctcctcctccttctgggctgcccctcccctccctccttccctctcggcccagccgcccggcccaaaccaggccgagccgagccagccgtgcgcacgcgcgtcgcacgcgcgctgacggcgcgcctgcgtgggccccaccacccgggtcgtcgtcctcctcccgcacagctcctctctctctcccgtgaaccctagtttcttctccctcaaatccgctcgattcaaatgactaattccaaaattgattagggggaattaatcccctttccctcccctctctttcccccttaattacctcttgat

SEQ ID NO: 49 - DNA, 1501 bp, Oryza sativa
  unsure (1)..(1501): unsure at all n locations
tttttatatgaatgtattataaataaatatccttcttaatgtgaaacgtacgacatccgtacagtgcgtaccaatactacaagttcaagggtggagaacagacccgaacaagggagaagctactagtacgtacctattggccggtaatactccactcacttaatgtattccaattgtttcactaattgcaaattttaactatttttttctatgatatgtcctgaagtgtcacaagcaaccgcgaggaacggtcctttgcgggtattacccgtgcgaattccttagggttaataagaggtacagggttaacgcagaggatgtaagtccctgtactatgtactagacagcttcacatatttatgatactaatatattgtttatcttcaatgcatgcagttgccaagattaaaacgtcgaacaagctttgacgatacaggcatcacaaatgtccagcgtgatctgtgccacttcatccaccatgagtgctgtcatgtgaaaggagatttctttgacccaaagggtgccctagtgacaagtgacgaattcaaggatcttcgggagtggaacacttctatgccataatgtaactagatggcgtatttgaagtgacaatataaaaaaatataatatatatatatatatatatatatatatatatatatatatatatatatatatatgtagtatatggtagagnaatgaggagaataaatatatgtgtatatgtgtaaagttgtgtatatattatatatatatgtatatgaggaatgatgtatgggtgtgtgtgtatgtgtatgaggggggtgtatatatgtgtgggaagattaaaattttattatatttttntatatatataggtatatataggtgtatatgtatgtgtgggtgagagatagagagagggggggggtgtgtgtgtgtgtgtgtgtgtgtgtatgtgtatgtgtgtatgtgtgtgtgtgtgtgtgtgagatagatatatatatatatatatatatatatatatatatatatatatatatatatatatatatatatatatatatatatatatatatatatatatatatatatatatatatatatgtctcaccatttgtgccttttccattctattacagtcatagtaggcatgcatcacaattctccaaaacaaagaattacctagaattgattttgtttctcatgatggtggatttgagcttggaaagcatcaggaggatggtacgtgctacagtgatcaatgcatcaagctaagtcagctcagttagtagaatcgaggaggctcaaacaacaatagtgaagaaaaggttggaaaatattgtcttattcaggaaagtttggacccatgcagaattatagtagtagagattaacatggtaagacgaacatggatgacgtaccaaaattctgcggaaacaggttcatgaattatagtagtaaagattaacatggtaagacgaaagatagactgtaacgaaattggctataagaatagaac

SEQ ID NO: 50 - DNA, 1501 bp, Oryza sativa; identical to SEQ ID NO: 47

SEQ ID NO: 51 - DNA, 1501 bp, Oryza sativa
cagcatgttataatgctgcttattgatcactaccagaacatgtaaattaatcgcttcaccttgttgcaccagatttctgggaggaggaattgtttcctgaacttattaagcccttgccagatgatggtcagtcattgctttcagttttgctagctattagtatcacatgatcattatttactcttcaccttgttgcaccagaattcacgcagcttttgaaaaaggatctaaagtctcgtaattatcccatgccaatcaggttttggggtgagtcattgctttcacttttgctggttacttttgttgcacattttgacggtattttctagcaaactcaactgtagttttatgtttttttaaccagggggtatgcgcttgaaaaatacttttgaagaggaatttgctgaagatacatggtgcaaactgagtaaaaaggttgctttaaatacatcccaaagtgttgtctcacttgcttcgttcaaaggtgagattacaatgttatatgatctttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacgcgcgcgctcgctcgcctggcctggcaaggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttacta

SEQ ID NO: 52 - DNA, 1501 bp, Oryza sativa
taaatatgcttgctgctaactgtagagaaagtggaatagatgcctcaccaatgtggggaggtgaactctcatatatatatagcagaattacaatcaatgctagtgctgagttacaatcaatactagggagttacataagaccaaaggtctaggagagtaactatctaggagtgtaaaagtttaggagataaacagcctatagattaataaataatcctaatacccgcccgcagtcgtagcgggaggagcatgaacgcacagactggaccgaaaatcagtaaataactgaaccggcaaacctttggtcatgatgtccgcgaactggtgcgatgaagggacatgaagtacccggacttgtcccaaagccaccttttcacggacaaagtggatgtcgatctcgatatacttcgtccatcgatgatgcacgggattcgctgtcacgtaaacagcactgacattgtcacaatagacaatagtagccgaagcaattgggacatgaagttctagtagcaattgccgcaaccagcagcactcggcgacggcatgagcaacggcacggtactccgcctcagcactggaacgagagacagtagtctggcgcttggaggaccaagaaaccagataatctccaaggaagacacagtagccggacgtggaacgaggagaatcgggacaacccgcccaatccgcatcggagtatgccgtgagggactgaatcgggccggagccgatgtggaggccggtggagaggctgcccttcacataccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacgggcaggccgtcggtggcggagagcttggcacgagtgtccactggtgtcgatgtagagtggcactcggccatgctggcccggtgaagaagatccacagcgtactggcgctgtgagaggaagaggccggcggaggagcgcgtcacagagatgccgaggaagaagtggaggtcaccaaggtctgtcatggtcgaagcagtgaggatgatgtcatcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttaataccatacagggacttctgcaatagacagacagcatcaggggcagcggggtcaacaaacccagagggttgctgacaatagacggtctcctgtaggtgaccatgacgaaacacattcttcacatccagttgatgaattggccaagcacgggatgcagcgatgctgagaacaaaccgtatggtggccggcttgacaaccgagctaaatgtctcgtcgtagtcgatgccatgctgc

SEQ ID NO: 53 - DNA, 1501 bp, Oryza sativa
cgtcgatccgcggtttctcgaagacgttgctgtggtctcatcagtgcgagagcaaggcaagtcatgctttacatttgatcatattgtacccaatttacaaacaccctgcatttctattaaatgttgcattcttttacaatgtcatgtgggatgggtcctattactcagccatttattgtttaccatatgccattgataacctgggtatcaaaatgattagatgttggtttaggaaatgcttagccatgcttagctccactagtacacaaaaagggatcacattattacatagactttgtctattggcatagctttagattggtgccaccgcaagggtgttaattaattaaaatacactgaatggtgggctatgggtgcatggttttgctggtcgcacccatagcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttaaggggtgggggtgaaaccttagcgtggtgtggatggttaggggagggttatgtggagggtcttgtcacgatttcccccttggcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgcttaatttctacagttgttttactgctttcaactactgttttgaaatgcctgctttatgcaaaagaacccctagcttcctttggttatatcctgcatcatacctcctcttccggtatgacttgctgagtacagtgggtagtactcagtcttgctctcttttcccccacaccagagatgaagttcttctcagttggagtcgtctcagagaggttggtttcgttgctgccgtcaaggtttgcttgtggagtggagtcgcccgctgctgaagtcaagcttcccggtttagctcgctttaatctttcccgctacatttgtaatcttttatatttttgtaagatgtgggtctgtatgtcaacaattgtcgtttgtgtatcctggctggtcctggacagggatttaatgcacattcagcttagaaattctggttcgagaatttctgggtgtgacaggttgcctcgccctgaggccctcgcccggccgccacgtggtgggggagtgagtgaggtggtggtcgaagctggaccgccatcaatgcgcggtgccccaaccgcccctcgccac

SEQ ID NO: 54 - DNA, 1501 bp, Oryza sativa
gatagggaattttcttatggtttatttagacatggcaactatatttttgtagataaataaacccccattacgagataaggaatctcttatggtttatttagacatggcaactatattttgttacaagataaataaattattttatggtaaagggattgctatctattacatctatctgtgacctccccatgtagtcctccatttctaaatacgaagttccgcagcaacgcgcggggcatcatctagtataaactgttttgatgccaacaagaaaaaaattgttgcacctccagggatagtgaaataagggaggtgaagagagaatttggttgatagttactattgtatctaaagagtaaaatagaatcactataaatagacaatgcatgtataagcatcaatagaaaggtaaaaacaactggaagaaaatctcacatacgttgtttggcatgttgggaagtaaacaaaagatattcattatggtgtatgattttttttctggtaaggaaacatgaatttattgatcaccaaagagttcatagtgtaatactgcttatgttcttaatatgtgaagatgacatttacagatttgtcatgaaaattactttcacagccatttttttaatagaaaaactaatgatggaacgtatctattggagagtatgtcaatttttaaaatgtcaagtaaagaggtagtatatgtgtatgtgttgtgtaaacactaccagatgaacaaattctctcgtgtatacatggttttgtttgtatttgataaaacactgacatgttttgtgataaaaacacaggttacgacgaatttatttaagtggtcaaagcccctttaaccatttattttacttggagtgaaatgaataaaaatatagtagaataagttaatcaactataataaaagaaatatagtagaatataagtggtcaaagcccttttcaccatttctttaactaggagtgaaacggaaatgttaaatgctatataggatactgtggtatgtggtgtagttctctggcttgaacatatgaaatttgatgttttgctttcaaacagcttgacgagtgtattggtgacattcttaacaggttcaaacacttcatttttttttactttgaagtaccatgtgttgacgtggaaaacaacacgaaggactgggatgtctgcttagctccaatgcaggtcctaaatcttgatgggatgcgagcgtgccagttagtttaatcctgcaactgacaagatatgtagacaatagatcaaaaagtcgatcggctaacaagccgatagagtaattccagccgatgccgatactagctgatgtcgatagggttttgaataatcggctatatgttcaatgcagagtctgatacttgagtaaatatcgatatatagacaatcggctgatgataataaaataacaatataatccaatgtaaatcaatcggctgacaataatatcatagaatatgtgatccgatggttaaatcataca

SEQ ID NO: 55 - DNA, 1501 bp, Oryza sativa
tgatgaaaagtatattagtaatactaatcataaaacaaactaaataatactccacgctttgatgcagaatatatggatgaatatatgttaagtattataaaagtgatgatagattcgttaaaatattatgaacatgatatgagaggtgatgattagatatgtttgcatgttaatttgtagaattcaataaattaagatgatattgcattcttgcatgagttttttgataaataattattactagtggatgataaattgatgatgtggtatatttacatattgagctttaaatttagtggcttgtaatttttataaaaggtatagataaatatggaagtttatgcactagtgaagacagattgtgccagcgaatgcaggttttcgatcataaaggtcctccaagaaaaaggtttttataaactcgattacctaaagattataattaagcttactcagcatatcaaaaggaagtacaatacgtgcttccaagaacactactacataaacgatttttctgtataagaatcctatagtttgcagagggaccgtatctggtcccatttaagaaaattgacttgcatttttgcagattttttttaagaattaatattattttaatggaaaatcgcaaaagtagaggccatccagggaaatcgcgaatttagaggcctgtcgaactggtgtagttcgataggcccctatcgaacggtgagcgttcgactggaccctgtcgatgtgcctatcgaacagagggagttcgacagggcccaccacccggcgccgcgcggcctgtcgaacagggagcgttcgataggtccctccaccgcccctatcgaacaatgggctttcgacaggcccttttaaaccgcgtgcgcctaggccgcgttgcttcttcgtttttctctagaccacatcgccagccgccgccgagagtcgccactgtgtcgctgtcggcgccggagggagtaaggggaggggctagcaggccggagaggaggcgccggccgggaggaaagggttggcgacggcctccaccagtgaagttaaggtatacattactaatccctaagtacgaggcatatgaaagtttaataaaaaatggcttgtgatttgttaattgtttcgcattgttcaatgttagtacatatgatttgttagcatttgtcattgctaaatattagtagagatatttaagtaatcgtatggttaaattagttgttagttaatacatgttattaatttgttgtgtgctaaaataggtagaaggtactatattttatttggattattaaagtagttgtttgtcaataatagttgtaagttagtacatggcaatgtagtataaattgtaatagggtaattatcgaaggcttaaatgattaaacgttagacaatttgtcatgttttatcaggatgtcaggtgaaatgcccattcgtctgtattacggtgatgctcctatacaaatatgtgatagcggggtggatttgactgtatatgact

SEQ ID NO: 56 - DNA, 1501 bp, Oryza sativa
cgcgtcgtcgccggacttgatcacgttgtccatgaagaacacgtacgccgtcacctcgttggcgccggcgccgtgcagctgctcgaatgccatcaggctgaacagcttgtgctccgtcgtgtcgtccacggcgaggcgcgggatgcggagcgcgccgtggcggaagctgatgtcgtggaggctgcgcgtccggctgggacggaaccggacgcccgcctggtcgagctccgtcgccgacggcacgaactcctctcgcctccccgtatggcacggccttggcggcgagccatggagcaggctccggtggcagacgtcgagcgggtggagcgccaggccgccgccgcctctcatcgccggcgggtcagggatcatcgacacgaagctgagcaccatgttgttgatcgcgtcgtcgctctgcaaccaaacgccggcgagttaatcagcaactaatcgaacactcgagttgatcagagcagcagcataccacgacgcacgcaccgcttcaggggcggcgccgccgtggacgaaggcgacgatccgctggagcacgaggagcggcagctggttctcgatcatgagcatgtcgcggcggacgtacgggaacacgtacagctcgccgtggcggctgaacacggggtcgttcgccgcgtagcctccgcccacgccctcgccgtcaccgtcgccctgcgccgcctcggccgccgcgcgcatcacctcgagcaggaagcacccatccaagaccatcatcttcaagaacccgtcgcggtcgtccctccacttggtggcgcccagcccctggtacgcgtcctgcagctccaccaccacctcctccatcgacgccacgaggctacccagccgcagccgccgcccatcgccgccgccgccgccgcggcggagcaggtgcaggagcgccctctccttgtgctcctcggccggccggagctcggggacgccgtggtggaaggggccgagcgacaccagctgcggtgcgccgtaggaggtgcgatgcttgatgtacgccggcacgcggtacaccgactgcctccgccaccgcctcgcctcctcctccgatgggttgccgccggcgtcgagcaggtgctcgacgtgggacacccattggctcgtcgtcttcaccctctgctgctcctcgccttccatttggtgagatttcttgatgttgcttgtcgcgtcaaaggttgggggaaattttgagtaataatatactactactctaaatcccccgcaaaaaaaaaaatatactactctaaatcgagattacagagcaaacaatattttttaggcaccgtccagccattgctactgccataacgtggtctactttgtcactcgaacaacaaaaaattcatttactttcggcaatgttcgacaagtcaaaatttaaaaggggcttaatgacttgttaatacatacggtcattgtgtatgtgagaaagtacaacattacatcgctgtcctcgtatctacagggaagtggccatttg

SEQ ID NO: 57 - DNA, 1501 bp, Oryza sativa
gcagatggtttgtgacttctgtgactgcccctgaagacctgcaggacattttctgcggttggaattctgaaccatgtgctacagtgctttcagccaactagattaaccagagaaggcgaaagcaaaccatacttctccagcgtcatagtttgattcagaccagctacaagacaaattagttggtaatacaaaattttggcataaaaaactttcagccccagaataatatatatcaaggggctattcccgaccatgatatctgtatagtatagaaaacgttgatactaaggttgtatgagattgaggtaaagtaggtgggagaatggatttttatactggtttggacctcaggatagataataactctagttcactttatatatagctctaggttgtatcactttattataatagggaagcaaactagctaccaactactccctccatcccataatataaggtgtgcacgtatttcaagattcaacctttaaaacatttgaccaacacttagtataatatgaaatgaattttatttgttaaaaactatatcattagattgtgatttaaatttacttttatatggttataattttgttgataaaaattttatagtatataagaaattataaactaaatattagttttggagaccgtgctaactttgatcacactttatatatgggatagagggagtagtattcgccgtgaactaatccgactacttgaagtcgacggctagctattgtcttcctattggttgattttgcaatgtggcttgtggctatggcttttgatttttcgatgccctcccctcctagagaggcgttgtatttatataagtagacaacttcttatccaagtagaattcaaagagccctcgtaggatacgggcatataagactttgccttcctcatgttagaatccaatatcttctattcccgtggaaggagttcttgttcttatatacctttctgcataatgttaggtatgcaatacttttggtggtcacgaatctaagtataggaggtatatctaattcgtatcactggtagtagcccttgaaaacgaactcgagaaaacgagtaggtaaatagtccttgaacaagtcatctttcccagcactaggctagaaaattactgaattttgaatttggagtgaagtcagaacaccaccaccacagaaggacaaccactaaacttctgccaaatatttcttggcctttgttggaggataaactcctcgagcaggggatccctccttcttcagttcggccgggggcagtgaatgtagattgaggaactgggcgtattagaaagaaacaaggggggtcggggctgcgacctagcgggcgagacaggaaagattatacaggatcgggccgctaagaagcgtaataccctactcatgtgtatgatgatttttctgagctttgaaagtctctgaatctctggtgtacagactagagtcaagtgttcctattctcctctctcctccccctc

SEQ ID NO: 58 - DNA, 1501 bp, Oryza sativa
gctgagctggaattttcggacatgtccgaaaatctcaattattgtgcataacgggcagaatctgggctgtggctataaatagccccctcccctcacttgtgagggctgctggttccattccaatcatttgtgcccttggcttgctctctctctagcacttttgtgccttgctttcttgtttcccctctcacccgtgttcgatttggatttggtgtgtgtgtgagagttgtggatttgagtttgtgtgagtgcttgttgttgacttcatgaagatttgtgagcacttgcatcatctccgggagttctttgcttcatttgttactcttggaggttgagaactcctaggcggctaggtgtcgctcccgagccaccgatctacttgtggttggccgggagaagtttgtgaaggtcagatctcacctctgaatgggaagagatacctttagtggaaggaggagtacatttgtgcaacctcacaaggatagggttggaaaagacctggctcattatgagctcctcaacggagagtagaatcccctcaagtatttgaacttcgggagcatatcgtcttacaagaatcctggtgatatatctcgcgcactcatctatcttagctaattgatgatgctgctagtagtttacttgttgtttgtgcaatcatttccttacttgtaccactacacttttttgcttgctttactagcttgctcgtaaatctgagattttcagaatatccaaaaataatatggaaatatccgaaaatagtttggaatatccaaaaagtctagcttcctcatttacgtaaaagctttaaacgcctattcaccactcttaggtgacatcaaggttctttcaacctacaatgctatatcgatattacatatggttatggactttgggtgatcatttctccatgaatcatcgttgagatctaagtatttgtagcacataacgagcatgatcaattccaaactttcccaactagtgaattgccataaaagaactaactagaggctagattgttacgaacaacaattcatggctccagcaatgactaccaaatgagaataaaaagttaatatggttcactaaaagaacatatggccatatacaacacatatactaaatgtaatatccataggcggaacaattatcccttacaacttgatatggattagagttagaggtctatgataaccatgtatcaaaatgacaaaagaggttgtaaacaactatcatgatgatagttttcacccatctcatatcctttaaaatttgaagcatgctactaaatattccaactatgttggaagtgctagttctgggctatgactctgattgcttatctatccatacccctttgggacatattgcgattgtgtagattacgggttatagaaaactttgtgtagttgtttaaaaaatatgttggttggcaaatcttggttgtttggctaccccggtttttggtaatgccatttatctaagctaagtgtgtaaa

SEQ ID NO: 59 - DNA, 1501 bp, Oryza sativa
atttcttcctgtcaatatccaagtttcagcttgtatggcaacgatcaggaagggcatgaaaaataactatggaagttgacaaagagaattaatatcagaatttaatttttagtcccatggtttgtttgccaagagaatgaaaggggattggaagttttagaggagtgagttatgggagtttcatttttttattcccagtcttttatttggtagtagagatgagaatcatgggtagtatggatgataattgaattttaagtgatgatgtaaagctcagatttatctcgtcatacttagaaaagaaattccctagaaattacatgcccttacccaattgggagtttgctctttaaactccttctcaaatccctcacaagcttccacatccaccaaccaaacagtaggttgtacctctcaaagttccatccctgttaacaattccccctaaccaaacatgctgtcaattccttatttagttgctagagagaaataataggggatgtttaaaagggaatttatgttatttgttcggttgtgggttttgagataagaaattattatcataatttatgatgaacggttgggatggaatcgatgggagttcgatcaatttcccatttcaatctctctcaaattcccatgttcttcaaagattaaaatgctctaatctcctatgcttccattagcattctcaaactcccccaaaccaaatgtaaccaaaataacacgcgaaaaggattttcaccacctgtctggaaaggggaacatatcttcccgtgcacaccaattagaaagtatcacgaaaaattctacaaaatatatattttttacacatatttcatattcaaattcattatattttagccgtatcaacaaaattctaatagttttaagggtaaaattctatcagaattttgtcgtttttgctacggctaaaatataataaatttgaagataagatttcacatgtaggtgtaatactattgaaagtatgcgtccaatttattttagaattttatttgatagttcgcatacatgggaagcctatgtgtccataggatatggaccgttgagacggatacgtaaccacacgagggaaacgtactcgtggaatacgccgtcaaccgaaccaagcctctctgtccttccccttcccctcgactctttctctctcgctgcttcatcccccgcttcttccctccatctccccgtttcaaaccctagggcacgtcctccacccccgaaaccctaaccctagctccccaatccgcccgttccggccaccccaccgccccggaatcccctctccgccatctccgccgcctcctccgctcccgcccgctccccgcgccgcccgcggccgtgccctcgaccacccctcaccccctcgcccacggggttcggcgtagtgcggggggctcgtcccgcgcgggcgctctcccgtgccccccgcgggaagggaaggctctccattgaggcctcgctgatgaagttgcggcca

SEQ ID NO: 60 - DNA, 1501 bp, Oryza sativa
cctatatatctgtacctgcttaccaagtttatcatcagcataatctaatctttctttgtatgcagctagtatacgctttagatcaccgcaactacggcccacaagaccattcaattccaaccgggataagtctatttttcctccctcaactcatggccgtgtatgaatagcatccctcaaccgcaaaatcgggtataacccatcccccaactctgaaaaccattgcaaatcaactccccgggcggttttggaggtggttttgtcctacgtggcacctttgaccctattgacttactgagtcagcagggggccatatgtcagtgacaaggataaaagaaaaaggtggggcccactgtcaaccacacttatcttcttctctacgcccttctctcgctcctccggccgatcccggcggtgatgtgccaccccaccccgccgccagtcgtcgaggctgcgccccgctcttgctcggccgcccttcagcgccacgctccgctccgcctcctcctccccacccccatcccaccctatcgcctccaccgctgccgccatccccctcctcagatccagagcggaggagggcgaacgagatgagggagctggccggcaacccttggacgtggagtggcttctcactgcaggtggaccagcgcagcccgtcttcgccgctgcgtccatgtgcatgacggcctcccccctaggcttcgccgcctacactagtgcgtgccatatgggtttgcaaatatttgcaaatcgattggggattctctggtgacggtgttttgcgtgctttggcagagtgatttagtgctgatcataagcatcatagtatcatacacgcttgaaaaatcatgatacagtcgaccaaattgctgatcgatagcttagtaaatttggtcagcatggtatgccacccggcaattttctgattgatactattgttggggtacctggctatctgcagctttgttgatggataaccattgatcttgcattgttttatatccgactgcttgcttcctggagccgtttgtagatgtaactggagatggaattttgcagcaattggtcttgccactgccgtctcacgtgctgccccagccaagtctcccccgaggccggccgcacgaatcacgctatgccgcgggccgccgccggcaatccatgtgcactgatgtgcagacataggtgcaggaggaggaggggaaagagcggcggggagaagttgtcgtacatgacggtggtacgggcggcgctgctcctcctcgtggcactcagcgcactctcgctgctcgccgcggggtctcggaacgaccgccatgccggcctcggtctcgccacgcttctgcccatccacagctgtccccggcaagcctcccccagcaacatcgtcgcggtggctaggcactgtgatggcggcgagctcctagccgtcaggatcggccggaggagcgagaaaagggtagaagaagaagtgtggttgacagtgggcccaccgttt

SEQ ID NO: 61 - DNA, 1501 bp, Oryza sativa
tcgtgaggcatctctgcaagaagaagaaagaagaacggcaatggcttctaactcaggtaagtagatcaattatttttccgcataagcaagaggtgattgtttatagactaaagcttaagatcatgtaattagaactccaacattgtggtatcagagcctaatttttagtccactcaatccctcataatcacatcatccctgtgattagaagccatccttataaaaatacaagattgattcggcatgagcaattttgaattagattggattaatttctttaagtattaagcccttttatactggtggtttcggccatcagtaggagaagcaaattattgaagaagctgtttaattcaagttttcgattttgattatccatcagtggagattaagagaagaaaagggattgggataaacatattgaaactcccaatttcctcgcactcagaaccctaagccgaagctaagaaggggataaactagattgaaattcccctaaatttagcaaagggaaattcccaattcccgcactcaaaattcctagaccgaaactaaggtttcggctagtactcagcaaacaagaattaggggataaacaagattgaaactccccacggttaatcatatgggaataaacaagattgaaatttcccgaaatccccataagccggatccaatcggcctaaaatccccaaatgaagaaccctaattctttggggaagaaccctaagtcacaaagtccgaattaaatccaaatggaagaaaattaggctcgggtttggtgacataccggattttgaagccccctaaaccggaagcagcatcgccgccacttcacctccttgcggccgcgtcggtcttcccgtgcgcgcgccgtcttggagtgtccctccaccgtccctcgccagggacgggaagcgccggcttggcggctgccttcggactccgccccctcccctccccgccgacgagctccggccgcgtcgacgttcaccgtcgcctccgcgccgcctcgccggatgtaacatcccggcctagggcttaataggattaatagaatactcatatcaacaagttgcaacttcttttccggaagctttttccggaagccaatctccgaagaactccagggttaagcgtgcttggcctggagcaatttgggatgggtgaccgaccgggaaattctttccgggtgcacacgagtgaggacaaagtgtgcagaaaagatatgtgttgccctgtgagggcagtctatgacctatgaaagctatcagatgtaagcggtcccggcctgggggaaggcgggacaccttgtcacgcccagaaattcccgaatagaattccaagtcttacaaacatcataaaagtctttacataaatgcagcggaaagaaagaaagccaacaggagctaagccttgactagaactgcagcgggaaagaaagaaagacaacaggagctaagccttgactagaactgcagcgggaacaccactccacagg

SEQ ID NO: 62 - DNA, 1501 bp, Oryza sativa
ggcacgacgggcttgtggtagagctcgttaaggaggctgcagagctgggtgccctcgacatcggggcagctgcagtagacgatgaggtggcaccgctgaggcgttaagctggtaggcagcggcaaacggcgcagcgaggccgtcggcgaggaagacggcgaatggcgcagcgaggccatcgaacgccatcttgaggagctctaccttctccggtgggacatcggccgtcgactcggcgcactccggcaaggcagcaagccatcaacggccacactaaggccgtggacgtcaccgtgccaggcggcggcgcgcacaccggtggatgtcgtcccagctgcggctggatctagcgccagcgactaggcggagctcggcatccatcactccggcggcgaggcatcgccccgcgaatctgccgccgacgacccgcaggaagggagaccggcaaatctggccatcggtgaggcgcggcgccaccggcacactagctgcaaagacgctgtccgtggcggcggcggcaaattggagagacggtggatggagttgtagcaggagtaggatgcctacaagactaccaccaccacccgctgcctgatgctcgctcgcccacaatggtcatggcgacggtgcttcgcaagctcttctctgactccctccgttgcccgccaactgctgtcgtgttcgcccatcgccgccctcgcccaccattgttccatccgtcgcccgcctaccgatgctgcgctcacccgccgccggcgtcccaggcccgctactgcgctctcccgccgtccgctccccccgcagcccaccgccatgcttgcccaccgccgctccacccactgcccgccgacggtaccgtgctcgtctgccgccggcctcccaggcccgccggtgctcccgttggattggatgcggggaggagggaccgaaatgcaaatatgttaccactctggtccgccatgtaagccagtcaacccggtcagatgacctttggacctcaatgagtcacttaaacaagatcacagatcctaattttgatttttcaagatcatggacctaagtgacacctcgctccaactttaaggattggccgtgtattttactcatttagaaattatgtagaggtacattacagcatggaaggtttagttcatggttgaacagtataccatagccatatcaaattttacacttgacattctgggcctgtttagcaagcctgctacggcaactgcgccgcgtgcgtgcggcactgttggtgccggctgcgccacagccgcgaaccagcagctgaacatggccactaggtgataaaaagatgattattatgtgaaaaagagaagagggggtgggggtgggggagggttgttattggcctggggaggcctgggttcctccagatcccctggcttcgcctctgctgcattgggtacgaagagaacatcctgagacttttttttgacgggaaacagcaggagaggctcctactgcgctatattaa

SEQ ID NO: 63 - DNA, 1501 bp, Oryza sativa
ggattctccctagctgaggaggaatactgcgtgtatgactcaaatctctgagcataaaagtagcttgggacctggcttgggtcccaagcataccccaaatgcgtcttaagaatatagcctatggtctgcctcggacctggccctgtcctaggtcccagtctcaccttagtccttgtaggttctacggtcctcggcaaaaggggcgtagaaatctgcaagatttatatcttaagagaacaagctaaggtatgcttcgggcccggcctactcttgggccccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggtctcgtcaggcccaccacgcaccacgtggcgagcacactggtgagatcctaactgtctcagatggagcccggggtaatatgaatcgcaagactcaaagggtttcttgaagactgtgttagggaaccagccggcgacaataagacagctgataagacaagactaatagtagattggtaataatgtgagcccctccttggactataaaaggaaggggaccatatacagatgaaagggttggattcttttagatcagtactcttgctttgtagcctgaaaaggtctccattgtacttagctgatctagagaagacaacgaacaccaacatagagtagggtattacacctctgggtggcctgaacctgtataaactcctgtctccctctctgtgcagggtagtcgggccccgtgaacccttcctgattgcagatagtccgtgcctctcaccgcaaaccccctggttggatctttactctcggggaggggtctccactccccgctgtctgagggactaccccctcgacacctgcgctggtagaaaccctacatattccgacaaactgataatatttcttaggatgttgtaaaaaaatgttcttaatggtgagaaggtacgtgcttgttctcttgttacctaatgcacctatgctgatagaggcatggaagttggtcgctcgactggcctttcatgatatggagatcaattaaactggataccattatatctttcgagaatacaaactgga

SEQ ID NO: 64 - DNA, 1501 bp, Oryza sativa
atgataatgtttttttatgttgatatacgatatattacctttgggaagccttaaaatttgatattttttactatattttctaattgttatgatcacttgtcaagttgctcccctcatgcttagatgctggcttccccagtgaatgcaccactgatgatagaggcatggaggttgatggcttgactggcctttcatgatatggagatcaattaaactggataccattatatcattaaagaatacaaaatggagaggaaaagtacaagggaaactaaagccgttttactaaggacaaaggtcactagatactaggtcgtggaatagggtcaagggaagcatggaccttacctgtgaaaatcatatctgtaacacattgtgtttgtatttcttttggggaaaatgaggatgataacatgaagtggaagaggtagcagaggacaaaaatgtggatgattattgtaatctgatgagcgccttggaaacttatacctgacatttttgaagtaaattttaggaaagcttgactggtacggttgaagttgcacaaatcacacgtgttatgttacaccagatattgtggtagaggcttacagcctagagtatcacgaaatcatacattaaccaatctaacgtgctaatactacataataaaaataaatacttaacttaggagtactccctccgtcccaaaataaggcaacctgtgaccactcctaatacaacgaatctagacaacccttcgtccagattcattgtagattagatgaccaaagaagatgcgaccataagttctcaactcatcttcttcattttccacatgcacgctttttaaattactaaacggtatatgttttgcaaaaggtttatatagaaaagttactttaaaaaatcatattaatctaatttttattttttatagttaatacttaattaatcatgtgttaatctattggtccattttgcatgcggaggggaggggttcccgacggaaccagatcgtctgacatagagcgatctacgccagagggacatacaacgcacgcccgccgttcatttgctatctaaaggtgccaagcgagcagagagtacagagtgaagcgagacagcctcactttcggcccactccaataaaatcagcctgctaaaccggaggaatcggcgacgccgctaatgcttctgcatctcacagccgcagccccaccgcctgttagttgattagttgagtctgtttctatctccatgcatgtgataatgatcagtttagttgtgataagataggattagatattatctcttcctttatatttgttatcacatgctggtttctctcccgagttggcgcggttgttgccgatctcgtggacttctttaatcgccacggtgagggctattctcaccatatattaacgcgtaagcaacgcactgatcgaaacatgcgattgtttcctgccaaaatcctcacatggtatcagagcctgatccaatctaatctagcgatgtt

SEQ ID NO: 65 - DNA, 1501 bp, Oryza sativa
ttttaaagagcgtcacgttctgaatgatgtgcttccacatcataatctattcccaaactttctattgcagctcaagatatcttgtcccaatatactaaatgatgatccaatgccaattctggagagacttccacgtcttgaagtgcttgaaattgttaactcatcatacacaggaaagagaataacatgttcttccgagggattccttgcattacgcagtttggtacttatggatattggtttggaggagtggaatttgcagcagggatccatggcgtttctcgctgttttgactctcaagtgtaccatgctgaggagcatctcaaatgtacttcaccagctggatgatttggtagagcttcgcttgatttgcatgcctcagctctctgttgatgatcatgagccagctagggggaggggatgccgtgtcatgatttcagttgacgaggaacaaacttctgatacttgaatttgtaagtgaccccatgcttgaactaacttcattgccatgcctctctagtttcagctacaagaaagcttatattctttccccattttggataaattgcaattttgttattcctgaggatgcatagcaactgacaacatatctgatctatcttcttatatgttaaaccagagggtttcccagcaaaataatctacgacgtcatcttaaacacaaagacttcccgatctttcattctggccatataggctgtttgatcattcatatacgcaaaatatattcagcggccttcatagaacttccatcacttgcatttgcaaccaggtctatctctttctctcctgatgtactatctcccactccttcctttccacacttgggatgccgcctcctgttccccacaaagcatcataccattcccaccccttttggtgaggtccaagatatcgaggcagaactgcagcagaatttccatccacaatcaccttctaaccagacaggacgagttttatttcttcctcaagtaagcagaggaattccattttctgtaagtttgtgataggttgtttttttcttgaccagagaccaaagaggctagctttttgtagaaagcagtatagtgtacataataggatgtgtttaactcaattgtatatagtgttttagttctgtatcgaaagagttcttatgcatagaagatgccccttaaaaaatacatgcaagatatgccatcctgacccacatgtcattgactcatgtgggtcctacatatcattgagataccgatggcatatctcaaactttacaaaattataatggcatggttccaaattacccatactagggaaaattggaactatgctatatcggggtggggctttctatcaaaaaagcaatttctcaacagtcaggtttgtgtgatccaaattatgggtatttttaaagtttctaaatgtaaaaggagcagtttatggattatggttagcaatattatggattatgcttctgccatttgttaagaatattgaagacg

SEQ ID NO: 66 - DNA, 1501 bp, Oryza sativa
aggaggtgtgccacgtaaggatttttctacagtatatgtacagcgcgcggggtggtatttttgcaaaaaagccctccgttttttcgtaattcgtccggcgtccctcgctaacagtccctctgagctggcattttacgtttagccccttctaaaatccggatattctatgagaaggagaggaaaaccgcgaattaggcctgcgctctaaaatgtgtaagctgaggggttttttcgcaaaacggcacccactacccaaagccctagcagccgccgccgcctccgcctccgctttcccctcgcgccaccacctccgcttcgcgccgtcgccatcgtcgtctgcatcgcctcgcgcctccgccgccgccgccttcgcctctgccacctccgccttcgcctccgtcttcccctagcgccgccgcctccacctccgccgccgtcgacgtcgccgtcgccgtctttgagcgcctccacctccttctcccccctcgcgtcaccgtcgtcgcggagtgcggacttcgaggcggacgcggagaaagcgacgaggagaacgctcctctcctcttccactctcgtctctcctttgcctgcgaggagctgtgcctcgccgccatcgtcatcgttgtcaacctgccgccgtcgtcgtcaactggccggcctagccgctcgccgccatcgcagtggccagatctgatggcacgaactcaaggccgcctgatctgatggcggtgagctcgtggctgtcgatggttaggtggttggagcaaccattgtcctgccaccagccggaatcaccctttccgccgccatccgcaccttgtcgctgtgttggacacttggacgaggggctccgcctcttcacacgccgtcagccgctgcgtacattaactccttcaagtaatcatattgttgttattcgtggatggggtgggctctttctcactgttatattgtctaatatcatctttctcttttttcattttttgtccattgtgagttcagacaaaaaaaattcaaacaaggccttaatttttatgataaattttcattagattaattaggactttcaaaaggatataaatcaacctatagtattggaattgcgtaaggctttctttacagtcgtgtgatttgtcacgtttgttgcttgctgtggtcatacaaagatatccgtcttgtgttctggtagatgtattgacatcaatattgttatgttatcaattcagcttctcagagccccttaaatggaagcaaggatgtaatttttttttttaggaaccaacggcaggagaatctcctgccggaatttatagaagaacagaattggcccagttaataagggaaatcgggcccgaaaaccaaacaagcacggttaattaaacgggaaaccggcaaaaaccaatacagaaaagaaaagaaaaacaaggatgtaaatggaaaaggtttcaggcccaatgggagtgaatcatcgagtagacagccaaaggacaaaggattctcatga

SEQ ID NO: 67 - DNA, 1501 bp, Oryza sativa
gttgttgattgcctctatagactttttggccatttgcagcaagtcataaagtatgtcagaatggctgagagtgctgagtttagttaccattatcaatatatctccttctgaaaatagactcggtatccaacccaactaatctctaatcgatcaatccttgaaatgattggcatcaacatcatgtgtgttatcttggttgttgatggtggtaatcccaggtagttgcagggtaaagagctgagaagacattgtagaacttgagatataccaaggaagctagcctcttcctaggtcatataaattggaacaactgtactcttgtggtaatttacttttaatcccgagaagctggtgaaagactcaagtatctgttgtagaattaatcatggcttgctttgcatctctatcagtgtgttatcggcatattgtagagtgggtggagctccttctattcgtagtgggtggggaagtacgtcttctattctcataaggttattgaatcattttttttttaaaaaaacaactgccataagaatgaaaagtatagatggtgataacgagttaccttgacgactgaatgtgttgacccgttgtccccattcattaaaattattgtctttccagtacatatacatacaggcgctttcatgcattcacatccgtatgcgtatccatatccgtcggatttctaaagactcataccataacgtcgtttcgaatggattcgaagcggatattatctgatccgttttcacagttagattcagtagttgttcaagaacaattaggattagtcatccgaatcaaaaccaaatgttagaaattgttagtatcattattttcatctgttagtaatgtggttttctctagtctagtagtgtgtggagcatttaatggctttattttttaattttcatatgtatttacatacatgtaatgcagttttaacggctgccctgctagctagatctatatatagatatgtatgtgactgtgtatctatggatggaaaaaaatatgaacgaattaaccttctaaatttaagtcctgccatgacttgataaaggcaagtagtaattattaaatcaatagtagctagccaaatatacaaatgaattaactgatcacaggcaaagatagaataaagatatatttagcaacgatattgaatgaaatataatattaaccaccaaaatatacatatgataatatctcactgattcatttctacatcgctgcttgtttgggcacaactaataaagaggaaactcatcttaaagagaaagagaagggagaaaggcaaaaaacggaaagaaacgggatcaggccagaggagcaagaatcacacactagatgccgacgcatggcaaccatttgaaaccatcgatcaaacctgttcctccttattttggctaggccagagggttccatgcgaggcgggtagtgagaacacgtctgtttgctcaacgtactactccttgcaaccgctcgccggcgacca

SEQ ID NO: 68 - DNA, 1501 bp, Oryza sativa
gcagcagtcctgcgacttcattgagcagcaaagggggaaggtacctggaatcctacagccggatcgggaagagccgcagccgcgagaggggttggcgagtcgcgagcgccgccgcggccatacgccgggaggagtgggctgccgctgccgccgtgcagtgcagggaagctcgggcgaaccatcgaggggatttttttttttttagaactcctttcgaggggattgaccgattgaaatgggatgttaggaagaacagagtttttctccttttttttattaagaccaatttgaccgaaattttcacctggatgtgactgactaccaggcccactgatatatgcaaagataaaaattctctgattaactttatattctaattatccctcgatggctcgaaggctatttaaaatatatgattggaacaaatgtagaaatttggcaaatcatatgagaggaacaaatgtagaattttgacataaatgtgacaaaatttagggttaggaatttgatgagagataaaggcttgtatgagttttttttaatcaggttgaacgtcatatttggttcccttcaaaactcatatggattaaggtattcctttgtattccacctttattaaaaaaaacatttaaaaaagaaatctggtaggactaaaatctaaaaattctgaccccaaagtatgaaacaggtgatgattttgtaggtggttttggtcacttggactacagtgagaataataacacgacaatgaatttggcttgtcctttggttggaggaattgtgtcctattatagggaaaaaaatatagtcatttaaaacaaaagattgattcttacaaattccattgtctataggttttttggaagagaataaacatgaggttactacgtttttccttgtatatcattcatatgataatttataacttacctattttttaagttcttaatagaaatctattaacttattaaaggaatagaaaaatgagcctccacgttcgttctcacggcttagaaattcccacattaatcggagaaaaagaaaaacatagtccatatagaaatacaatttaaaaatagtggaaattcggaagtaaaaaaataagaaatattggaagaggagactagagtccatatagaaatacaatttagaaatagttgaaattcggaattaaaaataagcaatattggaagaggagactggagtccatatagaaatacaatttataaataactgaaattcggaattaaaaaataaagaatattaaaagaagatcatagagtccatatagaaatacaattaataaataatagaaattcagaattaaaaataaggaatattagaagtagagtatagagtccatataaaaatacaattaagaaataatagaaatttggattaaaaataaggaatattaaaagtagagtatagagtccatataggaatttaaaactaactaaaatttgaattaaacataataaaattaaaagtagagtttaga

SEQ ID NO: 69 - DNA, 1501 bp, Oryza sativa
gataagaaatccacatcaggttatatattcacccttgcaaagggagctgtatcgtggaaaagctccaaacaaagagttactgcatcgtcgacaatgcaggctgagtatgtggcatgttatgaagctactggacaggcaatatggctgaaaaactttatcccgggattaagagtggtcgacagcatatcaaaaccactcaaattatactgcgataacaaaccagcagtatactatacgagtagcaacaaatcaagtgcttctgccaagtacattgatatcaagtaccatgttgtgaaagaaatgatccaggatcagacaataagcgttgagtatatgaacactaagttgatgttagcggatccacttacaaaaggcctaccacccattgtatttaaagaacatgttgccggcatgggtttggtagaaaagcctttgatcctggaataaataggaacctatatggcactgactccccataaaactaaggcggactcattttgaaattaaataggaaccatagtcacttggttcagtggtgcttaattgactactgtaatctagtgtcttgatgtactgttttattgaaaagtgagtccataagtttgtataagcctaatgtaataagttcaaagagctcgtaagattaaagaagtttgttttaaagtataatagtatgctatagtcactggattctgtgatgttttatattggtcactgtaatcttttgtcttggtatactattttattgagaaataaacttataagtttagcctcacgatcaagggggagaatgttagtgtgaacacaaatgtgatctatcggctaaaccaaagtcggcaagaaagatttttttagggcaatcgctacagtgatcgccccttcaagaacatccccgatcggggggattaccgccttaaccctagtgccggttccccctatgtgcagtggctataaatagagatcaatacctaagagttaaaccctaagaaaaatttctctagctacccgatcaagcaagccactgaaacacagggaagaaccgagacacaatcctctctgtgcttccaaacgagaggaaaagaaagaagaacaaacaacagagaaatgggaactccgggagatcaaggtatgattcaatcccattccaatttgtagttccattttgtgccaaaccgatccaaagaatatccaacacgcaccagatccagccgcgactcctgcacctaccggcctctactgctcctgctcttgtcaagatgccagaagtcgagcgccgccgccgcgaacgccacgacgcggagctcgccgtcgtcggatctcatgacgcacatgttcccgcggtagcgcgtccacatggcgcgcggcagtttgatgttggagaactgcttggtgcgggcgtcgagcgccaggaggtatgggttgtcgtcgtcgtcgtcgtcgtcgtcgttgatcagccagtagacgctcccgttggtgtgcatgtcgtcgctgaatgcgccga

SEQ ID NO: 70 - DNA, 1501 bp, Oryza sativa
atattgcacaagtccattatggcccaattaaaacccaatagaaagcccacctccatctccacccacatctgagccgccccgattccaatccaaacccaacctgcttgctctcaccgccatggccgccaccggcgattccgccgccgccgccggcgaggtccggcgcctcctcgcccacctcgactcccaccagcagctcctcgcctcctgccacgacgcctggtcgcgcgcgctcgcccacttcgcctcgctcgacgaggacctcgccgcccgctccgcgtcgctcgacgacgccctagccgccgcgggcgcctccacctccgagtccctcgcggcgctcgaggcccgcgaggccgccgtcccggcgcgcctcgccgaggccgaggcggcgctgtccgcggccgtcgcggaggccgggtccgcggagcccccgcccgccgacgtccgcggcgcgctccggtggatgtgcggccgcatggacgcccccgcgctgtggcgcttcatggcggcgcggcggcgggagctcgccgccgtccggaaggaggtcggccccgccgtcgccgcgtcggtcgacccgccccgcctcgtgctcgacgccctcgccgacttcttggccgcggaggatggtgcaggtgaggaccagttctgggtgctcggcatactgctgcgctcgttgtttgattccgatggccggaagccgccggagataggagatacgctggttgagagggcggccggagttgccaagaattggtcagagaaatttgggatcaagatggaattgtatgcaccggataacaatgaggtggagatgacagaagcgcctttggtggagaacgcaacagcgacagagaagaaagaagagcatgtagatgaggaagaagaggaggaagaggaggacccagaggaaatggtgcccgcgtcggaggaagaggcagatgcagaggaggtagagaaggaagaagaggacccagaggaagtagagaaggaaggaggagaggcggaagccaaggtggccaatgcggcgaagacaggggaagtagagaagaggaaagtcgaggaagataagaaggcgtcgggaagagaggtgaaggagggagagaagggtggacaggcagaggtgcagatattcctgcagatggttgctgcatttggactaaaagataggtatgatgtagatttcttgaggcggctattagttgataatggacggaggagggaacttgccagaatcgcttgcgtccttggtttcgaggatagcctcagaggtaatggtgtgttgcttttatctgttgctttcgctttcattgaactgatttaagaacatatcctaggtttgttgaatcgagatcatagggcaggttatgaactatatcaataagaattaaaagtactactgcatatgaggattataataatcttgagtcaatacctagattgagaaatatttgggctgttacttcaaatcggcaacttaagcatcaatttctttctatttaga

SEQ ID NO: 71 - DNA, 1501 bp, Oryza sativa
gtggctaacaatttgatcacctcaccttagacaagatgtgggaacttttgttggcaagtaatggtaaagtgtggctgggaaccaaacagcccctcagtgtctcgagtctcgaagagtaccgacgactgacgaggaaaaggagcggagagccggagacgcagttaattcagtctcgagatacacggcgtcgtttcaccttcccacgaatagttgggctctagttgggctaacgtgagctttgatggattgtttctttagttgggctttagtaagttatctggacaggccggggtccaatccaatttttttttgggtgtcccatgctgtatatacctatatactataacttgacacaaaaaattacccggtgtccggtgacacctgttaggcctacataggcccgcctcatggagctcggcctcctcctggcgcctggcccgggggctttgacctctatggctgggcgtacagtgagggactccatcggcaccacagtggggatactctttggcgggtgcgctccttggcgccatcaccgccgctgccggcactgaacgtgagcaggcagatcaccgggacgctaaccgacttgacgctgcgcgccatcatgggggagtgcggcttccggtggcgtgaggagttcctggagacactgggtgaggcgcagaagaaggcgactaggttcggcgtcgctgacctgttcccgttgtcgaggctcctccccgtcgtcaggagcccgagtggtgacggccggcgggagctgacacgggagctagctggagcggcgggcggcggaagtgggctggagctgacggaggctaggaataatccagcgcgctagtcagaggcagctgcagccgcagccgcctcgttggaggtctgtggcgtggggcggtttccaccgtcgccgccactcaagcccctcctgtcgccgcctccttttgttccgcctccacccgcgttagctccaacccgccgccgcttcagctcccgccggccgccagtacttcggcccccgccccgccgccgctccagccgtgctcccgcggacggtggaaggggagagaaagagagaagggagaaagggagggaggaagaagaaagagagaggatgacatgtcagtggactccactttttttaatgacaaatggatcccacaaatatgtttttaattaaatgtcacctaagcgccacatcaagaccagactagatcaacaccgtcacgtaagcaccacgtagcgaaaccaccgtccaaaatcgttaagggagtcaaattgcaccggtttcaatagtttggggagtcgttctatccggttttgcggttgagggttacggattagattcatgttacttttaagggagtcacagtggacttattccttcggttaatccctagcatggattttagcccagcccaccacgggatttccctgttctgtaggcccaggaaaaaatcacctactcgagaggagcggaaaaattcctcgagaggagcggcgg

SEQ ID NO: 72 - DNA, 1501 bp, Oryza sativa
atttttgttggattatctaaatgaacagcgctctattaaatttgggcctttgaatttgcatcctgcggccatagtataactgtctaagttgcagtcatagtaataactgcataagaattaagggtctgttcactttgatgccaaaattttgacaggatttcttatatagttaccaaaatttgacagcaaactaaatgtagccacttttttttgtaactttaccaaaatttggtaaggttgtaaatgatatcaaagtgaaccggctccaaatccgtatgtgttgtagccgctttaacatgttgccgaacacggctgctgcaactttatagagatattatccttactaaataaaatacaccatcgatgtccgaagaagaaaggaaaaatcatattgaacgatcaaaccattgtcgccgtatgttggtacacggtattaaacgtgccaaaaccatcttccccctccccacagacgtcaaacgtggcgaaccacttgacaccaacgtgtgcacgtctgacttcttgcactccctatacgtcttgacccccccaccccccaaacgcccaacggatccttctggaacccactcgcgccgtcaaaccaccaccgcctccgtctccttctccgttcccgtctccgtctcccccagagagctctcgtcgcgcgcgcgcacttttctcctctccgactgcggggcccaccagtcagaagagaactctcctggcgcctctctctcccccaaccccaccggatacctgatccgggccgtccgttcgatcgatccgacggcggagacgttgtcctgggctcccacggcaggaattggatggttctagaactcacccgagtcccgaccaccccacccccaccaccacagccgcctctcatatatcaagcggccgcccacgcgcccctcgcatctttcgcgaaggcgattcaggcgagaagagagagagagagcgcgaggccggcggttctagaagcttccagacccttcggcgcgagcgagctcacctcccccgtaggtacggcccacccttctcttcccaggtcgcgccgcgagttggatccgcgccaccgcccgcccgtggatctgatcgtgtttcggcgatttgttcgttgcgtttttgattttattttatttttttctggggtctcagcctggggggatggtttgcgctgctcgggtttcagccgcggagggatgatgtttttcgttgttattttttttttcgcggtagctgcgcgggattttgactcgctagggttttagatcggtcgtggtgcttagagtaatctcaaatccttgaattgttacaaatttttatttttgcagctctgcagatcgagatttatgtgattttagtgttgatgtttaggtggttataggtttggatcctgctgtgagtaactcgtagatcctgatcctgattgattgtatttatgtgcgcaggagctgttcattagatctgaataagggggattgaagcagtgaggagaaga

SEQ ID NO: 73 - DNA, 1501 bp, Oryza sativa
tagcacacaaaaagatatttcataactaatagattgagcagcggttcgtatactgcctgaaagggaatatttattatttgcgttatatcctgccataagaagaccaatagaaacaatacttgaaatggcaattcattacagagcaccaatgctaagacctttcgactcctaactaaagaggtagccactgaagtatcacaagaacaaatatctaaatagaaagaaattgatgcttaagttgccgatttgaagtaacagcccaaatatttctcaatctaggtattgactcaagattattataatcctcatatgcagtagtacttttaattcttattgatatagttcataacctgccctatgatctcgattcaacaaacctaggatatgttcttaaatcagttcaatgaaagcgaaagcaacagataaaagcaacacaccattacctctgaggctatcctcgaaaccaaggacgcaagcgattctggcaagttccctcctccgtccattatcaactaatagccgcctcaagaaatctacatcatacctatcttttagtccaaatgcagcaaccatctgcaggaatatctgcacctctgcctgtccacccttctctccctccttcacctctcttcccgacgccttcttatcttcctcgactttcctcttctctacttcccctgtcttcgccgcattggccaccttggcttccgcctctcctccttccttctctacttcctctgggtcctcttcttccttctctacctcctctgcatctgcctcttcctccgacgcgggcaccatttcctctgggtcctcctcttcctcctcttcttcctcatctacatgctcttctttcttctctgtcgctgttgcgttctccaccaaaggcgcttctgtcatctccacctcattgttatccggtgcatacaattccatcttgatcccaaatttctctgaccaattcttggcaactccggccgccctctcaaccagcgtatctcctatctccggcggcttccggccatcggaatcaaacaacgagcgcagcagtatgccgagcacccagaactggtcctcacctgcaccatcctccgcggccaagaagtcggcgagggcgtcgagcacgaggcggggcgggtcgaccgacgcggcgacggcggggccgacctccttccggacggcggcgagctcccgccgccgcgccgccatgaagcgccacagcgcgggggcgtccatgcggccgcacatccaccggagcgcgccgcggacgtcggcgggcgggggctccgcggacccggcctccgcgacggccgcggacagcgccgcctcggcctcggcgaggcgcgccgggacggcggcctcgcgggcctcgagcgccgcgagggactcggaggtggaggcgcccgcggcggctagggcgtcgtcgagcgacgcggagcgggcggcgaggtcctcgtcgagcgaggcgaagtgggcgagcgcgcgcgaccaggcgtcgtgg

SEQ ID NO: 74 - DNA, 1501 bp, Oryza sativa
tgagtggcggcgacggtggaaaccgccccacgccacagacctccaacgaggcggctgcggctgcagctgcctctgactagcgcgctggattattcctagcctccgtcagctccagcccacttccgccgcccgccgctccagctagctcccgtgtcagctcccgccggccgtcaccactcgggctcctgacgacggggaggagcctcgacaacgggaacaggtcagcgacgccgaacctagtcgccttcttctgcgcctcacccagtgtctccaggaactcctcacgccaccggaagccgcactcccccatgatggcgcgcagcgtcaagtcggttagcgtcccggtgatctgcctgctcacgttcagtgccggcagcggcggtgatggcgccaaggagcgcacccgccaaagagtatccccactgtggtgccgatggagtccctcactgtacgcccagccatagaggtcaaagcccccgggccaggcgccaggaggaggccgagctccatgaggcgggcctatgtaggcctaacaggtgtcaccggacaccgggtaattttttgtgtcaagttatagtatataggtatatacagcatgggacacccaaaaaaaaattggattggaccccggcctgtccagataacttactaaagcccaactaaagaaacaatccatcaaagctcacgttagcccaactagagcccaactattcgtgggaaggtgaaacgacgccgtgtatctcgagactgaattaactgcgtctccggctctccgctccttttcctcgtcagtcgtcggtactcttcgagactcgagacactgaggggctgtttggttcccagccacactttaccattacttgccaacaaaagttcccacatcttgtctaaggtgaggtgatcaaattgttagccacaacttactaagcctaagggaatcttgccacacttttttgagccattgacacgtgggacccaatttgttggaggagaatcttgccacaactgtggctacaaccaaacacctgtcaaatttgcctaaccttaggcgtggcaaactgtggcaaagtgtggcttgcaaccaaacacaccctgaatcgctgctcttgctcgatccttcttttcgctcaatcgctgctctactcagatcaagatcaagatcaagcaccgcgcccgcgcggccgacgacacgctgcgtgtaggccacggcgagcggcaacagcatgcattcgcgtacgctcgacttccagtcttccaccagttgcaacttgcaaggtttgttttctaccattagtccagaattcagattattggattaggacattagttcattcaatattctttagtgctgtcagagtaggagcatcaaaacattttaatttattcaatcattttttagttgtccacattctgtatcgctgcttactgattggtgcttgcactagaataactggttggcagtgagctaagtggttagctaactgattgacatgggaattta

SEQ ID NO: 75 - DNA, 1501 bp, Oryza sativa
ctcgccatctacccatctccgtcagtctccctaccggcggcagatcccctctccttccgggcggcgctccccttgttttctcccccgaccgacggccctactctcctggccggtgcaccgacaagcttgacggcttggaccgcgggagacggcgagatcggcggcgacccctcccccctcctcctcctccaaccggcggtcttcctcctttggctggacaccgataagctcctctccctctccgtcaagctgttgcgtggttttgagcggggacgacgacgagctcggcggcagctgaatggtgacaaaaacgaggttaggcgccacctcctcttcctcatccgctgccatagccgtcgccttatcgagctcgccagatccgctttgggggcagcgacatatctcgtggtggtggcctcgccggtgaccgccaccgccttgcacggggtcacgcctctctcaacacgtcgctcgccccgtgcctcagctcccgccctaattgatgcctgtgcaatttctgacgaagaatccgtatcttttatttggctctgcggtctttaggttgggagcgcggacacgtgcgtggcgtggaatctcagacgtagatggtcgatgctgaacgccatggacggacaagatcaatacaagcaagtccaaacggcacagtactagtctatcacacgtcaacaaaccagagaggggaaccagagaaatctccccttggaagggaagcgagcgacgaagtaaagaaagaaatcgaggaggcgagacgtgaactgtcgtgcgctcttgaattttttttcaattcttttaaaaaaaattgggagtgatttgtctgttgctctcgatcgattgagagggggaagaaggggaaagcaagaggacaaaacggcctcgcgctttctccagtttcttccactcaaccaaggggaatcccaccgctagggctctgctgctctctgttgcccatccaagaacgcacaaatcttgcttccacctctgttccgatcggcggcggcgcatgcttcgtcttgctccggtgagttcattcttctgcaggaatttttctagcttgctcttgcggtttcttggatcttggttggtggatggttgtgttgtccgttcttgatttcctgcaacttcgattggaaggatgatctgggtgggtggaatactcgaatctgggttgttgattttttggtgggactgtgtgaggacggtcagttcttgttggttttgctgccaatgcgatgagggagtacggacgatgaacgcgaagtgttcgacgaaattactgaccggagttatctgaggaggtagagagctatatcaggatttgatgcctctggattgtatttgcttctacgtatcttaggacagcacattctgaacctccggtctggccggagccccgagcccacggtttaggagcgcgccttcgtcgtgccctagactcgtcactgtgtggggtggagcaggacaagatgctcgtgttgatcac

SEQ ID NO: 76 - DNA, 1501 bp, Oryza sativa
aggcactcacgcatgctcaggccttgccagcggctaatcacagtatcacacgtgcaggagcaggcatacgaagaagaaaagagttaaaaaagaaagaaacacaaatagttttgtgaaattattaggagtatgatatcacgtacattgaatggaagcaagtatatcttactacatcgatatcacgtatgtctataaaatactcctaaaaaatagaaaaattaattgatagaaataatataaacgattcgatcaaacattataagcctcatattttttcttaaaatcattttccactaatactataaattttgtggatttatttgcaaaactttcaggttttataaattcgctgcaattttaagaataaaactattagattgttttttctccctaatcctcatgtattagaatataagcatttttagagttcgacacagttattaaggccgtgtttagttccacccacattcccaacttttcatcacatcacatcgaaaacttttctacacacataaactaccaattttttctccaaactaccaaatttctttcaacttcccaacttctccaccacctaaacacaccctaagaaagttggtatgattaaatgggggagtattgtgattggagaagaagtgaaggtaggtagaaaaattaaatagtgaagggttatgattggttgagaagagaatgttggtggagaagttgttatattttgggacaaattataaatgctataagttgttatatttttgggacggaggaagtagcatatataaaatcatttgtcagagtgaaacaacacatccaaattaatgacaaatataaattactaatctactttgatccatctcatcatttttaaagaaaatactaaaatccattaaaagatcattttggaaaattaaacttttattgaaaataaactaactcatgtaaaattataccgttttcctgttacatgtacaggatataaattaacagcgcgccttttggcgcgctgattttctagtcgaaaagttaaaccggggtataagtgtagcaccttcgctccactcaaagaaaatgtaagccgaagacttgagaagcttccagaatccagagatcgcagcagaaaaggagcgaacaaggcaaacctctcaaaggaaaaaagaaaaataataaaggaggaaacctgtcaaacaccaccctatgacaagtgggtcccactcgaaccaaccgtacggcccccccacccaaacccgctcccccctcgctccgaaaatatccacctctctagatctttctcgtcgcaaacgcccttccgcccccgcctcgccgcgcccattccaccacctttccgaaccttccactcccttccagactccacccccacgtcacccctatttaaacccctcctcccaccgagcaatcaagcgacaagatcgagaagccacaaaccccagcgcgatccgaggtagaagaagaagaagaagaagaagaagaagaggcgatcgagaga

SEQ ID NO: 77 - DNA, 509 bp, Oryza sativa
ccactttattgtcatgatggaacttaaccttaatttcctcctgccttgcctcctttagtactacaaattactttatggttctgctgatgtgggattttaattattatattatctgtagttacaggctagtgttataatcacccaaatagtaatttgttttggtaccaaaatcattaaacacccacagcttactatgcagactagtaggcattcaatcataggagtttttattagacatgcccccccccccccccctgggcatgaatcacttcacagacctctgccactataccgccctcaataaatctagctaacatttttttatttggggtacaaaccatctccaatacttaccaaacatcagccgaatgggcttttacccttcattcttttgactgcctgtcaacaattgttcaggaaacaatcatgtttattaatgactctatgagtttaaggtgaactttgaagcacctcttttccaccctttctaacctgcttctgaactattc

SEQ ID NO: 78 - DNA, 255 bp, Oryza sativa
accagcctctgttatttatacaagaagaagtgccctgtctgagtctgaatctcaaatagatataatagcaaatgctcgtgctcccaaagcggcttctgcgtcaagccattctatccctattaagactagaatagtagtcagcatcagcataaatgttgaggtgcatctcgctcacccattgtaaggcattggctcgcctgccattttgctgatagaaccaaccgtgtcttattgtgtgagaatgcaagggcaagg

SEQ ID NO: 79 - DNA, 1501 bp, Oryza sativa
attgcaagccaccatcgtagactcatcaacattgtaaaccctttaagaaattttacgaggtagcacatatatattttttatataaaatttagttcctcaaatactaggatacgagaaggatgtcattgtttttttaaaaaaaaatgttacctcctaaaatatttcttcaagagaaaatcactcaaatccttttaacattttacacagcgggatcaggtgggtagattccaccgtgaggacacgagccaattaacataaatttggttttgctagtgattttttgacgatgtttcggaatagacgatgtacagctcatgccgtcgacgtcatgcgtaccatgaacatatatgcggccttagttaaaatgacgaaggagtcttccccgcaaaaaaaaatgatgaaggagtcgaagaatcaatgaatcatgaaaagctgaaaatatgctcggtcgattaattacattttttgcactaatattttgttgactcttgtgattcccccttttcaacttaattatactctttcgtatcctacgtgcagtttcccgagctactaaacagtactcgctccattccaaattgatctatatatttcatgggtacaccaagaccaaaaaaagttaataactctctcatactatatttactctatcaacaaactcaatgcatgcactatccccactatttcctagccaatagcaaatcaagatattgtatgtgggttataaatgcttgtgtgcatggatgcatgcatcaatatccatttactccaatgcacaaataacgaatagacctaatgaatgaacacaaatatgtagatcatttagaaataaactaaaaaaactatatgtagatcaatttggaatggagggaatatgttttttattaaaaaaatttctatggaaaagttgtttgaaaaatcatattaatttatttttaatttttttagctaatatttaatcaatcatgatataacgagtcattctgtttttcgtgtggaaagtataagttcccaacacatgtacaatagaacacagccctaagcctaaccctgaaggtactgtcctccttaagcgtatatgacttaagagcaagtttaatagtggagtagctaattattggctattagcacatattaaagctaacatgtataatatgttaacacatattaaagataggatttattttttttctatcttatctatttctcttactatgaatttaatgtaaatatctaggagcatgtgtatagctagctcttgcataaaagccaacactcctcacttttatttatctctcttttccatataagcttatagttagcttataactcagtattatccttactctaagttttactatagaaaatgactacatgaaatttaaccaaaaaaaacaattacttgcatgaggagtatggagagttaccacgttttatagtgttaatccataggagtagtacatttttggttatatatagtacattttgtatctcgttgagg

SEQ ID NO: 80 - DNA, 1501 bp, Oryza sativa
tgcagccgctgggctcggagggttcccgagatccaccgctaggttcatcctcccaagatgccatcagccacgcccccacgcgacgccgccactgcttccctcgatcgaccggcgcgccgccgccgccgcaatcgccagcgagggcagccgtcgaaagacggcgcggcggcgccggcggcgggtgaccaaaatataggggacaaaaaagacaaaattagttctagagcatcggaagttgtcgattttggttttatagcatcaaaagttcaaggctcattttgatagcacctgaagttacctccgttacttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacgcagtatgctggctccacgagctcgtcatgtaatacttgagccctcacgagctcatccgcaagccgctgtgttcatccgcgcttgctaggtgtgatctatccacattctagctttgcccggacagcgccatcgtcgatcgatctcgtctgccgcgccgccatggccatgctagagcttgttcaaatcttgcgtgctcaaccaggtccatttcctccgcggccgtgccgcttccgagttcgtccgtgtgcactgccctcggtctcccctagatgcgtcatcctcaagctcatccaatccatgaacgcccgaagtgtcattgtccagctcgtcgccggcattgtcgggaccgcacggaagcaaagccctccagattattgtcggcgcccttgagctctctccgacatgctgccctcgatcgagctcatccatcggccctcaaattcgccccgaagcaccaccctcgcgctcgttgcgggctctcctgagtgccgacccactcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgcaggaggaagaagatagaggtaggatggggtgagccgacggaactgctgacggaatgctaaaaatagtaatggatgtagttttcagtgctattaaagtgaatcataaacttttaatgctatagaatcaaaatcgagaactttcgatgccatagaaccaattttgccatctccggtcgatgcgagaaatggcgcggagttgaaagcccactaaagcccaaggcccacttagctgctgacacatgggccccggcccgcttggcccgcggggaccccatcgtctcactcacctcccccccgcttcctttctgcctagggtttctctctctctctctctctcctctctctctctctcctctctctccaatcgaat

SEQ ID NO: 81 - DNA, 1501 bp, Oryza sativa
ggcagcggaaacccgccgcagcgcactccctatcctccagggggcggaggccccgcctcgcggtacaggcggtagcccccgcggcggcggaggaggagaagggcgggctgccggcggcggaggcggagaggctggcggagttcctgcgggaggacctcccccacctgttcgacgacgtcggcgtcgaccgctcggcgtacgacgaccgcgtccgcttccgcgaccccatcacccgccacgacaccatcgacggctacctcctcaacatccgctcctcaagctcctcttccgtcccgacttctacctccaccacgtcgagcaggttgagctgctaccccgcactgcatttcccaatttcaatcgtaacagatttgcagcgcattttgcgaagaactcgtgactggatgggtggtggggtttttagacagggccgtacgagatcaccacgaggtggaccatggtgatgaagttcgttctactgccgtggaagccggagctggtcttcactggcctctcgatcatgggcgtcaaccctcagaatctcaagttctgtagccacgtggttagcattcttgcttgacactgcagcttttggaacatttgtttcttcgaattaatgtacgttaagattttcttttattgttcatgaaatgaattagtggtattttaatcccctgaatcatatgtatggatcacgtcttacagagtctactatatgttagaaccataggtctcctgcttgcgacattcgagacctctgagatgaagcatatatattaagcatatgcagcttagaagttaaagtcttaaaagagtacggtttcttttatcaagagcattagtaagcagtcagtctggagtaagatttcgagagatgagatcagggagttcctgacaaagctttcagacaagctttagttgcatacttatgtttagctatgtcaaataactttttattgttgcaattctccaccggatacagttcctcctataatgcaatgcttcatagtcctaattcaatttgatactaaattttagcttttcaggaagcttgtgggactatttattgatgggccggcaaaacaatacttagcttccatagtccacacttgataaagtttacaatactcttaataattgcacttgctgtgatgtgccgtagagttcctggttcttacttatttgtttttttccccccgtttagtgtgcatttttgtaaatagaagattaaggatactatgcttcccagcagagtgttggagagattttgtacatacagagaactccaacacactaaataagtttacccaagtaatcattaaatattattataacttcccaatatgctgaagtgcaggatatttgggactcaatacagaataatgaatatttttcttttgaaggactgggggatgtcttcaagcaggtcatttgtcatgactctacatttttcttataatttgtcaaacaaatgtttgagctagatcttttgattctgcac

SEQ ID NO: 82 - DNA, 1501 bp, Oryza sativa
gtggggaatggctcctaccattaataagtaatgacaatcatcaaatagtagttaaacagatatgctgccaggaactcagtagtcagtacaacactttacagtttaagaagttaggccaatacctcccaaccacaagagcagcaagagcagttgtgccagaagcaagagaggagttcacagaacaagcatctgcgaaagcagcatcagtctgtaagaacgctgaggacagagctttctctatctcccttggaaaatcctcatcctcaacgataaaccttgccaaattgctgcacacaaagtcagcagcgtgctttccaccatgcccatcaaaaacctaagacattaaaatcatatgaagggtatatataaataaaatgcctgccaggggcatgaaattactcataaaggaaagttgttattgttagtctagtcatgaaatggctaacatatatcgcatacatcaagaaacaagtctgggccttgaatacagtagaataaaagcataccccataaaatgcgctcggaccatcttcaaaactttcaactccaaactctttcatgaggttatcagaacaaataaagacatcctccattgtgtgccttgacccaatatcagcccaacctccagaccttacaacaggcatatatgcaacagcatccatgttttcaaaagttttctcagttccagattttgtactgtttgcaggactcctcacctgcaaaaccaatgccaagcatgacaaaaaaataattaaccatactgcacagaatctatgttgtatgctctttcattttgaagttgcactaccatgacccaaaaagggtttccagattatctcatacatatattaacaatgttgatccaacaaaaggcaaaaacaaaaattgcactgtcatatactccctctgtcccaaattgtagagcactcttatttttagaaaaatcaaactcggtaacttttgactaataattacactaacaatatctacaccaagtattatgtatgttatatcattagattcatattttaaaacattttcatgtgataataattttatagttgttgatgacataatatgaaataaattaatgatcaaagtatgttattaaagattgtgtaaaaaatatatctattataatttgggacagagggaatacattcggttcttccgaaagtgaatatcactcatactcactggctgatccatggcccaatggctgcctaggctcgtccgtggatgcccaattaaaatgatttaattgcaaggattgaagagaaaatttttatagcaaatactaactatagttaagtttgccctaccacatgcccaaaagcggtgcaattagttgtaactatgaaacaactattcttgtcccctcccatgtgaattaagtgtgacattataatggttccctccttgctcaaataatgtgatctactagaaattaccaagcaacatgcagtgtcagacaagtacataactacaaatggacaggcaa

SEQ ID NO: 83 - DNA, 1501 bp, Oryza sativa
tacactactggttgaaccattactacatgagtaattaagtattaattattttaatcgtaaaaatagattaatatgatttttaaacaactctattatagaaacattttttataaaaaaatacagtgttctgcggctcgaaatgtgagcacgcaaaaaatgggaattctctcacatacgttgctcactaagatggtgtttgaaactggtgaagatgaagattaagttagcgcacgtaaaacgagaaaatcattagcacacgactaattaatttttaattattacaaacttgacaaatgtatatatttgatattttaaaacaacttctatatagaaagttttcgcacgaaacacactgtttatttatagtttaaaaaacatgctaacggaaaccatggtaaattctgaatcttttacgctgaccactgatgtagagagctgacaaaatttttaagcagcaagcactctgtcttagggcctgtttagttcccaaacaaaaattttcacgctgtcacattaaatgtttggacacatatatggagtattaaatgtagacaaaaaataattacatggttcgttaggaaattacgagatgaatcttttaagcctaattacgccatgatttgacaatatggtgctacagtaaacatttgctaatgacggattaattaggcttaataaattcgtctcgcagtttcctggcaggatctgtaatttgttttgttattagactatggctatgtttagttcccttcaaacttccaatttttccgtcacatcaaatgtttggatatatgcatggagcattaaatgtggacgaaaaaaacaattgtacagtttgcatgtaaattacgagacgaatcttttgagcttaattacgccatgatttgacaatgtggtgctacagtaaatatttgttaatgatggattaattagacttaatagattcgtctcgcagtttacaggcgaaatttgtactttgttttgttattagtttacgtttaatacttcaaatgtgtgtctgtatacgtcaattttttttaccaaaacaactaaacatggcctatgtttaatacttcaaatgtgtattcatatgtccaatgtgtcatgtagggattttttttttttttgccaaaatatgtttggttttatgggacgaaaggagtactgtggaattctccgcacccacgaggaccttaaaccaaaaaccgtccacacgcgcgcggcgcgcgccgaaccgaggacgaggcagcacagcaggtagcgcgcggtgggccccacccccaccccccgaccgcgcgcatctttataggcagcatccgcgcggccaccaccacccaccaccacaccccttgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcc

SEQ ID NO: 84 - DNA, 1501 bp, Oryza sativa
agattcgtctcgcgatttcctctataactgtgtaattagtttttttatctatatttaatgcttcatgcatgtgtccaaagatttgatgtgatgtttttgagaaaaaaatttggggaactaagcgggcccctagacgacctagaaaagctttggctcttttccttttgtttttgcacaaccccaaggctggctgcgtgtgttgatttgatttaggaccaaacttcctgggagcaagctccaaaatggaggacgacatgaacaaactaggttagcttcgcctttaccactttacataattacatgtagatgagcatgcagctcactcagcagttgggggcctggggctagttttttttgcatgcataaaacaagcatgggtcatatgggtgagtgaagtgagtgagtgagcagcatgcaggtggtacagagattgtagaggaggggatcagacgttggtgggccgaatcactccgcacgaactgaaaattattccaccatcaaaagaccccagtcaactcatcatcgacgctctcaactctagatgggctccctttctcgtacgcttgtcggggccacgggacagtgacaccctctggagcaaaatttgtacggcatcgatctgtggagcaaactttggagttaccacgcatttcggccgttggtaatccgatgcaagtttgggtcttgctatttgctactccctctatcgtaaaatataactagtggtaaccttaaatattaaagacagaatattaaagacagggataaaaaaactttgttgccttttcaaaataggtgaggcttaagtttaggccagtcacaatggaggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccgcgccacgcctccttcccgcgtgaacattcctccttcccgcgcgagcgattccaccatctcccccgtccggcgcctacggagtacaccgcaaccggtcgccccaatccggcgcctagaccgtgacccacccgccatcttccgcaagaccgaatccccaacccacccaccatcttccgccgcccccgtccccgtccccggccatggatccgtcgccggccgtggatccgtcgccggccgtggatccgtcgccggctgctgaaacccggcggcgtgcaaccgggaaaggaggcaaacagcgcgggggcaagcaactaggattgaagaggccgccgccgatttctgtcccggccaccccgcctcctgctgcgacgtcttcatcccctgctgcgccgacggccatcccaccacgaccaccgcaatcttcgccgattttcgtc

SEQ ID NO: 85 - DNA, 973 bp, Oryza sativa
acacatatgctacataaaagaacttttaataaataataaataagtattaactttttatatcatatgtaaaagtaaatgtatcgcaaataatatggtgcatcacatactcataaatataatagtatcatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaggagtatgtaagggattgagcaaaattcaagggtatagaaggaattaggtgaactttcatgcatacataggtgattttctcaatttaatactcagggtggccatgcaccatggacagagatgcagaatcaataatttcaactcaagaaccttttatttttactgacaaaggaatgcataaaaaacaagtatactcttttttttcaacatattataagttctagtgagtgtttaattatgatagacatcatgttgttggtgctgtttatacttatttagttggatgcataggacaaactattatttgtaattacaccgaataaatatataaggctgccactagtcagaacacaatataaatgttacacctgtatggtgataaataggatggtcttaattccgagatgtgatgattgatgatcgcaagtagtaggagatttccccgcacaaagcaaattttgcgcgtgctaattgaatcggatttgttatacaacttttagctcatgcttacgtatatgcaattatatttaatatcttaactaattaaaacaatcgtcacctcgtccgtgcgctttttcatccgtccaccccccccccctcaaaaaaaaacccagaacacaaatacgagtccacatcaaaatctaaattggacccaaatcatagagaaaacactactccaataacacaagaacagg

SEQ ID NO: 86 - DNA, 1501 bp, Oryza sativa
gaggaacgcccgcgggaactcgccggagagcctgttcccgttgaggaacacgttgcggagcgccgcggcggaggtgaggtcgcccgggagcgcgccggcgagcgcgttgaggcggaggctgagcgtgtgcagcgccgtcaggttcccgagcgtcccctcgggcacccgccccgccagcgccgccccggggagccgcagcaccgccaccctgccgccctcgcaggtcacccccgtccacgagcacgctccgcccgggtcgctcccgttccacgccacgtgcctccccaccgcgtccctgaacgccagcagcgccctcgcgtcccccgccaggtcgtccgccatcgccgccgccaccaccacggacagcaccaccatcgccgccagcgccacgcggcggccgctcgccggccgccacgccgcccgcatcccggcggcgcgcagaggaggaagcgagaggaggagggcggcgcgtgcgcgcctttgtttcgcttttggttgtgtgtgtgggtgtgtgtgtgggcggtggtggatgggggagaagagagagagagagaggtgggcgaaacggaaaaaccctaaaaactcccgtgcgaattttgcggaatgggcctcggggagttggggttttccgtctttgggaggccgggatttattccgggagttggcgggcggttgggaaagggaatgggaatgggtggcgccgcccgcacgggtgggaatgggaatggtaatgggatctcgtttgcttggccgggatggggaaggggaatgcgactgggtacgatgactctggcaatgctacgcctaggggagagtgccctgttggattgactgtctctgccagccatccagccgagacaacaaatgcgccttgctgcgcgtgctgggagggctcgctgacaagtgggcccgcgcccccgggttaaccggtcactcggttattattctggctggcaataagagcgagtataattgtagaatataagccggttaaatgctgagttggaggaaagaagagaggagagagagaagaagcggactgtaaactaacagccggcttggacacaagaaccaaaaaactctgtgagagaaacaagtgggtcctgtattaattgtgaagagctaactattatatggataggctaagataaggctataaagaaccttatagccagcaggtcggctgtattattagccttgctctaagagcaagtttaatagtatagtccactactagatccaaatcatttatagctaatgtaatagccaattcatacaatagttatttactatactattaatatctggtcccacttgtcatacacacattatatcttggagtccgtgctgtagctggctacagatctgtagcccgctgctcttctcttctttttttaactctttaaaatatgtttataactggcttatacctgctattgtacctgctgtaacaagcatgtcagccagttccatctttctttttctcctaccaacagcacta

SEQ ID NO: 87 - DNA, 1501 bp, Oryza sativa
tcataaccaccataaatcaagcacaaaacgggagtgctagtgctaaaactagtaatggtgtgatggagtaatagatattatctatgttgctgttgctatgccttaatctagttgcattagggattgaatggcgattgaaaatttaccgtatatgatcgtccctttgactcaatattcggttaccgatatatttcctccgtcccaaaatgtaagtatttttgaggttggcatgggtattaaaaaagtagatgagaatgactgaagaaggtgtgtgattggttgaaaagagaaagtaggtgaaaaagaatggttgtgattggttgagaggagaaggtaggtaaaaaaatagcttcattttggaacaaagtactggctagaaatagctacattttaggacggaggtagtaatacgtacctgcttgcaattgctacatattcatttcatatttataatcgatattatctgtatttgaatccgtatttaataattacttatgtccgatccaattccgatcataaaatatgggttaagatataagaaggatcgaaacccaacccgattcatccctagtttttataccggtcatccatgtaccttttgagtttcaagtcaactgtagtattattcaaaatagtatcaactcttagatgcttcgttttacgagcgactatgaagatgattagagttgctatcgcctactcacaatcgcagtacgtctcagctcacaggttcagcatgacatccttctctgttagtcacgttgagaatgctagtaaccataatatgcttaaatagagtattaacattgaacatatggagcccagcgtttgacgacatacttcgagctttcagattatttatttatttttccttcaatctctttgactctagtaatattaaacaagtgaacttgcatcagattattcttctttcctccagccaccattctttggaaccttgaccctcgacacccccccaccccccaccaatgttttgaacaaccccaacatctttaaacaaaggaacaaactgaaactactcttgtatttttacttctatcactaacagtattcccacggtctttgaacaatcaagtcaaaaataaagggataaccatcactgccagcctgccatgtcaacatcttctagttcctcctcactagagaaaaagagcctccaaacaaaaaatcatttagcaatttgattggactaacagctactatctccgtcccaagacataaaatgttttaaaattagacatgagtattataaacataggtgaaattaaatatgaaaagattgtgattggtgaggatactaaaaggtaaaagatcgtttacattttgaaacaaattttgaatgctataaattgtaatatttaagcacggaagtagatttaacaaacaaattgtaatattttaaatactaaaagtaaaaggtcgttattgattgagaaatgaatagatatataagttgttatattttaaaacaaaatttgaa

SEQ ID NO: 88 - DNA, 1501 bp, Oryza sativa
tacaatgattatattggttaaggcccctcgtaaaataataaccctaattcagtttatatgggattgatatggaagaccacagaatacagagagaacatacgaactcgttgagaccgacgagaccctagtcgagattgttcgatgagatctcccggcggcttcagcttgggtccttcggcttcgaaaactatggtcggcgtgttggcgctatgattcgataatccagaacccctccaggggtatgccttttataccgtggattgccttagtctccaagttgaactcggaaacaatgaaccctgcacgatatagaatagtcctagtccttcccgagtaggactctagtagtctccagctcataaggatatttcctataatattttatatatgtccttatcgcatatagaaacatatcttgggatatgaggtataccgatctaatatacttggttaattgtaggatacgagatatgtcttatccgtaatcctgacagatattcatttagatttgattgtttcttaatattaatacatttaataaagggtattttgtaaaatttataatgagagtaggtgatgtggcaagttcactacgagcactaacttttttaaaaaagcaatatagacatgtgttattggaacactttaatagcaaaccaaacactaaccaaagtgctttttaataggaactaaagtacttttaaggtatcaataatttggtaaggcatatatttttttgaaacacagtacaaacacaagcatttataacgtgcacacggcactcaccttacctctatgagcacctccgaaagattgggtcggtaagattgacgaagtcaccacgagcatttcattgttggcgggttcattatctatcactggaaaataataactagccataattataagcactaacgtcaagactaggacttaaacttagggggttggttttaccacaagaaatttagccggttgaactacaataatatcaaatcaaaatgggccaactacactaatatcaaatcaaaatgggccaactacgctgatatcaaatcaaaatgggcgtctggccaatttgattgatacaacaagcattcttttcatccaaaaataaatcaacataggttcaaagtggtatttcacctgataccaacatactgagtgacattttatccggtgcatcatattgagtggcattttatcgaatccccacgtatagagtggcatattgtccgttctctcggttctggtgtttaggaaaacagggaaatgcatccgccgttgattgcaccttgaacggctaagatcggaagtgactgcttaagtggcaatctcacaaccatgccatcctctctctctctctcctccctccaccccgccccagatccagcgcctcccctctcctccgctcgtctccgcctccggggctaggggttcgcctccgccgccgcgcccgccgtcgccggagacgacgatcaggggcgggagggccaagcgaaga

SEQ ID NO: 89 - DNA, 1501 bp, Oryza sativa
gacgggaggaaggccgccgcggcgcagcttcgggatgggggcgcgggcggggcgtcggcggcggcgctgtcgcccatcctggcgtcctcgctgggcctcaaccggattaagacgagatccgggcccctgccgcaggaggggcaccgcatcgctgccgcgctcgggagcagtaatctatcgcgtgggcaggcgcaggcggacccgtcggctgcatcggctggcggcggcggcggcggcgggaggaaggctggaagctcatgggcagattcgaccagtggcagccgggggaaagggaaagcggccgaacatccagcgcggggcgccacagcaacgagcctggaaggaaagagctctgcaaaaggttgttgatcctgcaagctgaacatcctttaaacttgttttccaggtttttgcatcatgatcctgcaagccggctacaggtttttggaagatagggggattagcttatcattgccaagctcttgcattgatagtaaggggagaacagcattaagcaattcaattcaagctcccttcagagcttaccgtgtcgacggtagttgttaaaaacagtaaaaacataataatttcaacttagatgtgttgagttataaggagattggcgcccatgattttcattttgccgcatggtgtctagatgctaaacttggaaccaccggtgctaacgtaagaatgattcttaccatttaagtaaggaatgcccgcctagttattaaaaggtgtagacaatttaaattcaaagctagtaattggttgctatttttagcagttgatcataagctattcctgcgatttcatgattgaagttaatgtaattgtgcgcacagcttctaattctatatacacagctcattggatatatgactggagtgaggtgttcatttgacttgtggcagattacttacttaaatacctgtttatgtctatcggagctatatccttcagtttaatttgctagttcttaaaaaaaacgaacttcttggagtccgcagcaaactctgtagtagtttgctgagaaatgttttactataaagattcatattgttgctacaactggctgaatttattctataatatgtgcttccggtgtttaatagtttctgctcctctcatatgaaaatgcatttctttttgtagccttgtccatagcacattctactttatcccatataacaatagctaacaatgtataatctgtgtgtctttttgtaacttgaaaatctgatatgtgtgtgcccaatctatctcatacacagttaaaccgaatgcattgcggaaccattctggagatttgaggactccaactcacataccagataatgtggtactgatgcttctacaagcccatttcacatttttaaattaaacaagcaatgacaaaaccatcttttgctcttttcttactcctcctatctgtactgtcatcttaatccacagtgtgcatatgatccctgtgaaacaccaaaggaatcggaatctc

SEQ ID NO: 90 - DNA, 1501 bp, Oryza sativa
tggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcggagggagcgtgcctgctcattggcgacgtcacgggcgcgcagctcccggatctcgtcctcccacctctccaccctctcctctccttgtggatcctgcacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggaggatgcgctgcacgtgctcctccgtctccgccgacgccgccaccacctcctcctcctcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatca

SEQ ID NO: 91 - DNA, 1501 bp, Oryza sativa
atagtataataacaaaacaaattacagattccgtctgtaaactgcaagacgaatttattaagcctaattaatccgccactagtaaatgtttactgtagcaccacattgctaaattatggcgcagttaggcttaaaaaattcgtctcgcaatttacacgcaatctgtgtaattattattttttctatatttaatactccatatatgtgtccaaaattcgatatgatagggtgaaaagtttttctttgtaaactaaacagggccttagccaagctctgtggatttggttgcccgatggccaataatgaagcccataagtaaggccatgtttagatcatttagtccctggatattaaacttgtcccttactgttttgatctaggaacttcagtaaaaaggactaaaagcacgtagaccgagggagaaaaaagagagtggttatcattttagtccttataaatacctctaagagggtctaatagattttagttccaatatacacctttaatcccttttagtcatccctatttagattcttaaggattaaaagtgactaaaatggagggattaatagattactccatgaccaaacatgacctaagaaaacatgaatgcagtttacatttaactatccttcgagatagtcacgtctacaaactaaacctatttttgaacggaggatgtataatgaataaaaactgaactactttctatgaaactgaactagtgatctaagggcgaggtcagcgaaggtgaatagactcatctgcctaaggcttttttaagtatacagacacacatttaaagtattaaacgtagattaataacaaaacaaattacagattctgtctgtaaaccgcgagatgaatttattaagcttaattaaaccgtcattagtaaatttttactgtagcatcacattgtcaaatcatgtcgtaattaggctcagaagatttgtctcgtgatttacatgtaaattatgtaattggttttttttccacatttaatgctccatgcatgtatccaaacatttggttttgatgtgatggaaaagttgaaagtttgaagaaaaaattgtgaatctaaaggcctaattttaatagaaacgttcgcccaacatatgtttgcatctcgagcctcataactgtagtgggagtatttgatacacacgtatacgactgttccatcttgttttaattttcgacaaaaatattgataaattttttgatctttaagcctgaggaacaaaaccgtatagtcgtgcgattttactttcaaaatgacgataaaaattcaacgaatgtcaaatgtcaaaccttgatttctcccttccagaagtcgagagtttttgaattcctcaacttgccgtcggcttgtccctcttcccgcgtgttgaaatcatcttcccttccagaaagccaacgccttcatctgatcatctccttggccaccaagaaatgccttcgtcgaacacctcgccacgccacgccgcgcgcgcgccca

SEQ ID NO: 92 - DNA, 1501 bp, Oryza sativa
gcgtcgaaggtacgtgccccgctcgtacaatccatctccccattctaaccgaaacgggctcgagttctagctcccccgattttgcaacaaaactcgcatcgatttcgcctgctcaattccatcgattgcatctgacgatccctgacgcccctgttcatcctcttctctcctttgcaggaatcgtcctcagcttcgtcaatgaggtaacggcccccctcctccaaaaccccacatgaccaccggctaatttggctgctctggtcctgccctgcgcttgcccttgcctgattagatattttatggactcggctaacatgtcatattgttatgcgacggtgatgggtttgtttcaagttttatctggtgccctgcgctgcatgatagtaataataattaataaattgctacaccttccatcccaaaatagaacactctagaggttttttttttttttgtgtgtgtgtgtgtgtggagattaaggagatgtgaagttaaatgagggatggttgtgattggtcgagttgagaaagtaagataaataaattaaacgagagatggttaggattagttgagatgagtaagtaggcgaagaagttgctaaattttggaagggacggagacgtttttgttttgggagggacagagagagtaacgcatactccgtattggtttgtgttttgaggggttgtttctactgagttactgtatgttggttctgaatcttctgatccatgttagctctgtgagatgcaaattgatgatctactacttcagagtacggatttgttgaaacccatgataatctgctttctactatgtgttcagatgtgaaacatcgtagtaacttaactagtccactgttcagccatgatatggttcgcatgctcattgctaggactaaaatctgcatgttctttgataagattgaagagtaatgttttgttgttaccaaataaggccaactttgtttatttccttttttgttgatttcaaaaaggttcaagtttttcaatagtatcctctctactcggcagcatccttgtgtggaaacttttgtgcgaggttgtgtataagattgtgcatagaaagaaggcactgaggtgcttataaatcgaatctctggcatgtgagcttttttaggtgagtttttagtcttcactcctcatgtagactgttcctgtcacaggttcacagggtgtcacttgctttaggaagcaataaccctgtgtatcgccagtatgtttgcttaacatatcatccatttcctgagcaggacagcagattttttcctccttttgagtagagataggacagagaaactatatttggcatcttttgtataccactcttaccatgatttgttcacaattaaccctgttttacttgtatgactaataagtttgcagcacttggactttatgaaataaaaaagaagatttgagtaagagtacaatgtgatcaaattagaggatttcaaactctttctagtattgttgtaaaa

SEQ ID NO: 93 - DNA, 1501 bp, Oryza sativa
ggcatctcggcgagccgaagcgaatagctagcatgcgcagcgcaggaggcgccgcgcgagcgagtgtagcccgtactgccgtcgcttcgcggcgttgcgggttgcccccgcgtgcgtcatgatcacgtacagcctgctaacgactactgactagggtgtacttagttcacgtcaaaattaaaatttacattgaaattggaatgatgtgatgaaaaatttagaagtttatatgtgtaaaaaagttttgatgtgataaaaaagttaaaagtttaaagaaaaagtttgaaactaaacatggcctgcagagtgctcgcgagtgtcaatgtgtcatgtacaagtcaacgggggcgaggccgagtatacgggtcaaactaggcccatgtagaaagtttaaaccgtgagcggaagcaaaggaatagtttacttcgaatccctcaaattatagtttaaacctgattcatttctctaaccatcatactggatttcttgatgcttaactattaaggccatgtttctttcagctcagaattattataatccagattattgggagtaagctgaaagaaacagacaacttattaaagtagcttattataatctggagcccagcttattataatctgataagctcatttaggtgagctttttccagattattggatgaaaaattatccaccatgccaccccactccctctttagacttgcaaacctaataatctaggctctaataatctagaaaagaaacaactaaccacttattctactacagattataacaatctagcttatactaatctgactcaataatctagattataataatcccaagctgaaagaaacagggcctaaaacatgtataattggactcccgcatcagcagttttcactgacgtgacgtgttgacttggtccgcatgtgttgacgtggtagcccaatcacaaaatagaagttcggcccacatgtaagtgatgggaaaaataagaaaaaatgtagggcctacttgcagtgcccttctcctctctctatcctttttctccaaccactccacacctggcacagcttaggtccgacccgtggtggccatcgtcggacaacacagcgacaacaaggctggtgaacgccgtggtggccacctccatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcccttccacctttccctgcca

SEQ ID NO: 94 - DNA, 1501 bp, Oryza sativa
atagttcggttgagatttagaaaggtgaaggaaacagaaattcttaaaggtaattagatgtgcggtataattcttaaagattaaattcaatatgataaagtaatatccgtaggattgctatgtaatggcatattgacatcgtaaagaaaactcacatagcatatgtttagccaagttgatgcacaaaaatactaaattgtcaagtttttgtactagaacgcatccatttgtcaagttgttgcactcggacgttcaagtctcaagttcttgcactttatcgcacccacatgccaagttgttatatggtgggtgtaatttacacaataaattaagatgtattaacatgtgatatattactataccaacatctaacttaaaattcaatttctacatattaaaaaaataaatttgactattaatatacgttaactaattgttatttaatttatttttttcgttacaacatgtagaagttgaattttaagttgcatgtttgtgaagatatatcacatatcagtacgcctacttaatgttttttcaaattttttcataattgtttaagtgatatacaaacaacaagcgaatatcccctcgagaatttagaataatttcccccagtctaccctcaatcccatctcccctatattcttccccaatccgggcgactgagctcagaggcagttgcacatcactacgtcacctcccaaaatgatcctagtaatttcctaatccatttggctattggtgcggccgcctagtcctgcagttttattaggaatagcaattccgtttattaaactcccccgcacgagtgacgagatgccgctgcgccttgcttctccgtgaaacaacccccggcatgactccccagcgatacgtccacacacacataccacaagtagagttccaaacttgccatatttcccggttgctgatcatcaatcatcacttcatcagcgcatacgtccggaacgtggatgggaatttgaagcttcgctacattccaccctgtttctcgcctcttgtcccctgcatcaacgcgacgacacgcccaaatctctatctgctaacgcgatgctactcctcccgttctcctgaactcatcaggccagggccagccacgcatgtgagttgcagccgccagtcaagcccaggtttcggctgcactgcatggatcgagcccgactgccgcaagcaatctcctgaccaacactaccacatgccgacttcgccgcaaaccgccccggctagctagtagtaacatggtgtcacgttcgcgatgggagctagtggctgcgactttggacttcgttactgcaatctcgccaggattctggggaaatccgttacgtgacagttgacacgcaccgcaacctagcacgcacagttcacattcagttgcacctcgagctctataaatggcgtgatgcagcgaagcgaaatatgtcagtagctagcagcgatccgataagtgataatttagtggtgttttcacgcatgg

SEQ ID NO: 95 - DNA, 1501 bp, Oryza sativa
atgtatgctcttgcattagcggcttagcaaaccagtttatgctagggttgagaggcaccaggagagaagctcccttcccaatagtgggatgaggatcttccttgtggactttaactcctggtccgattgcatggttcaactctccaaattgcaccagtactggctagcataaaagttactggttactggccaattaactttgaccgcccagtagctattgcacttaagacattgcctactgaaattagtgtgtcaaattacgcagtgtcatgctgcagctacgagctctcatgttatattttttttcctcatgcaacttgttggtcctaataatcaccatgatcacccagtaacgtgttatatttttttccctcatgcaacttttttttgtctaccgtaaaatttataatggtatttttcatagaaaaaggagtcagccatattcgttcgtaaggtataagaatttttacactagtaagagaaacaaaataaaatctagaccattaatttgggtctatgtagaaataaaattttaaatataaaaaattaagactacaaataaataatattgaaagtagagtccatgtaaaaatataatatagaaaatatacgaaattcaaattaaaatagttcatgtagaaatataacatattaatatttgaaattcggatttaaaataactaatgttgagaaaatagtccatctaaaaatacaatacaatttagatatatttgaaattcgcattagtaataaataatatccaggtcgagaagatgccaagtaaagtacagttaaagagatcaattcaaattaggaacaaaagataaaacaaaatccaaattttgacactacgccagatcctcacacctttgacggcatatttgtgacgggcataagtgttggtcagtgatgaaagtcacctttgacgagtcctaccagatgccgtctttagtgagccatccagcttcgacccgtcacaggtgacgggccggaagtgaaaaccgtcaaaggtgaggcttacctcacctctgacaggttccattttcaacccgtcacaggtgactagctacctgtgatgggtcgcaaccggatggctcgtcagaggtgaggtttactcacctcaaacgggtagaagccctaacccgtttgagtgagttgtgtcactatatatatatatatatacccgagatatttcttctcccaagagataaggctggcttctccacttctctcgattcttctccacttctccactctctctccctctctctctccacagacttctctcgatacacgcgccgagcaccgggtccggcggcagcatccgcttcttcctccgccggccggcgccgcctcccccagccaccttccgaccgtcggtcgactcctcctccgccaccccaccgccgcctgccagatccggcggtagccgcctcaactgcggcctctccccaccgcggatccggcgcctctcccccgccggtcgcctcctcctccgcca

SEQ ID NO: 96 - DNA, 1501 bp, Oryza sativa
aagtcggtatttatagacagctcgatcgaggaggagagaaaaggccagatagattggctcctccatttaactttacatagtatcttttatttgagcatatactacttaaaaaaataggttttccggcagccaaaatatgttttcataggaggctgacacaaccgccagcgacctaaaaccagtaaaaatcgatgatttttgctagcggttacggtccgcttgcgagcccctaagacgaccgattgcaaaattcgattttcgcatgcagcactactaggaggaccaccagcaaaaaggttatttttccaataaaaagttaatcaatattaagagaagagaagctattgcatattcaaatccacatctagagatccaaattcaaatcctcatcagatccatattcaaatccatatccaaatagcactacatagatttttcactccattttcaatttgcaaacaacaataacagatgcaaatgaaatagcatcgccgtcacccgtcgccgtgctgttcatcattgtcgttgcaccgacggtggtcgtcataggtggagtgggaaagggaggacttagctcagcaagatctggaatcgcgttgaacaagccgagccgagcaacgctgccctctcctagtctctttcctccatcgccgatgagaaggaggagtggtcgtcgccgtcacaacgtctatcgctgccatggacgagctcccctcgccaacaccatggacaaggatccactgtcggagcctcatcgaagccacccacgccatgggacctgtcacctccaccggatctatgcctgaggtcactgccaccactgcttccatggcttgtcgtcatcttcgccaccgcctcctccccttccgctgctggatctgtggcatccaggcaccgtcaccaccgaatatgccgccataagatccgtggcttgccatcgctgttgccaccagcctcgtcccttctcgtcacatgatccgccgccacccgcctcccgttgccatcgccatcgctgccgtggcatcatcaccatcgtgtggcacgcaggcacggtggaggtggggaagttgaagggaggagggagctgaggagacggaggatttagtgggtggcatggatagtgggccatagggctgtgcgattttaatgccagcgaaacatcaattttcgttggcggatacttaagaagtctgcttcaaaaaatagagttttttttacagacctcctaagcattcgtcggtgaaaattggttttttgctggtggttcatgacctaaaatccttcaatacatttttacaagtgtttatttcattaacccgtcaataaaaataaaagggtgacaccatgaaaaaaatcgtttttagtagtgataataatgctatggagtgtctagtctatttctatatatttgtatcacccacacaatcgtcacttctcttttgggttttagtgcggttgctcttttgggtatatacatggagaaatctatatgcatggtagt

SEQ ID NO: 97 - DNA, 1501 bp, Oryza sativa
aatcaaaacccccatcagacttcaaagtccacggaaagctttgcattggcaacaactccacgaaccccagagaaattttcatttgggcaatacttggacgaggcagagacgctgtcggtgaccccagccgatggaagcccaaatctatccccggccggccatgcatcctgacgacgagctttaaacatttggccatggtcgtacggcgaaagccttgggaaatccggaggcgcacgtgaggcccgcgtgtgctcctgctcgtcggcagctgctagttactgttacttactgcgctcttgcccagcgaaagaggaacagctgcgcctcgcccccatcctcccagcacgagatttcacgcagtttttaccgtgacctccgtggttaattaaccttcccgtacttgtacttaattaccctctaatgctacttctggtacggttcggtcaagctgctgtcacagtaattaatcaattactcactccattctaaattgatctacatattttataggtacatattttattagtcgttttggctcggttagctgtggataagaaaatttgttattggagcatttttgccacgcatgagacgagattgcccttgtgcattcatggtgttattgctctcagattatctccttgttactccttttaacgcttcttttccatctcatttaattttcgcatgccctcgagcgctatctgtactgaagctgcatgggctgcatgcatgcatggtgcgatgcaaaatcgccaagacagaaaaaaaaggtatgtatctagaccaggaatcgaactcaggtcccaagacaacaacatgaaagctctaaaccaactgatcaactgagagagcagttgttgcttgcttgcatgctacatctaaccatatttaatagggatatgacttcttggtttttaaaatcgtgtccgaaacgactaataaacccagcccgaagggagtattatatttacctagcaacaaactcaatgcatgtaacatccctactattttttagccaatagcaaatcaaaatattgcatgtgggttataaatagttgtgtgcatggatgcatgtatcaatgtccatttactctaatataaaaataacgaatagacttaatgaatgaatataaatatgtaaatcatttagaaataaccttaaaaaatattatatatagattaatttagaatggagggagtagcatcaagagatgatgctgaactgtggatttgagatagtcatccatgaagaagtatgaacataagaggctgtttcaatttgtaccagtaccatgtcatggcgtgttaacacggcgatatgagtggcacctatgaacaggacacggagcatggatgccgcagctggctagcctgttaccctgcacaaatctcggcacggctaattaatcaagcttaagtcgttcgtcgatcgatgcaaatgcaactgcatttgcctcgatcccttgtgtttgtgtgccggacaatgcaatattgcaat

SEQ ID NO: 98 - DNA, 1501 bp, Oryza sativa
ttctggatgttcttcagcgccgggaaggtcgtcttcatgaacgatccgttgtacgccttgagaaacggctcgttccccacggcgacatacctgctcgatcgatcagactcacgattaggatcatcgcggggattgcggccatggacgaacaccttggcgagcggccggcatatgcccctacttgatcttgagcttgtcgccgtagctggtgacgttctccttgacccaatcctgggcgttcccgtagctgttcatcgtctccagcatgtcgttggggatgccgagcatgacctcgatgccggagtcgacgagcgcgccgacgggccacgggtcggcgtcgaacagcttcaccttcaggatgccgttctccttgagcatctgcacgaccgacttgggcagcagcgggtgcgacagctgcgagccccagttcacgccgacgtccacggcgttgccgtccgccgccgcacgggacgccacggcgagcagcagcagcagcgcggccgcgccggccggcagccgcggaggcggagccatgccggggtttgccgtctcagctctgatcgatctccccgccccctgtgtttcggatcgatggcagctaggtgagagatgatcggatttggtggtgttcgcgcgctgcgggcctccctcccctcctgtggagaggaggacaaaatggcgggtaaaacggttggagtttgaccagaaaacatgcaagaaaagctcatcacctgtagacctttgttgaccacaacaatttcgcgtagaaaaaaataaaataaaacgaccatatagttgcatgcacacgtgttgtttttcaataaacaacgcaaatctttgaaaactggggcacgaatatgctgcacattggctatcggaagaataccaaattaacattcctaaaagtgttcctttgtgaaaacctacagctgcatttgttgttggatttaattccccccatatgtacaagttgaatttgattatgtactatgtttgcggactgatcacttcattgcaaaaataaatttgaccaaattttgatatttttatagggtaacaaactaaacaagattttaccattgcaaccttaccaaaatctatcaaaatttgactattccagaaccttccattaacaaaatgcaccaaattttagtaagtattaaactaaacaacattttcacattcattgacttgacgaaatttagcattgtcaatccttggttttaccaataaatggaagtagtaagatttattttggtaatgaagtgaataaattcgtcatttggaaaagtccagtcatcccttgaggggcaccttttttttcatgttgctcaagaaatcataaaaaaattatattttaataagataaattaatatgtgatacatcataaaaaatatgcaagttgatatttagcatatgtaaaatagaaataaacgataactttgactataaatagtatgcaccatttgctgtcaattttgttataattgtttatatgtg

SEQ ID NO: 99 - DNA, 1501 bp, Oryza sativa
tgtcatatatacatatatgtatttatatttttattaacatataatcattcgagatcttgttttaaatatttaattgtaacaaatataatggtgtaaagataaatggtttaggagaaaaaaacatttagagcttgcttcacagaaaatcaaaccaaccacagccaatcagaatacgacatatcacccagaccaaaactggatggcttcatcgagcatattgagggaatattctatatttcggaccaccccatctaccctgccctctaaccaaacaccacaaaaattcagacgatcatctcctatccagactcatccatccaaccaaatacaccattaatgaatttgtattgtgcttatcagaggtataaacaagataagcgagagagtacgtgagcactagttttctcgatggatccaaagtaggaatacaagtcatctcgtagatcaaatctatctattatctatctacctatctattatatactaaaagtccattaaactttctacaaacgctcttaagctgccaagtaggactcctacaaatgctcttagtccgtcacgtgactccatcaaatctaaccgttgattttcacttaaatggtgaacccgataattttaaaccattagattaaactttccggtggacccgatattttaggccattagattacatatattttaaaaaaagaaactaattccttaggcagttacgtgtttatgtatacaggagaaatttgtacgtacgtacaactgaactaatgaagagaaaaaaaactacacacagaattaccataaaatcaataagaaaaaaacatacgtacttagtaccttgcaaaagtttgataatatttaaaataggattttctattatttaaatataaaacatattacttcataaatttacataaatatcaccgtcgatttttatttaaattggtggacccgatcgatgttttagaacattagattagatgcctaaaagtccattaaatttctcaaaaatgctcctaattcgccatatgacattctacaaacgttcctaaattgtcatgtgatgctataataaatgagtgaaattcttaaaaaatctgaaataacaaaaacatatttcatttaatttggtggacagattatttatagccattagattaattttcaagaaatgaaattactctcctaaacctaggaccacctaagcctgtatgtaaaaaacgaacgtacttatgtacgcctcctctttcttcaattcatttatctacattttcaccgattccttctcatattttcatgccttattagttagataagcaataattttgtgttaaacaagtaagcttctgaatcatacaactaatttctaatccgcgtaaatctttaaattatttataactaaatctacagttgaagaccatatttcactagctataatttagctttgaaaaaataatgtcattttggtttatattttattacttttgcatgccattcaagcaattataaa

SEQ ID NO: 100 - DNA, 1501 bp, Oryza sativa
cgcacatgtttaaatcgatggatacatgtacaaccacaaccaataatgacacactcttataaccagctaccatatgattataaatacaatgtatcgacagcttttataatctcaaacaatagcccatcgtgccttcgggccggcccgactagtattgggccgtgcctgagccgtgtatgccgcccgtgggctggcacggcacggcccggtgcatcggtcgggccgtgccggcctgacaagcctcggcccaggcacggccgggcttgggccgtgccgtgccgggcggcccagatggccatctatagtctccatgcagtatcgtcatcttattatcttaaattcttaattcgttttgtggtgtgaagagtcacccaactttgatgacgacatcgtcgtagcttctctgcagctctccgaccagcttctgcagcgctacgcgcgacgtgccgccgtcgctcaccgccgacatcgccgcccgccgggcccacgcggcccgcgcccgcatcctctgcgccgcctctccgccggcgtccatcagcatcctgatcttctcctccacctcggctctcccaacgacggccgcgccgccgccggagtccaccctgaccccggtgccgacgatgtccacgatgtgcctcgcgttcagatactgctcggcgatcatcggccacgccagcacgggcttcccggcggcgaggctctccagcgccgagttccacccgcagtggctcacgaacccgcccactgactcgtgggccaggacgccgcgctgcgggacccaccccctgacgatgcgcccctggtcgggacccacgtccaccggcggcgaccacgtgttcgaccgcaccgcccacaggaaggggtggccggattgcaccagcccgcgcgccagctcgtcgagctgctcgtcggcgacgtgcgcctgcgtgccgaacgacacgtagaccaccgaccccggccgcgctgccctctcgtcgagccacgcgaggcagccctcggggtcgtcgttctcctcgtcccgctccggcgtctcgccggcggcggggagaagcggccccaccagccaggcgcgggctccctgctcgtagaacgcctctactggagccacgtagtcaccgtcaagcgcggcgaagctgttgacgaggatgccccagctgcggacgtctgactggaagacgttgtcaatcaagaaccgggtcaccgggtcgtccatgtcggtgaactttgcaacggaatatggtatgtcctccgccgtgatcataacattttccggcatgccggacacgtgaaaaggggatccaccgccggcgccgtgctcgacgccggacggcgggctcacggggagcaacttgcagatggccatggagaagcaggacatgccgtggaacacgacgcggcggacgccggcgtcggccgcgacgccgtgcgtgaacccgaggaagaagtcggagacgaccacgagcggcggggaggaggacagcgacgccatgaactccgcgaa

SEQ ID NO: 101 - DNA, 1501 bp, Oryza sativa
gatccttgtccatggtgttggcgaggggagctcgtccatggcagcgatagacgttgtgacggcgacgaccactcctccttctcatcggcgatggaggaaagagactaggagagggcagcgttgctcggctcggcttgttcaacgcgattccagatcttgctgagctaagtcctccctttcccactccacctatgacgaccaccgtcggtgcaacgacaatgatgaacagcacggcgacgggtgacggcgatgctatttcatttgcatctgttattgttgtttgcaaattgaaaatggagtgaaaaatctatgtagtgctatttggatatggatttgaatatggatctgatgaggatttgaatttggatctctagatgtggatttgaatatgcaatagcttctcttctcttaatattgattaactttttattggaaaaataacctttttgctggtggtcctcctagtagtgctgcatgcgaaaatcgaattttgcaatcggtcgtcttaggggctcgcaagcggaccgtaaccgctagcaaaaatcatcgatttttactggttttaggtcgctggcggttgtgtcagcctcctatgaaaacatattttggctgccggaaaacctatttttttaagtagtatatgctcaaataaaagatactatgtaaagttaaatggaggagccaatctatctggccttttctctcctcctcgatcgagctgtctataaataccgacttggttctaagagttgtcataacatctcgatcagctgcgactgcgagcagctaattacagagtaagggaagttggtactatacctgtcttggccgtttcctttgctggttgtgttttgtgcttgcattcatggcgaccttcaccgaacgtacccgtctcctcgcggcgctgcttgtcgtcgtctccgcggtgatcatcggctgctccgtccacgtctgccacggcgcccaagagggtcagctacctagcttcttccttcccctaaccccctctctcagctcattttgactttaatttgcatcagtatcatactaacaacagcgtactactggacgtttaattttccctgtcctctcgtccgtccagctgacctgcaggctgctggctactaccgacgcggcggcagcatggatgatcccgacttcgattttccctttcccggcccccgccatgttgtgtgcaacgacgggccttgccgcaccggcccaggccgattacgtccctacccctttccgcgacctttgccgtaccgtcagacgccgccggcgccaccgtcgccgccgctgccgccaccgcagaacaaacagatcccgcctccgtgatgaattgatgatgactgttcatgccggccggccggccgtcatgatgccacttaattatatatgcatatggctaattaagtacgtgcgtgtgataaaaacgtacgcacaccagagattacatacgcatattgtacgtgcggcgaacggccgggcgctagctctc

SEQ ID NO: 102 - DNA, 1501 bp, Oryza sativa
taaaatccacctcataagtcagttaaaatttgacatttcacttgataaatcattttattcgaaatgctcaatctttagtcggttttaatataaaaattaaaccaccctaatacatatgagcttaaccgaatcagcatgttatcactaatgtagagccacccaagctaagctagccgagtcatccttgtccaaatgcttgtattagacttattctttatttttttcgtcatatagcgaaactcagtgcaacaacgcttaagcactcatcaaaaattctatttgagtactctcaaaaaaaaatatcaagactatactcctagaaatatttgattttggtataaaccatattgacacctcacagtttatgaaaacgtaatgatttggttaagcacatgtacattgggggtggttttaacaacagaactaagtagggggtaggcattcgcagcaaactaacttacaaggtaaaatgtcaaatttcaagtgatttctaaggtgatttttgtaatttttcctatttttgtaaagagaaatgtgtgctgatatgtcatacgtgtggctaattattattttggtggtatgaaacacgggtgctggtatgtgtgacaaattattcttttagtgataacctacgtactagttaataccaagatgtttatgttaactttatcaatctcaagatatatcagtcattctctcagttgtaagaataaggtgtacatgtatgttcgttgcacatttgacaaaaaaaacccttagatttgagagactttttacatggctagaactgtatcgagattcaagcattaatagtaactgtatactctcaacccctttttctcccacacattgcttggcaaaatgggaagaagcgagctcactggtgatgcccaccccacctccaaccctggtcggcgcctaatggcgcgaacggcacctgctaggcccgcccactcggcctcttcctctcccttgtttaccttgcccctatctccgaagccggctgcgccgcttgctcgtgtccaccgctcaccgccgccgccggtcttctgcctcgcacagctaaaccttgttggttgggccaccggtggaacttaaggagaaggagaaggagtcagcacaaatcttagcatggacccggtggcccaaaatcagatttctgacagaaatcccgtaaatttttgttgtactaaggcgcgattaaaaaaaagaagtgtatttttccagaactcttcatacgtaattatttagatcgtatatatacaaaaagataagcacacatgctgtcaagagcttaataagatccactcccttgactaataaagcaattgtcaaggtagaaagccaaaagacattggaaatttagtatccagatgcccttagatttagactctcgggcccagtttgcatggagagagacgatcgagtaacagtggcgagcagatatgcctataaatacggccacccctgaacaccatcgaacatgcagcaagaaagccag

SEQ ID NO: 103 - DNA, 194 bp, Oryza sativa
tacgtagctaatacagcccgatatatggcgttatatgtaactatatctgtacgcccgaagaaagaagtaacaaattaagctatatacctctcaagatacaatgtaattaaggacctagctagaagatatatatatatatatgctgcctatatatatatacctcctatatacggacatatataattcaatttagt

SEQ ID NO: 104 - DNA, 1501 bp, Oryza sativa
aatttctattagaaattacttcacatacgcctagttagcatcatggattcatggtttccccaaaccaagccaagaacacaaacgaactgtacattcacaacgcggatcaacgcctataactaggaacttagggaggcccggagttgcgaacttgcgattcccaggaagaatcacttggatcaatcaatgaaatatgagcagagaacaaagctagtcacaactagaagcagagcacaacgacgattgaacacaaccggatcgaaaagcgcttcaactaaactatgtgttcacaaatccaacggaaattcaatttctagccatcatcacttcacatgcgtctgagccagttagcatatcatagtttccccccaaaattaagccaagaacacaaacaaactgcacattcacaaacggatcaacgcctaactaggagggatcggaggtgcgattccggccacgaaggattcacttggcgccggcgggcgcggccggcgcgccgaccgccttgccgcggagcttgacctcgagcgcgcgctccatcttggcgagcacggcctggacggggacggccttgccgctctcgtactcctgcaccacctgcgcccgctcgttgatgcgcttggcgagctccgcctggctccaccccttcgccacccgggccttctggatcgcgccgcgcacctccgcgcccacgcgccccagccccgccggctccgtcgactcgtccagcttccgcgcgggcgccgccgcccccgccgccgccttgttcgtgcccgctgccgccttccgcaccgtctccaccggcgcccccgtccgcatcgcctggttcaccgccctcgtcgacttaaggtccgccgccttcggcttcgtccgccgcagcaccaccggctcccagtcctgcgtgatgttgccgctcaacctccccgtcggcattgctctctcccctctcctccctctcttccacgctcttcttgtgtatgtgattttgacgatgaggaggtcggagaaggtggagggatttatagaaaggtgggattcgggaaggttcaagaggctatagggtgttctggaaggttccgggaggggtggttccgttgtttttgggccgttgatttgagttgtatgggggaatcgggtggctgaggatgggctcacgggaacttggttgccacggaaaggatactgggttcaaacaaactgttggcgaccggcccaccaagcccaggaaacttggcggttactcctctactccctccgtcctttaaaaaacgaacctatcaccgaatgtgacatattctaatataataaatctgaacatatgtatatttagattcgtaatactaggatgtgtcatatctgatactagattagttttttatgggacggaggaagtagtgctttgcgattcgtgctcccccaccaagagatgcttcatcaggaaggtttggaaattccgtgaatgaaccgcagaaagtttatagcctgcatcagcatatggtca

SEQ ID NO: 105 - DNA, 1501 bp, Oryza sativa
tgcgccaccgccctgctccggcaccgaagcctgctccgccgccgtcgattgcgccggcgccgtcgcctgcgccgcctccaagaagctagggtttcggtgtggggaacgaatggcgaccgggttgttcgagccggaccggagctggtctaagcacacgtgaacacgagggcagaaacgtccatacgaaaatacggtaccctaaaacggtggcaaagcgcgcgcagggcgtacattatggcatggttccaatttgacgaaacagttgtggcctgcacccggattccggaataggtgtagcatttttttttttgatttgccacaattcgcgtggcatggatccaattaacccttctctatatatacatatcgatgatgaattgaaaaagagaccagatcccaatccttgcaagttcttcaggtaatcacgtgagtgcgcgaccacactacatgagtacactccttgactcgtccgtttgtttcccatgtgcgggtgcctgtcaggccttgccgtcttggagtaaagtaaggtgatggaaatactccctcgtctcaaatagaataatttcccttttttaatgattattaaggagatagcaaaagtacaagtgatgaaaaatgatgataggagataaaataatgtattactcctttcatccgaataaacaaacctaatacaggggtgtgatatgtttgtttattttagaacgaatgggaataatagatgataggtgaggattaagtaaagtaaaaataggtaggtggaggaataaactataaaagagtggataagcgagatataaggctggctcaaattattaccaaaataaacatttctagaattttggtaatgccaaagttttggtgagttggtaatattatcaaattttaataggataggatagatgtattgttaccaaaattatctaggcattaccaatgtttgggaataaattaaatgtatccacgtatttctcaattttaccaaaaagatttaaaataacatcaacctaatagactcataaagtatactccctccgtcccatattaaacgtagttatgagtttccttgtctaactttaatcatctgtcttatttaaaaaattttatgattagtatttttattattatcagatgataaaacattaaaagtactatttttcaaaaaaaataaaataagacgtacaattaaaatttgacaactcatgtttgcgcttgaaatgggagggaggggtgggtacatgggcaataaatgatcatcttcagattataaaatcatctataatttaggataaatttaaaggactagctagtcagctagaccagtcaaatctgtgaatgggaaaaaaaactgtcaaatttgaaggacggctagcccaactagcacctggccagggcagggcgcacgcttctctttaaatcggcgtatcgcctcgcccaaatcaccccccccccccccccccccacagtaggactacgcttctcgcttagcgacgcaacagca

SEQ ID NO: 106 - DNA, 1501 bp, Oryza sativa
aggggagatggcgacggcacgcggcgcgagcgacgacgacaggcgacacgattggtcccatctgttcctccgcttcgttgcgggcgccgtcgtgggctggggctggttgtcgcgcatggcgtcagccgcctcgccgccgccgtaccccgccaccactcgcctcctcctccaccgccgccctgccccaccactcacctcccggcgctcgctgcctccgctgccacctcgcctcgccgccgcgcttgctgcctccgccgtcgccgaccgcccatgccgaccacccgtccccgcgccgtcctcgccgtgcgcgctgcgcgagccacgagagaaaagagcgagcgagagagagaatagagagagagagaaagaagagtatggcaggcgggtcccataatttttttattaccaaaacgttgactggattgctacgtgtgcgtcacgttggacaaaaccactctgaattggttcgaggggggtaattcgtccggtttgtatagttaggggtgaagaatgtccggttttgtggttcggggggtaattcggacgaccgttattgttcagtggtgtaattcatagtttttccattttaaaattctaatgccacgcggaacaaagaccatgtcaaaaccgccacgtagacgccacgtcatcgaaaccgccctttaaaaccgtaaagagagtcaaattgtaccggttttaatagttggtggtcgagatatccggtattgtggtttaggatacgaatcagaaataatccgtccgcatccgcactggcttcgaatccacttagaaaatatagtatagaatatcgtatgacaactatccatccgaatctgatctgttttcatccctctagacttctatcttgtttttatttccacgtccgccactgattgactataaagcgaaccaacctgatttgtgcccagtgaccatatgctgatgcaggctataaactttctgcggttcattcacggaatttccaaaccttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgataggttcgttttttaaaggacggagggagtagaggagtaaccgccaagtttcctgggcttggtgggccggtcgccaacagtttgtttgaacccagtatcctttccgtggcaaccaagttcccgtgagcccatcctcagccacccgattcccccatacaactcaaatcaacggcccaaaaacaacggaaccacccctcccggaaccttccagaacaccctatagcctcttgaaccttcccgaatcccacctttctataaatccctccaccttctccgacctcctcatcgtcaaaatcacatacacaagaagagcgtggaagagagggaggagaggggagagagcaatgc

SEQ ID NO: 107 - DNA, 1501 bp, Oryza sativa
ggtggatctgtgtatgaaggagttacaaagagctggagagcaagagagttcaaactctagagaccctcttcctctttctcttctctctgagctcccgtcttcccttctcttctctctcttttcgcccccttttcttaagtgggcaaggtcctccttttatatctcaaggggataccacatgcaccacttctacctactcttcttttgagtggggactcaccctatcttcaaaaaaaaaactggcttgcgtcctcgcctagaagctaaatcatagcttgtctttgagtgaggcccagcgtcatcactcgcctgacaccggagatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagctgggactgacgtgctaactccaggagttaacacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcagggcgccccagccctcggggccgaaacgggagcggcccaacccctcggggagacagagggaggggcggccacatcaccctcgggcccgactccccccgagggggtcaggccacgtgggtgaccgcggctgccccaaacctctagtcaagatacccccggtcccatgtcaccgacagtagcccctggcgttatgccagggcgatcgccctcctcgaggaaagtgctcgggcatgacgccactccttaggcctggtgacaggcggggccggtctctacaggcgggcaggaatccagtggtgcacgcatcggcaagggaaaaccgaccgacaataatgagcggctttcttcaagaccgctacattacttgagtagcgcgcgaatcgggacgagccggttcgtttcgcctggagatgtgatgatggtgcatcggtcggcgagcgtagttaacgcgcgcacgatctgtcccatctcgactgccacggccgcacatccacctcgtgcgccgcaaacgggcgagcgggattagtggaggagtgggcgcgagaaacgagggggcgagatagtgggcgcgggaagcgaggagccgggcatagcgttggcaa

SEQ ID NO: 108 - DNA, 1501 bp, Oryza sativa
ccattggccggggccgcgccaaggagaggccaggcgagcttcccgaggagccgcacccgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgatctcttctctcccccctttttcttttttttttttgcttgtctcgctttttatttttttgctacctttacggttgctgggatttgggggagttggtggttggttggttggttggtggttgcgtgaatccgaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacgaaatatgcacgcatagctgttcccctttcgagctaattcggttcatcgatctatcgtttttttacctattagatgcagtatgcctccgttgaactgcagatctagtcatttcgctgctgttcatgttgttttgaactgttagtctgtctgcttgctcttctgtggaagaagcagcagtggcgctgtcgttttcttagcttgaggtctggtggtattggactagatcactggtttggcagccactttcttgttgatttgtctgacggaatcactcgaaaagtaagaaaataaaatggagaaagtactctagtgaaagggggatggactagaatatttagttgcctgagaatgattcctttcgttcatggaaaaggcttgcgcttgttgtctaattgggaaaatgatgtgccatccacttggttggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaa

SEQ ID NO: 109 - DNA, 1501 bp, Oryza sativa
agtatttacaccatcacatagctatggctgccggtggtggatgagtcttctggatcacttgaccttttggttgtgaggctcgtatgcatgtcagccactcaaagttagagaactgtatatcaaagaatttgttttcgccaacgtcttgaacctatacgagtgaagatccagccctcgaataggtggagagtagccaaataacattttatatattcaattttaggtgtggtatatactactcctctgtacttaacatagttataactacactactttatagtataattacatctgaaagtttttggagagcttttctgtcgaaagtcatatacatagtttttgaacaaatactacttcaattattaaaatgttggattttgcctaattgctctcatgccacgggtttaagtgttgttgtacaaatatcatgtccgtcagtgtattaaagacctactcccatatccaaaaggaaaccccgtatctctttttctcctcttctcctcagcattcgtgtttttatcttcttaccataggagtgtgaaggatatataggtaaaagagaagattgtttcttattttactataatattctatttagagagcattttactcttagttcatggtgagtgtcctactttccatgacggtgtaagctggttggagatatatcgactagatatgagaaatttcagttcatttttccaaaaaattccaatcatacaattcaaatgcccaatattccactaatgacctcaagtttcaattgaaattgcaaaaaaaaaaaaaatcctcttcaagatatgaaacaaactttcaacttagaaccatagaaagtatcggctcataatattgatatctcaactccaatcacaaaaactttgtatctcaaaatccaactcaagtttggcatcgttcttttctgaataagatgtatgttttatctctgttctcattaccatgattttcatatcgctaaacggtgtattttgtgcgaaaactttttatatataagttgctttaaaaatatcaaataaatcaaattttcaagcttttaaaaattataacttaattaaccatactaatgtctttcttattttctgcgtcgtgagtttatcttcaatcagtttcttattatttcccccataaaaaaggggacaactttcgtttagcttgagaagggagaagccacgcccagaacgtacgccactgacgcgttgcggtggaaccaccgaaccaacgggtttggcccggacgtacgcaccagaccaggctcgctgcaccaactgcgccaaaaccacttcggacttcgcgcagcaagcagatcgcgatatcgcatcgcttcgccgtcgccgcccgccccaccggatcccgcgcagatccggacgcccagatcccacgagccccatggaggcctcgccggccgcggcggagcgcgaccgctcgccgccgccgccgccgcctcccccgcccccttcctcgtcggccgccgccgcagcggcga

SEQ ID NO: 110 - DNA, 1501 bp, Oryza sativa
tatattaaaatgacaacataattttaaattttgtactaactttatgaaactactaatgtgtaatattcatattgtattttatatacgtgttacttattaattatttttatatcaaattttagttatttctaaaatatattcctatatggactctacacttagtctttcaatatttcttattttttaattccgaattttcgttatctgtaaattgaaattgtatttctatatagactatcggctcttcttccaatattatttatttttaattctgaaattttatattttttctaattgtatttatatgtactctaaactcatctttcaatattatttaatttttaatttcgaatttcaattacttctaagttctaaattgtattcctatattgactttagactcttcttcccatgtttttttatttcaaattttagttatttgtaaactgtatttttatatggactctaaactctacttttaattttattatgtttattccgaattttagtttgttttagattcctatatgaactctatactctacttctaatattctttatttttaattctaaatttctattatttcttaattgtatttctatatatactttatactattcttctaatatttttttattttttaattctaaatttcagttatttctaaattgtatttctatatggactctagtcttctcttacaatattccttattttttaattccgaatttcaactatttctaaattgtatttctatgtagactctgtttctttttctccgattaatatgagaatttctaagccgtgaaagcgaacgtggaagctctttttttctattcctttaataaattaatagattttccatactgattagtactccctccgtactcgtaaagaaagtcgtttaggataatgtttaagtcaaaccttgagaatataaatcatgaataactctcaagttgttgagtttaaaaatgtgaaaattaaatgaatagatttatcttgaaaaatactttcataaaattatacatatatcatttttcaataaatgtttttaagaaataataagttaaagttgtgttttgaaaaccgtgtcactgtccaaaacgacatcctaatacggagggaggacctgacaataccatgtgacaaaccgagagtagcatttttcttgtaaagcaagcactgtagcattattctgaccctaaattctggaggtgattagagcccctaaatggccggatccgattcgtccatctctgcatcgtgcggtgggcaatccctttcacatccagtcatcaacaacaccacacacaccctcacacacacgcacacgcagagaaaaagaaaaaaaaaagaagaaaaaaactaaagaactagtcgtagcggccacactacaatttacaggaaagaccttataaaatccaagagaacggtcaccgcttgcttccaagccgagcccagccagcgaagcccaccaccaccaccacccagatcccc

SEQ ID NO: 111 - DNA, 1501 bp, Oryza sativa
aacacccagtccacctctcccaagataaaagcaaggtcgagttctcttttccattctctgtagttatctcctgttagggtcggaatatcttttatgtaacccatcaaggagtagccacctgagataatcatgtattgtgagaacaaaattaacaataaaaaatattatgtattaagtctacatcaccattgggcagaaaatagacataacacatagagccataactataacattgcaattatcaatgttggtccgaaaattacaacatcatagcatatagttaatgttcctaaaattaaaatctcccgttgattcgaaatttaattttagaaacactaattttcatcaatttcatctatttgcagcggaagatctatatacaattcatataaacaataaaaaaactctattatttactctgtaaaaattctcccgttggttcaaatttaaacagaggtaaaacatgcaaaaacaattcaaattctattgtaatttgcatgaaaatatacaaaatacatgttcggaagcatttctcacatttatctattctctaaacaattttcacattggttcaaaatgcttagaaataaacacaatcattaaacatattgaaaaagcttctgaaatagggacatttgttaaacttcttttttcttcggccgagggacctaaaataaacttattgcggcgcagccggtcggcccacggcatgctttcacgcgcgtgggtgccccctcccccccccccaggccacaacctgggcctgggccgggaaaggagcccccggcgcgcgccctcttgggccaaaatcagcccagccatcaccgaccgtccgatcgctagggtttcgatcggacggccgagcgccactttcggggaaacaaaaacacccacaccacccagtccgccggccgaaaaccctagccgttcaccggccgaaaccctagccgcggtggcacggcggcacagcgcggcggcacggcacagcgggacggcggcacggcgcggcggcatggcggcacggtgcagcggcggcacggcgcggcggtgctgtcgcaccccccttcgccgacatgcgcactcacccaagagtgagtgcgccaccgtcaagcggctgtgcagcggcgcccggcgagccggcggcgcggcgccgccccctcttttctctcccgcgcgcgtcggcagccggcgccggcggtaggtgagtctcttttcttttcgacccgtacggatcgtgtgctgttcttttcttttgatctttggattttctttcttatatgtggatgtctatccccgaaccgatctaagccctagggttgctctgataccattgttagggttgtctattggatcacctaggtttagatctagtcaggtagaacactttggatggatgaacaacaatagatgaattaaaaaagagggagtgagagggtttagggatgtgaccggtcaatgttgaggaggaggatgtgcggccggccatcgtctttgtcgtcgc

SEQ ID NO: 112 - DNA, 1501 bp, Oryza sativa
gccagtgacgggaacacgccaccgccgcgccacgcctcgtcgtcgacaccgccgctgcatcaccgccatcggcactgagttcactgtcaccgccgtccacgtcaagcccgcgacgacaaagacgatggccggccgcacatcctcctcctcaacattgaccggtcacatccctaaaccctctcactccctcttttttaattcatctattgttgttcatccatccaaagtgttctacctgactagatctaaacctaggtgatccaatagacaaccctaacaatggtatcagagcaaccctagggcttagatcggttcggggatagacatccacatataagaaagaaaatccaaagatcaaaagaaaagaacagcacacgatccgtacgggtcgaaaagaaaagagactcacctaccgccggcgccggctgccgacgcgcgcgggagagaaaagagggggcggcgccgcgccgccggctcgccgggcgccgctgcacagccgcttgacggtggcgcactcactcttgggtgagtgcgcatgtcggcgaaggggggtgcgacagcaccgccgcgccgtgccgccgctgcaccgtgccgccatgccgccgcgccgtgccgccgtcccgctgtgccgtgccgccgcgctgtgccgccgtgccaccgcggctagggtttcggccggtgaacggctagggttttcggccggcggactgggtggtgtgggtgtttttgtttccccgaaagtggcgctcggccgtccgatcgaaaccctagcgatcggacggtcggtgatggctgggctgattttggcccaagagggcgcgcgccgggggctcctttcccggcccaggcccaggttgtggcctgggggggggggagggggcacccacgcgcgtgaaagcatgccgtgggccgaccggctgcgccgcaataagtttattttaggtccctcggccgaagaaaaaagaagtttaacaaatgtccctatttcagaagctttttcaatatgtttaatgattgtgtttatttctaagcattttgaaccaatgtgaaaattgtttagagaatagataaatgtgagaaatgcttccgaacatgtattttgtatattttcatgcaaattacaatagaatttgaattgtttttgcatgttttacctctgtttaaatttgaaccaacgggagaatttttacagagtaaataatagagtttttttattgtttatatgaattgtatatagatcttccgctgcaaatagatgaaattgatgaaaattagtgtttctaaaattaaatttcgaatcaacgggagattttaattttaggaacattaactatatgctatgatgttgtaattttcggaccaacattgataattgcaatgttatagttatggctctatgtgttatgtctattttctgcccaatggtgatgtagacttaatacataatattttttattgttaattttgttctcacaatacatgattatctcaggtggctact

SEQ ID NO: 113 - DNA, 1144 bp, Oryza sativa
acacacacacacacatatatatatatgtgtatatacgtgtatacgtgtatacatatatacatatatatatatatacatatatgtgactacattcattaacatctatatgaatatggacaatgatagaaaatcttataatctgaaatggaggtagtagtatatataatatttcactggtgaagttaaatgcatgtagtttgtacgagcaaatgtgcatttgcaatatagaaatcgtcggggctgcttttttgagctacacaacgatgacacatgctttgagctccagtcatatcgccgtaagtgtttattttttttattcgtgtggcttcttagccgggttttcctaattaatacatccgtctcttaatataatattatttactattttgttgtagcgtttgatcactcgtcttattttaaaaaattgtacaaatataaagacaaaaaattgttcttaaagtagttaaatagtgcaattaaaatgttaaaatattatattagagtacggagggagtagtgtgtttgtgagatttttggttcggattttcttaaacactatgccaagtctcttactgttaaacgaaaacagacgatcccggccctatcctcttttgatcatttttttttaaaaaaaacatgtatagcaagagttaatgagagaacaatggatagaatcaaacaataaacttgaatgaattaaagaagaaatgtcgattccttcatgctgtcgtggtgatcctcaattcctcactcatcaaggaagcttaagtcgattagactggacatttcacactgctacagaaccagctatctatctgtcaggctgtaacgagtcaagtaggaccgtcgtatatagtggttggaacttggaactaagggccgttataaatagggttaattggatccatgccactataaatagaccaaattaaaaaaataccactactattccgatatcgttggatccatgcatcgtcccggagggaagttgccgtcgcaggccgtcgagacgaagccctgtgcgtcgtctccccctttctgtttcgtgtggtagccgcccctagtgcctcccttcgcctccagctcagctccagctccgccgttgactctaccgaggccggcaccgggttcttgcattccacgg

SEQ ID NO: 114 - DNA, 1501 bp, Oryza sativa
gaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtagccaaggaacttttatttcattttggatggcgtagtacctacagaatttcgtgatagaatctacgtgattttgaaaaaaattattattttagtagatcatatcatcggcagaagttgagggtttgtcccatctcgccttttttaacttttctgttcacgtctgaatttttttggctgtgtgcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttcttttcaaacctctgaagaaaaagttcagaaaagacatggagaacaaaaaaaaaagtgtactcctagctaagtagcgaagctaatctgcttctataaatacccagcaaggcatgccgtgtcacccaccacacgcacacagttagctctagctttgcttgatttgcagcagcagcagcagcagcagcagctagcttgcatccatgg

SEQ ID NO: 115 - DNA, 1501 bp, Oryza sativa; identical to SEQ ID NO: 88

SEQ ID NO: 116 - DNA, 1501 bp, Oryza sativa
atgaggatattgccatttgagtcatctcagcacataaaataaaatctcagaccaatactccctccgtttcaaaatataaggatttctaggattcaaatgttgtaccacaatataagcatttctgcactgattcccatcacttcaatgatcgcagagccaatcagatgcttcagaagggaatctaagaaaatcaaagttcaaaaattgacaactgcaatgaataaagaaaaaaaaaatcttttgacctaatcttagtagagtacttgctaaacaacctagaaatccttatattttggaacagagggagtagctcccaagagatgcattgcattatcccaaggaaggcagcatggatatttgtaaaactaaaaatctactaaagtgcactgccatgtagattcaataatcaccaagccattcctctatatgaaatacgatactgaagcacgacacagtgaaaccgtccttttacctaaaccacaagactggattgctccaccgcacaaccatatatactcctcgcgtaaatcaaactaaactatatctcctaggattactacactgaatgaatcgcattatggattttagatacttgaggggaaacaaaatcggtcgcgactgaaacagacgagcccagggtttcgcgcgagctagagggtagagcaatcggccgcacctcagccgtgaccgtgtaccgcgtctccttcccttcgatatctgcgccgtaaaaaaagagaacgaaggcatcagccgcaagaagaacacagcccagggctttgcagggagagagatggggaagacgacgacctttggccttgcgcttgaagccgcagagggggcaggaggcggagcggacggagtcgaatttgaggagggtgccgcacacgccgcagaagaggaagtcccgcgcctgccagaaggccatgccgccgccgccgccgtcgccggcgaagtgttccttctcctctagtctgtggttggctggcgatggtggcttgggccgatcaaaacggcaggcgtgttttagggttttttttttctaggtgggctcatgggatgggctgatgggcctacgaactcttgtttttctcgccgaatccttttgggaaaagtacaccgaaggtccctcaacttgtcaacgggataaaaaaacatcttaaccgcaaaaccagatatacagggtctcttaactgtacagaaccagaggtgcttcggcggttttgatcccggatttggcctacgtggtggctgagttagcgtgggacccacgtgggtcccacatgtcagtatatcttttccctcctctcccttttctgctgtttctctctctcacacactcttctctccgacggccgacgatgcagcacgggagaaggggagggtggcggaagggcgaggcggcggcggcgggtgaacgcggtggcgggctcgtcctccccgatcacactctccggcatggggaaaggatggcgcaggcggcggaccgcgcgggagaccagcg

SEQ ID NO: 117 - DNA, 1501 bp, Oryza sativa; identical to SEQ ID NO: 89

SEQ ID NO: 118 - DNA, 1501 bp, Oryza sativa
tttgcttcccaattggtacttctcgagttaaaaaagaaatattaagcatggaattctcaacaatgcaatgactggctaaggcccactgtgcttatctttttaattgttgcagaaatgtaaacttagaaccattgcattttctttacaaatcaaattaaggttagacaaaacatggtatccaactgttatgtatttcacaatcgttctatcttttctgaatgcaataatattgccgtttgcatcttaaattaaaagaaaaacatttagccaaacacccgaacatctaaaagcagttgaaccaaatgagaatatgataatccacctcaatcgaacaggagtctaagtcagctttgcatgccctaaacatgcatttttatcgtagccatcctatagatggaccatggcaaaacagaactacagaacacattcccttgttcttgaccccatacataattgatagtaactgaaatcaattcactatatacagatcctgtgagttctgaccttagaaactttctttcttgtcactccatgcataactctctatctcatcaatgaacaatgtaagacatgaaactggtgctgaacaggtttctgcataataggcccctctgttcatctcttggctacaagttatttaatttggatgctttagtcctgccaataagtcctatcatatctctatctgaacttggaagccttttttctgaaaaaataaacattgaaggcattttttctacttggtccatcccattttagtgggcaaaatggcatcaagggcggagctaccattgaaacaaggtggtgcactaccatcgaaaacctagaaaatttcgatggaactgtgcattctagcgtttataagtgagaaatcttggatttaggggggtgggggggggggtgggtgggtgcttgggttcctgtgcaccacccaagcttaatgtggctccgccactgaatgccatgtgggtttgaacagcatgaaccatgtgctacatattaataagctgacacaaacattttaaatattactaaatatgctattggaattatctttaataaggaatgctttgcaactccattttttttctttgtgcttatgcagttgctacattatgttagttagccttctagtaataataggtaaatcttgtgatttgtggcataacattttctctattgttttctgtacattagttatgacttgcctttgttcccctcaaacaacacggttcttctgttatttattacatggatagatgagcatgccaatggcctggtgctacagctcatgaggaaactttcgaaatataatttaaatacgtgaatggagtgtgctcattctggaaagctgttttgacttgtgttgatgcaaaacattgtcggatcggttactacactccaattttatgttctctaaacagattaaatattattcttttttgggatttcaagcctcatgagtagctgcatacagaacaaatctagtaattcatttatt

SEQ ID NO: 119 - DNA, 1501 bp, Oryza sativa
gaggagcgggtggcggcggagctcctcggcaaggaggtgtcggtggaggtagggatggcaatgggtcgggtcgggcacgggtagagcaaaaccatgcccgacctgatgcctaatattgcctgtccaaaccctacccactagagttagcgtgcaaaactccgtgcccgtacccatgcccggtgggcgcgggtatgtccggcgggtacccaatggatctcatataaataataacttaaaatatatataatttaagaaagaaaaataaaatcaataatttacgaaattattggttaccaacaataatttgaattacatcacaacttagtatcagttagcattacaaatgaaccaatagaaagggtataagaattaagaaatgagtcaaaattagctaatacatatgtatcgggtcgggcatgggttacccatgggtaaaaaatgaaacccgcctgttgcccatgacgtcttcgggtatcgggtgggcgtacccatgggtaaaaagtcacactcacacccatgcccatcgggtcgggtatctgtggatacctggacccatgggtaaaattgtcatccctaggtggaggaggcggataacctctttgaatttgctcgatgcgggatgcggcgaggcccaagaagagcgtagcggaggagaagtcgaagggggagaggaccgggtaagaggcgaaggtgttgagtagggaggagggatcgagggcagagaggaggtggtcggggatggcaacgataggtcagggacgacggagtggaggaggaggtgttggcgatgaggtccatggaggtcggcgagaggagtagcccgtcgttggcacggccatggcccgcgcagtggttggcacatgtcatgtggacctacatggcggtggatcccacaattttttttgtgtgaatgacaaataggacccatatatttttttaattctaatgctacataagtgacacgtcaacaccacgttgtataaagaccagttcaacaccgtcacgtaggcgccacatcagcgaaatcgctctgcaaaaccgtcaagagagctaaattgcaccggttttaatagttagagggttatgatatccggtgttgtagttcagggatatgaattagactcatccactagttaagggagtcaaattggacttaatccaaaagagaacggcccatgaaacaccaaacggaaacagcacgctcggatctctttcccttcccttcccccgccacgcggccacgccaacccaaccaataagctgtctcccgtggcacatctccccaatcgcatcacgccacgtcacccctctgacgcgcgcgaccccttctccttctccccagttgcgcccccgcttctataacacgcgcctccgccttcctccccgcggcaccgatctccctcccccctcgccggcggcgcaccgaccgaaccgaaccgcgccatggtcaccgcgcgcaagggccgcggaggcagaggccctccccgcccccgcgtcgtcg

SEQ ID NO: 120 - DNA, 1501 bp, Oryza sativa
gatgcagacaaagtttttccacaatgttgtagtccaccattaccctgattttttcgaagtgccgccaacactccgctctctctgtagatggtgcggatggctcggcctcgcttcccggcatgggcaagactgtgtcatcgttggccttagggatgggctgttccgtaggatcatccccatctccctccaaaccatccatatggcggtcatccatcctgtagtcgtccatacccggggatagttggtgggcatcgaccgacctatggtcaagactaggcgagcattggcggcgtctttgcgggggtctcgacgaggtcgacctccgacgagtatcaccccacatttttgctgtgggagggaaataactatgttgctctgtttattttgtgctgcatttttttgtgttgggaagaagaggaggaggaggaatttatagaacaaattgccctcatgagctagttatttctcgttgcacttacacacacatgacacaccacacaatacacgtgctgcctgcaggctccacggaggcacatccaatcaccattagccatgcccatattctctgttgccaggcgtcccatctccatctcaatccaaggcaggcgccttttctccgcggctgcacgtgcacatctgcacaagttaaaacagcaacatgcaaacatgtattatcagctacagcgtgcatgtgaccacatacaaaatatgaaattggggccataatagcaaacgcttacggcgaatggcgatggcatgccacatgcgggcaggcaaaggcagggcgcaggagcagcagagcaaggctgcaagggaatcacaggcacacacgcatctactacctagtccctaatactaggtcgagcgtttgtccagtggtagatggcaggatgtgtccgtttggccgtccgccgtccccatccccagtactcgattgcgtccattcggccgggcggcgtcacttgactgcgtctgcgcggcgccacggctgtgtctcttcggccggccgcctccattcattgcgccaatgcggaagggaatcgccggacaccatcgcatccttgcaggagatcctctgaggtacgaggagagagctataaatcagacgtccgatgtaaaaaaaaatcggacggtcaaatgtttcagttgaccgttggtgcaacattaaattatacgtggtgaaacagaaaaatgagcctatgaaacatattgaaattttgtgaaacacaataagaacacatggtgaaagatataactatcacgtatgaagcattaagcttttattgtcaaaacatatatttttctttcatcagaatataatcatgtgatatcttgttgtaaagatttaattataatgaattcaacggtgtgatcgaatcgttcatcggataagtagtttagaaggaaaaatattttaatatcactaaatacttgcatcatgattcatgcatggtgtgggagaaagccaatagatggcgagagagagagagtagggacatga

SEQ ID NO: 121 - DNA, 1501 bp, Oryza sativa
cggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgtttcccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatggtggctcgcgcgcggttttgccgcgctgctcaggtgtcgggtgcagtggattggatccgactctttcaccgggttaattgcagatttgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagc

SEQ ID NO: 122 - DNA, 1501 bp, Oryza sativa
tatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtacttccgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgctcccgagcaccattagagagagagagagagagagggagggagggagggaggcgggcgcttacagggtttcctggaggacgccctgggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtggccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagca

SEQ ID NO: 123 - DNA, 1501 bp, Oryza sativa
gcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattagctaattttgactcatttcttaattcttataccctttctattggttcatttgtaatgctaactgatactaagttgtgatgtaattcaaattattgttggtaaccaataatttcgtaaattattgattttatttttctttcttaaattatatatattttaagttattatttatatgagatccattgggtacccgccggacatacccgcgcccaccgggcatgggtacgggcacggagttttgcacgctaactctagtgggtagggtttggacaggcaatattaggcatcaggtcgggcatggttttgctctacccgtgcccgacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattca

SEQ ID NO: 124 - DNA, 1501 bp, Oryza sativa
gctgactctattgccatgacagtattcaggaggctagcttgcttagctacccgtgtgtttgtgtattgccgcttgcttaataccgacctatactaatgctacgtgcttatatagaggtggaaagatagtgaccttacgtcctcacgtgggtatatatatatatatatatatatatatatatatatatatatatatatatcgggcaaaccacatatcgtggaaactcgaaaattatcgttcgataaaaaatgaatgtatgagatttgtccatgtcattatgagtaaaaaatttactcccgtgagtaaatctatcaataaaatttttactcgtgatgacgtagacaaatctcatatgtcaaattttcaattcaatggtagttcaatatatatattccccttttcgtttagcaccacaaatatggtctcagccatctcttaataaattttgatataagagctatttcttatatctagcgtttttttaagggaggaatggagaaatggattttaagctgtaataatattattggcggacgtggaatttgaaaggtggggtacaaactagaaaagaagcatcaatacattaaaaaaaagttctttatcaaggaaaaattattacaaactacaaagtaaaatattttatgatcaaatatagacgttgatctggagggttttttttgctactttccaattctggaatcaaatatagctgttcttaatccacaaatcatatgcacatgtattatacatagcaaatttaaatgtttttttaaaaaacaaattaggtataagtttatcccggatatgtcccatgtcctaggctatgagatatcatttcttctatgcgatttaaatatcattcatagaaccttttcaaaaatagaaaatataaattattatgttacatatatctatttaaaacagccttgaaaggagactacatgttcgctgtagtggctagaaattaccacattaatcgaagaaaaagagaaaatctacaccattgaattatgatagatctataatttaaccattgagattgattgtacaaatataaaaaagtaagagtcctcaaactttttaaaagaaactacgcagcaaaaattaaaaagtccaagttctattcggactatcaaattccaatcgggcaaggctgacaaggacagctaacaagttcttttttcaaaaaaaaaaaaatcagagaagctcagtaaaaatggaaaatcaatcctcttgcttggtagtctgcccgttacagcaatggctcatacaattaataatatatccaaatattatataaggatatctagaaattaccaaattaataataagtaaagaaaaaaatctgcaccaattcatggtggacatactccctctatcccccctaaaaaggggggcaaactctagctatgaatctggacatgagatgttataatggttgagattgattgcccagaaataagtaccggacaaatcctatgcacaagatgtaaaaatacta

SEQ ID NO: 125 - DNA, 1501 bp, Oryza sativa
tcagaagctcccctaaacagtctagcttttggtctaaattataagaagctgtagttgtagaatccagaaaataaaaagctagaagctgggaaacccagttttttcagattcttagaagctggcaaccagccagctgtttctcagaatcttaagctccctcaaacagacccctagttcatttttcagattctacaactacagattttcagaatctgggtaaaaaactggactgtttgagggagtttttggcaactggagattctaggagaagttgcagctactagaagctcctccaaacagacccttagaatctagatgaaaagctagattgtttgaagagccgaagatgaaattgcagttacaagaagctcccttaaacatggcctgattggctgattatgttgtcaattatcaaaactgtcagctcctcgccatcaggcttccaaaacctgctagtgactggctgtagcctgtagcaactagcaaccggtttgtggtaagtgcataaaaaatcgttgaatgctcgcatggtttgatggtttgaatgctcgcattaagattcatgtgactgcaagccaaaaatctcaccaattcacggccagatcgatcgcgatcgagtgagcgcagaagtttgacactagctccggtcattcacgcacgtgggttttcgcggttgcttccttgctgttgaacatttttttttctcttttgtaactaatagctgttgaacagttatgttgctagcaaccttagctcgcagagaaaaaatgcgtacggtagcaactaactgacaacatactgtcattcgtgctcctttcctgttactactccctccgtcccggattttgagtttttccatactacgtttcaccactcgtcttattcaattttattttgcaaatataaaaaacgaaaagttgtgcttaaagtactgtagataataaagtaagtcacgaataaaataaataataattttaaatttttttaaataagacaagtggtcaaacgttgcaagtaaaaactcaaaatctctcatattatggtatatatattatggtacagggagtactaaacattaacgacgactagttgatccaaattaaatatatattttttgatggttcagcaatactaaggctgtgtttagatccaaagtttggatccaaacttcagtcattttccatcacatcaacctgtcatacacacacaacttttcagtcacatcatctccaatttcagtccttttccaaactttacaacgatctaaacacagcctaactaacaaaaccgttgactcaccaatcgccacacacattgtcgacaagtacaagcgccgtacgcaattaaaccctacctatgtaaagagctcgccgcgagcgctgcatcttgcaaacacacatgcatacatctctcgatccatcgatcgaatcgatcagcttccttctgatctccttcattcccgccatggagagttcgtctcgatctccctgcatttgcaagc

SEQ ID NO: 126 - DNA, 1501 bp, Oryza sativa
tcactttcttcattaacatatatgacctttctataaatgcagctatagtgtggacttttaaagctcgaaagttcttaaaatattatcacacattctaaatttggataaaaggataattagccactgttgtttcccttcatcttttgagggattttctctgaagttgttttagaagggagattttctctgaagttaacagttactacatgaacaaccatctgagatatatagaacgccaagtagccacgtaggatatatatatatatatatatatatatatatatatatatatatatatatatatatctgtgtgtgcgcgcgcgcgcgctgatgaggattgaggagacaagagaaggaggagatagtataacatcatgtcaccattaacaagagaaggaggagatgattcaccttattcaaaaatttatttatttattactttgctataatttattttgtcactacaacttacaagtaagggtggatccatcgtgggtgctagaaggactcgactctctcctatctcgttggatcaccattgatagaatgagttaaggagggggggctgaaggaggaaaaagaagatgagccctccctctaatcatctattttatttacaaatgatcgaacgttttgttttcgctgtgtcgctgacggaccttcactcacttgtcacttaatctctaatgggtaacgagggctctaccggtcagagattatatatagtccaagcccgtcagatggacgtaagtagaaaaaaaatcgtcagaaaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggcaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaacatatgcatctcaagc

SEQ ID NO: 127 - DNA, 1501 bp, Oryza sativa
tataaaagtacattgaaacataaaccagtagatatcactttcttcattaacatatatgacctttctataaatgcagctatagtgtggacttttaaagctcgaaagttcttaaaatattatcacacattctaaatttggataaaaggataattagccactgttgtttcccttcatcttttgagggattgtctctgaagttgttttagaagggagattttctctgaagttaacagttactacatgaacaaccatctgagatatatagaacgccaagtagccacgtatatatatatatatatatatatctgtgtgtgcgcgcgcgcgcgctgatgaggattgaggagacaagagaaggaggagatagtataacatcatgtcaccattaacaagagaaggaggagatgattcaccttattcaaaaatttatttatttattactttgctataatttattttgtcactacaacttacaagtaagggtggatccatcgtgggtgctagaaggactcgactctctcctatctcgttggatcaccattgatagaatgagttaaggagggggggctgaaggaggaaaaagaagatgagccctccctctaatcatctattttatttacaaatgatcgaacgttttgttttcgctgtgtcgctgacggaccttcactcacttgtcacttaatctctaatgggtaacgagggctctaccggtcagagattatatatagtccaagcccgtcagatggacgtaagtagaaaaaaaatcgtcagaaaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggacaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaacatatgcatctcaagc

SEQ ID NO: 128 - DNA, 1048 bp, Oryza sativa
tgcagcccgtttttaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgaccccccccccccccgagggggtcaggccacgtgggtgaccgcggctgccccaaacctctagtcaagatacccccggtcccatgtcaccgacacaccccatcttaaaatatagtaaactaagattggatggaatacatcttaatacaacgaatttaaacagagatatgtatcccatataatccgttgttatattttggaacgggggagtaagagaaattaaggatataggagtaaggagataaatgactaaaatgcctctaataagtgtttcttggctgtatgtggattaggtagttggaataagatagaaaaaaatgaactagagttgattgatgtgaccgtacactactccaagataaatttttctggacgccatcttcttttgtttctatacggcccgtaagtggaactgtatgagaaaatagagggaccggtgccagactgtcgcccacacggaaaaatgcattttcccgtacgggcgtcttaatccaaccgcacgggataatcctcattatcccgtgcggtcgacttaaaagaaccgcacgggaaaatcgtttttcacgtgcggacttttattagtggaccgcacataaaaatacctccctccttttcctcccacccacttcaaattttttacattctctttcccctttttttccttctcacccacttcaaatttttcacaccctctctctttctttttcctttttattctcactgctacacgcctctttcctctctctctctctgtaaacatctgcctctttcctctttcctcccctccccttcccttcccggcgacgccttcgagagga

SEQ ID NO: 129 - DNA, 1501 bp, Oryza sativa
atggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctgggaaggaggtcgccggcgtccgcgcgggagaaggtctccggccgtccgcgcacagagggaggaggtcgccggccgtccgtgcgcgggcgaggaggtcgccggcgtccgcgcgccgggaagaaggtcgccggcgtccgcgcgccggggagaaggtccccagccgtccacgcgcgggggaggaggtcgccgtctgtccgcgcgcgggggacgaggtcgccggcgtccgcgcacggggtagaagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagggacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcg

SEQ ID NO: 130 - DNA, 1501 bp, Oryza sativa
tagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgggagcggcagatgggccttcctcaagctcagtggcggtggcggggactggcttgatctcggcggcgggagcggcagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcatatggccaggttctatcagaggatgatcgacatcgagaagaacaacatcaaacaaatctcctgaccccgcgtcctgtctgatacaccttctttttgctacctttgtttcatatcataagccgtttgattttttttttcttaatgaaaattccttgcctgcttgcttctttcgtccccacggatgacgccaaatgttgggacaaaattcaacaagcgtatgtgtatcacttctgtattcaatatgcccagctgtgagcaatgtttacatatttatacaaggatgtacaaggggaaattacatcgctaccctaatcgctgatttatctaggcggctggctagcgggccagctttagggctctttggtcagctcctcggtgacaggagggctgcgcccattaagggagcggcgccgattcccgaaggcgcctgctattactcgggtaaaggcgtgctctgggtaatagcgtgcgctgtctgccctcgtcagcggcgtcagaggtggttggcagatgcgtagtgcgtatttatggcgtgccactacgcatccgatcacccatcttatgcccagggctcttcaagccctagcttcctctggagcccttgaacagcttcggagggcctggaaggctttggagtccttggatggctccggagcccacgaacagctctggtggccttgatcggccccggagccattagatggctccgaaggccttggatgaccccggagcccctaggtggctccgaggacccgtgttggctcccgagctagctccggagcctaaatcagtagatgcctccggtcattctcctagggtggatggctccggtaggtgctgcat

SEQ ID NO: 131 - DNA, 1501 bp, Oryza sativa
ccttttgtgaaggttggccaagtaccaaagagttgctagactgtataaaagatggccacctatgtttgcacaggaacatgatgcatctgatgagttaaaatactatgacgatagcgtacttcaactattacatccgttgcatatacaagagttcaattgttaatatgttctatctcttaccactagctaaatgaatcaactgaagttttataatttaactgtttcagtgaccaagaatggaaatgcagcttaaaaaatccacatttcttattaattaaaatggttgcaagttgtaatgtcagtttacccatttaaaggattgtacagaattcgtctccaaattaagtaactttggcttttctgtctccacctcttccttgtgtccttaggagatctattctaagctgaattatcgatgtcttgtttgcggtcactactgttttataagtgataaaaacaatgatagtttttcacatgaactttgtaatgaggaatataatgggtgtgctatttcacgtgtgttaggatctacgaaaggaaagttctatttgtatgatgttttcttagtggtgtagttgacatacccatgagaaaaaaaaaagaaagaaagaagaaggggtttaacatactgtgtatcggatgggacgcggggtcggaagatttgtttgatcttgttattctcgatgtcgatcatcctctgatagaacctggccatctgcgccttggacttgcggaaagcgggcttatcctcctctctgaagcagtgaacctcatcgctcatgtccaagctgtccgcgagaagctcctcccatgtcatgggcctctttctcaggcaaggatgaggtagcgtgcgagggatcctcctccatctcccaggcgtcctcttcctcctcgccggggcttcgcctgaccccgccgccgcaactgagctcgacccagctccatgtcccgctcccgccgtcgccgagatggagccagcccccgcccccgccactgagctcgagaaaggcccatctcccgctcgcgccgccgagatcgagccagtccccgccaccgccactgagctcgagcaagccccatctcccgctcctgccgccgccgagatcgagccagcaccccgcaccgccagagagatcgagccaactccagccatcacagagtccagccactcccgcgcggtgatcgggacggtggatccctgacgaacctggaacatggagtaggtcgccagtttctcttctatggtgggcctcctcatctccgcccgcgcctcgtcgctgccgccgaatcgcaatcttagggttaggtttcttccttctggcgaactctcgatggggaaagaagcgatcaggggagacgaaaaagaaatttatccacgtcacggaataggatgcctcgcctgggcctggcccatgggcgccgtggcccggtgggaaaaaaaaaggaaaaattatactttgactccctcaactagtatgattcatatcctcgaaccacaaaa

SEQ ID NO: 132 - DNA, 1501 bp, Oryza sativa
tgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctggggaggaggtcgccggcgtccgcgcgggaggaggtctccggccgtccgcgcacagagggaggaggtcgccggccgtccgtgcgcgggcgaggaggtcgccggcgtccgcgcgccggggaggaggtcgccggcgtccgcgcgccggggaggaggtcgccagccgtccacgcgcgggggaggaggtcgccggccgtccgcgcgcgggggacgaggtcgccggcgtccgcgcacgggggaggagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagcgacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtga

SEQ ID NO: 133 - DNA, 1501 bp, Oryza sativa
acattctacgggccatgtagcggcccagcccattagtgggagcgaggcaattgcacgttttaccgcggagaggagcgcggtggggcgatctggaccgtcgatctgtagatcaacggctgaggacgggccagcgaggcgctgataggatccggatttggtgtgctcatcccgagacgggtcgagaagtgggggagagagagagaggggaggagatggcatataaaatgggcttcatcttcttcttcttcctctggctctggcttctggtggtgggggggaggaacaggaagaacacggccggccacaaaggcgtcccgattttctctctctgggttccgtactcttctcaccgcagcctgaggaatccattttgtcggttcttctcttgatctgtcggtgttcttgaggaggaggaggagaggagtgaggaatctttggctttgtcaggtgaattggagcgaggtgttcgcaggtactgcccttaacagtttgattcgctgcgtttttggttgtctctgtggtgttttgtttggtaaaatttttggtggggattggagttggaaaagttttactttcacagtgatggataaattttcccttctgaattgttgtgagttctggcttgtggtttgttcgaattctggattcttcggttcttgctaattggttgtttgatctggaagattcagttccctctttattcccccgggattaaattcctttttgcggctgctttttcctgtgctggaattcttctgccgttgtctgcgcctctgtctgcgattgggaatggagtgagggatgattcagactgggtaatttgaatccaatttcgccaagacgcattagttgcatcaagtgtgcttcatatctgagctgcctaacttgggatttgcgcggttgggggttctgattgggatcgacttgatttcgtcacaaatcttgtcagttttaatttggttttccttgtagtaggtcgattggaaagagggagctgattttccttaggtaggatgctggtaatgatttgggtcatcccctgtgttttgcttctctcgtgttgatgattttgtatacctcaccaagttagcacattttactcttgttttttctgctcccaaattggcttgttcgtctgctcgccgttttcttgttctcgtctcaaattttgtccgatttgttgtcccctctttctaactttttcactgtccatttctgtgttgaattttcaatattggttctctactgtaggattaccgaaaattgtatcgttctgttttttctcccctttatctaggttgctttttctttccagaatagatgagttaaattgaactgaatatctaccttcatcttaaattcgatctgttaatttgtctgattcttgcccgattttgagttcgttcagtctgaattttttttaaggtttcagtctgaatttttgaaagcaaagtggtcgcaaaactcccaaaagtttgcaactttatctggctgatttcct

SEQ ID NO: 134 - DNA, 1501 bp, Oryza sativa
ttacatcttgtgcataggatttgtccggtacttatttctgggcaatcaatctcaaccattataacatctcatgtccagattcatagctagagtttgcccccctttttaggggggatagagggagtatgtccaccatgaattggtgcagatttttttctttacttattattaatttggtaatttctagatatccttatataatatttggatatattattaattgtatgagccattgctgtaacgggcagactaccaagcaagaggattgattttccatttttactgagcttctctgatttttttttttttgaaaaaagaacttgttagctgtccttgtcagccttgcccgattggaatttgatagtccgaatagaacttggactttttaatttttgctgcgtagtttcttttaaaaagtttgaggactcttacttttttatatttgtacaatcaatctcaatggttaaattatagatctatcataattcaatggtgtagattttctctttttcttcgattaatgtggtaatttctagccactacagcgaacatgtagtctcctttcaaggctgttttaaatagatatatgtaacataataatttatattttctatttttgaaaaggttctatgaatgatatttaaatcgcatagaagaaatgatatctcatagcctaggacatgggacatatccgggataaacttatacctaatttgttttttaaaaaaacatttaaatttgctatgtataatacatgtgcatatgatttgtggattaagaacagctatatttgattccagaattggaaagtagcaaaaaaaaccctccagatcaacgtctatatttgatcataaaatattttactttgtagtttgtaataatttttccttgataaagaacttttttttaatgtattgatgcttcttttctagtttgtaccccacctttcaaattccacgtccgccaataatattattacagcttaaaatccatttctccattcctcccttaaaaaaacgctagatataagaaatagctcttatatcaaaatttattaagagatggctgagaccatatttgtggtgctaaacgaaaaggggaatatatatattgaactaccattgaattgaaaatttgacatatgagatttgtctacgtcatcacgagtaaaaattttattgatagatttactcacgggagtaaattttttactcataatgacatggacaaatctcatacattcattttttatcgaacgataattttcgagtttccacgatatgtggtttgcccgatatatatatatatatatatatatatatatatatatatatatatatatacccacgtgaggacgtaaggtcactatctttccacctctatataagcacgtagcattagtataggtcggtattaagcaagcggcaatacacaaacacacgggtagctaagcaagctagcctcctgaatactgtcatggcaatagagtcagctccggcgc

SEQ ID NO: 135 - DNA, 1501 bp, Oryza sativa
tgttcaaacgggcggatttgcccccgcaaatctcgccggcgccattgatggcggccggacctcccgcgccggtttccttcctccccggccgctctctcccccttccaaccctatttaaaccctccccgcacttccttcgcccgtttccaccatttgccgcgccttctcctcgccggaatcgagctcacgccgtcgctctctctctccgccgccgccgccgagctccggtccgccgccgtcgtcgccccggaccgcctcccgcctcggcgccgcctccttcggcttcgccgcaccgtcgccgtccccgtccaccccctcatcgagctcgccgaccgccggagcgccgccgtccccgtcgacccgagccgcgccgccgccttcctccactccgggcgcctcctccgtcgccgccgtcgcctcggggtgagccatggaccgccgcctcgtttccccctctccctcccctctctcggccgccgctccgccgtgcctatggccgccgccgacgaccataggggcgcgggcgccgcctcccgccggccgcgccggcatggccgccttcgggcccgccgagtggctgccgcgtggggcccggccgtgagccgcccgcgccctcgggtgcggctgacgcgtggggcccgcggcgccggccggtgcgagcccgggtgcgcccggtccaccgtggaccgtgaggctgccgcgtgagccccactcccatggacccggtccgcgcgcccctccccctcggctgacgcaataaaccctttttaaattaaaatttaaatgaagaaattcgcaaatattcatttaaagagcatataaacttcaaatggccataacttggccatttgaactcggaattagaccgttcaagtctctaatttttccttaagaagtcaaaaacccttttttgtgctttgttcctacttgttatatggagtttattagagtaaaagacttttttttttctgttagtcgtgtagacgctgcagcttcgaaagatccgctcttcgtggaggttgaagccgacgtttgggaaagcgagcaaggcaagtcacatcatccttgaacatattgaatcccagtttataaaattattttgatttaaaattattacattaccgttttacttaaattcccgcgttatcactgttttgtttagctatgcccatttacctttgtatgaccttattattgttgttattgttattattaccttgttcaccctagaataaacaaaaccccaactagtgggtactcaatttatggtaccactagtatgaatttaggtagatgcttcgctggttaattaggcaacattaggtggttttacaactctagactttgggaatattctcatcacctggacattatggaatggttgaattattgtggaattggattcacacctccccctctattcaaaaccctcaaaatggttttaggctgggctcggggtgcatggttttgatagtagcacttcggccatataaggaccggt

SEQ ID NO: 136 - DNA, 1501 bp, Oryza sativa
tgacttacattgtgaaacggaggaagtatatgttctatctactaagattcaaggcttaaatttcctaaaaaaattctgaagtttaaattaagcctacacattcagataaaaaaaatctacagattgttacatgaactatttactacggtatttgccttctctgcctcttactttgtagatagagtttagatttatttttatcagatgccagtatactccgtatttatatattttttaaaatatataactattttgtttctaaaaaaaactatttgtggcaagctggagatataaaggtacgtatatataagagggcatccgccttgattacttaagaccgtaccaaaaagatgaacatgatcacaaagcttgttatagagttgtcatgctcacgtaacccaacgcctaaatcaaagggatcatgctaggaaaaaaaacataattagaacactgatttaaacaaaaaatgaaatgctagagaaacataaaaagcaaaatcgtctaaaattccaattttccctccatttttcattcttcgccactgtaatccgatcgttaccgtgtgtccgcttttcttccatcaactaatacagcacctgcgctccgccacatccatcaaacgatcagtgagattagtgactttaatttgattaatcaattaattaaattaattatctctctcaagatcagcgagtggccgtgagctgattactgtcatcagtagtagtaaacacagtgattcccagtcagttcgatcatgtcacgacgggcgttttcagggggtgatcaagttggacaagtaaaacgcgatgatctgacgcgatttttctccgtaccacatcgcgattctctgcacaggtccccgatcgagctcattgatggcttacagttacacttgccattaaccagtgtttagtctctctcttaactgtactagctggattagtatattatattgctgtccaaagcagaaatcaatcttaggcaaaaaaaaaaagaaaaagaaaatggaaactaaatctctctgtctctctctctgatctctaactaacactgtaattagagagagaaattaagtgaggctctttggcgcgaactagcagtatttttatccagcgagatggaggtatcttgagctctaatccagcgagctcgagaggggagtggcagcttgcttagaaaccacttgatcgctgcctcacctcaccacaccacacaaacacctattctctctctctagctcgctgtctctgtgtctctctctaactgaagttgcaggagttcttggcaagcttccccatatatacccgaccaccaccgggcaacggttgatcgatatagccagtgaggagaagggttatagaggctgatcgaccatcgatcgacgtcgtggcgagcggctagtgttcgttgtcgtcgtcggcggcggcgaggtggtggtggtggtagctacgtaggttgtggacatcgatctagaggtagaggcagggagggggaggaa

SEQ ID NO: 137 - DNA, 1501 bp, Oryza sativa
actgtctgggtccatcctacagatgaacaagtagcacgcaatcattaaaccctaacacggatcggaagcgcttggcactaagcatcaatgcatcatgggaggcaattggggcgaaatcagcgaaatcaaaggggaaagcaaagggggaagtaaagagggaagcaaagaactcactcgtctaggaaccaatccgagcggtcgtcggcgccgttccacaccatggctgctcctcccccttcctctggacgcattgtcttcccccttcctctcgatgcacggtcaaatccacgctcccatgcttctccaagcccccggatctgccgccgctagggtttccccgccacggagagaggggaattgagtgggaggaagagagagagagagcggacttcaccgcatcggtcaacggtaacccttatgccagcgactgaaagggcaagatggacaattttcctacccgggcccatatgtcggagctgtcaaacggctcaaccctaacagaatagcgacggaagggtgtgtagggcgcgataaagttcgacgatggcattctgggaggctcaaactttttagtggcacagatgcaggggccatcttttttaatggcacacaggtaaaaacctctgtttgaatgggcctaactctcaagaaagaaataaaaagaaataaaaacgcccgtagtggggaggggaaagcaaacaagccctagttccgccgatggagaggagcgccggcgaggaggttggccgtggcgtcgcttgcgattagggtggaggcgccggacagcaggagggtggaggcgccggacagcaggagggtggcgttccgatgggtacaatctgttgtctccgatgccggccaggagggcggcgttccgatgggtgggaggaggggcggtggtgaactggtgacgccggcgtcggccagaagggtggcgttccaacagaagatatcctagctgttccaggaagctcgcgagcactgcttctctcgcttctctctgatttcgagaagtatatgtcactcatctctacttctagttatctctatcgacatctgtacatcttctagttaccgaaatctgcacagattcaacaattttactctagacaatatatagagtaagaatggggaaatggtgtacctatctctatctgcactggttcatctcattaactaggatatatagaataagaatggggcgatgatgtttttacccaacttaatttggtgctcaatcatgattatgtcctcctttttcttactttgtgattttgtccctgtttttttttttttgcgaactgaagctaccttttgcccctagttcagacttatgataattacaaagtatatgcaatggttatttcagcgaaagacaatctttactaccatctctggtgccactgggcgacgttccgatgggtatgaggaggggcagtggtggcgctggcgctgaccaggagggcggcgttccgatgggtgggagtaggggcagtggcga

SEQ ID NO: 138 - DNA, 1501 bp, Oryza sativa
ccatgttagaaacagatcatagcccaaaatgggatataggacaagttataagtagcagcaggaaaaacaatctaaggatgaaagaaacatatcatgcctttttgcgagctcttgtttcttcaatcaggaggcttgccgtcaaaaacatatctgcatgagtgtcacaatttaagtgtatttatatggataatttcaataacaacacatgaggaatttgggtttacactggcttgattcctgcctccagcaaccttattgtccggttgaacataccttgcaaatgactgcacagcaaaaagttctaatttataaaagaattaacagaatcctagcactagaaacggtgtaagattaatatttagaacctggtgacttcaccggcctcgttcgtgagggtttccatccccgtccttccaactacaatctatacaagtaaaacataaaaagctgtcccaacttataaagcagtgggtaaggatttcctaatacctcaccaaaacttgtcaagcatttgcacacagaacatatagtgaatgtaatatggaattgctatgctctactcccatttttaaagcaaaacatccaatgctagaggtgtttagtttaatgttaataaatatagccgaccaaagaagaaaatatgaggcacaatggaggtatcccaatttcacccaacccgatttggtctaagagagcaatttgaaatgaggaatccttacaacactgggcagttaaatagaaaaaaatacaatctctctcgcgcaatcaaaggcttaagaaaccctaaaccccaagtaagtgagcacatttcaaagccaactcgcagaatgtgagaggagacatgggggcatacgaggaactggtagatgctcatgctggcgtcgacggcaatgcgccggccgaagtagctctcgaacttctgctccttcatcgccttgggcgcattgtccgccaaaagcttcgtcaaaccctaacaaaaaaaaacccgcacaaaatcgagacgaaaacccatcacgaatcggccgcaaaaacagctacaacccacaccaccggtcacaaatccgaacgaggacggcgcggcaccccccccccctcccgcgctcaccttgatgcccatctcgcctccgacggatgcggcgagcggcggaggcggcggcggcggagacacagagagagaggtcgcgggctatttcgagttttcgtgctcggccccccgcctttgcgttttcacttcccgttctcgggccggtctgggctaaggctgggctgggtagaaccggtctagttgggcctcgagtacgggccgggtcgggctgaaattggactgcaacgcaacgtgcggcccacgtgatctgcagtctcatttcggcccaattgaaagcctaatcaggtgacgtgctgagcggtggcgctgttctttgccggtggcggcgttgcagaggcttgcggcggcgaggggacggaggcggaggcggaggcgagcggcggcggcggcgagggg

SEQ ID NO: 139 - DNA, 1501 bp, Oryza sativa
cattataaggggataaggggaaataaaccgtttataccgtataatatagatcgtatctaactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtaaattgaggtcaaattgccaatcctagttatttcaaaggtatattgcttgcattgttttgtacaacctgattcatataggacaatagggcgatctgattctatatatatatcaccaatcaaacctggccaaacttgcttgtagggtaaattgacagtcctaaactcctaatcagttcaacaaagtatgcaaccaaaatttgttgtgatccagctagctactactaccgagtacatgttaatcataccatacgggaacatatgctaaacagacctttgatcactgaagcatgcgaaattcatgtccaagtttcgagaccaaggggcctaagcattccgtcgagcaccttatgcgcggaagccccaccgagggcaaccacaaggagtgaagcagggaggggggaggaggagtggaggagcggtctgttcctagagtatcctgaccttgtaaagctgctcggtgatggcggaggcgacgacgccggtgtagaaggcggcgacgtaggtgccgatgagtggcgcgaacgagcgcggcgggcggtacggctccaccatgtcccagagcaccgtcttctcccacctgttgaattgccggtccgcgtaccacctccacaaccgcctcgccatccctctctcccctcgccgccgccgccgctcgcctccgcctccgcctccgtcccctcgccgccgcaagcctctgcaacgccgccaccggcaaagaacagcgccaccgctcagcacgtcacctgattaggctttcaattgggccgaaatgagactgcagatcacgtgggccgcacgttgcgttgcagtccaatttcagcccgacccggcccgtactcgaggcccaactagaccggttctacccagcccagccttagcccagaccggcccgagaacgggaagtgaaaacgcaaaggcggggggccgagcacgaaaactcgaaatagcccgcgacctctctctctgtgtctccgccgccgccgcctccgccgctcgccgcatccgtcggaggcgagatgggcatcaaggtgagcgcgggagggggggggggtgccgcgccgtcctcgttcggatttgtgaccggtggtgtgggttgtagctgtttttgcggccgattcgtgatgggttttcgtctcgattttgtgcgggttt

SEQ ID NO: 140 - DNA, 1501 bp, Oryza sativa
gagaacatatataaaagtttaaccaacaaatttatttttattctctaataaaccgttttggcttattaaaaaaaaaagccaaacgatgaggccctcctaaggggatcaggtgattcccctagtcagccgttggatcgaccatggacggccgagagcaagccagcacttcaccacgcttggcactgccacgaccacaacggtgcatcggttaattgggccgtaacacacttgcagctcttctcagtcgggcctggaacggggattccggtccatatatattgggctgtaacgggattgcggctcatgtgaggcccatatgtactaggccgtaacgggatcgctgctgacgtgtggcccatgtagtttgggcctgaacttccgttgtttgtgcatagggaaaggtcgggaacttctccaaacgaacttagcgcctgcagcttctcctaaaatttttaggtgctaacagctctctcaaacagtccagttttttacctaaattctcaaggttcccaaattttgagaatttgtagttataaaatctgaaaaatgaactagaagcgagaaaaaaaagcgagaaactaggttttctagcttcttcagattcccacaagttagtttttcaacaatagtttctcaaaatcttaaactcccctaaagacctaaacaggcaggctcacagtggggaactggtcgtggattagccttctccaacataggggtggggcctaataagcgggattgctgctgacgtgccaaatcgaagtgtcacgactatagcggcccgtttggttggagtgagtttttaaggagggattgggagtttagagggatgggctattaagtgttttatttggttgggagacatgaaaattttggtgggatagggatggggaattgagaaaggaactacctcattttcaataactgggtaggggcaggtaattaggagggaattcctcctttattttgtctaagcaaatatcagacatatgtttttattaatgacctaatctccaactaaactccctatcaatttccatctcccctgtcaaacaagatattgggattaaaaatcaaattcccatcttaatctcatcattaattcccttgtgtaaactcctaatccctttacgtcgagttaccaaacaagccgtagcaaaatctactttgaggtaggccccacctgcagtatctgccggctacatcagaccagggccccactttgcagcgaaacacgtaacagaaggccagggagccagcggcgcagccgtcatccgaccgagaggcgagcgagagagcccatttcgcacgagaaagaaaaagaaaaggaaaaaaaaaaaccgagcttcaaagaggcgcagcgctacaagccaaatcgaagaggcaaaccaaaccaaacccaacccctcctccgccgcggcccgaaaccccaccggatcggcggcggcggcggcggcaggaggccggcgggcggaggagatgtcgctgacggaggtcagga

SEQ ID NO: 141 - DNA, 1501 bp, Oryza sativa
atttcatatctagatttatcgtattaggatttatcatatctaaccaaaatcccttatatttagggaggagggagcactacggcgcaccgactgaccgacctatggggcttacccatgagccccgaagttggacgtgtcaggtgagatacgcgcgtgtaccgatgccacaatatgtacgtatggtcgatgctgcaccgaggctagcagcacgaaagggcctccataacctacgcctagccctagcacgatggatggcacagtgcgtgcccatcctgcatctgcatgggttagtgcgtgctacgctgcgacggcgacgatcgatgtagcctagccggtgtgtgcagtgcagtgcaggtcaggattgccactatgaccaaaggatgcttgtgtgcgatcaataatggccgctcaatgtgtcatcgtacggtgacacaccactcatcctttgttgatctgtggtgatcgacttgagttaatcggcaaggcccagcccatggtttgaggtcagggccaggctgaatttggcccagtaattttggtttgagaagcccacttcgtcacagcgtcaggccgaattactggcccatggtgagcccatggcatccattccccatgattgaccttgtctttctctttttctctcgatctcgaaaagatgagcagatactcgtaattaaaccgcaaacatctgccacccatgtaatgataacaatcgttaacaatgccatgcatctcccgaagcttctgtgcctactcatttgagtgcgagaccttcctaacatgtgtccccttaacattgtttactccctttgccgccaaagtggttactacacactccaaacttttgtggcagaagtacactcaaaagcgaaaggtagcagaacacatcaggcatccaaattaacaacaacaccatttacaatcagacctgaacacgttgatcggcgacatcaggcgccgcacatggcaacgacacccgatcgatcaccaagtgtaaaaactaaagccgcatccaacttgtactcgccaaacagccaccgatcgatcgacgtttcgatcgcctgtatcgacacactgatcgatctgatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagcaaaatccatcagagttctaacattcgcgcgtgaatttcgaggttaatttttgaagcttaggatcaa

SEQ ID NO: 142 - DNA, 1501 bp, Oryza sativa
tgagaaaagaaagttcgccttttttagttatcaaaagcagtccaaacggatacaattttcttcgtcctcagatgacaaagcaatgacaaagaccggccctttttcaccttccacagaaaattagctaaaatatccacaacatcttagcccacagtaaattctaagaagtaataagtcaaggagtaaccattggaagataatcaccggaccggtgaaaaagattgtcaattcaaaggaaaaaaaatgttattttggattgttgtcaaattatgtcttaccattttctttagaggttgttcagattaatgtcattttaaatcatatactaatttttagtaaaattctaaaaaattgcatccatttatttttttttaccaaactttgttaaatatataagaaatacaaaatttgacaatattgccaaaatgtaaaaatttggtaagtcttattttggctacaatttgaacaaccctttttttttaatagtgctctctccgtctcattataagtgtacccatgattttccgtacccaactttgatcgtccgtcttatttgaaatttttttttaaaaaaatagaacataagtcacgcataaaatattattcatgttttatcatcttataacaacaaaaatactaattataaaaaaaattcaaataagacaggacgatcaaagatgggcacagaaactaatggttgcatttaaaatgggacggatggagtagtaaatgtaatggtttagtttagagccaagtgaatggtaatgcctatggttaatttggcaccattctaaaattttctccaccataacataaattttgataatctaaacacacccacttaaaatactacccttcaaaatataccacactaaaccaaacaaacccaaattcccaaccactcaggaggattagagcaggtacaataacaggctataaaccagctgcaaacatattttaaggagataaataagaagagagaagagcaacgggctacaaatttgtagtcggctatagcacggactctaagacacagtatgtgtataacaggcgggaccaggtattaatagtatagtatgtaactattatataaatgaattattaaattggctatagatgaattagagcaagtagttggctatccaattaattttgctcttatcacctatttctttccacgtgtggccggcagcggctgctccttgcctcgggctcagtgatgcggtgcggtggctgggcgggccgcgggcgcgacataaaaattcatgtgaagcgcgtgtgcgctgacgaggctgtggcgatcgggttgggcgtcgccgtccaccactcgccgccaccgccccctcgccccagcgcgcaccgtccctgtcgtccgctgcgccctcagctgggaccccgcgccgcgctgtgccgctccctccccgctagtgccatgcatgctcacgtctcgctgatgctaccagaatcctctctctttctctcgcgcaatatatatatatat

SEQ ID NO: 143 - DNA, 1501 bp, Oryza sativa
aaataactgaaattcggaatcaaaaataaggaatattagaagtagagtatagagcccatatagaaatacaattaggaaataactgaaattcggaattaaaaataaggaatattagaagtagagtatagagtacatatagaaatacaattagaaaataatataaatttggaattaaaaataaggaatattagaagtagagtatagagtccatataggaatttaaaactaacaaaaatttgaaataaacatgataaaattaaaagtagagtttggagtccatataaaaatacaatttataaataactaaaattcgaaattaagaaaaacatgggaagaagagtttaaggtcaatataggaatacaatttagaagtaactgaaattcaaacttaaaaattaaagaatattgaaagatgagtttagagtgaacatagaaatacaattaaaaataataaaaatttagaaataaaaataaataatattggaaaaagagcatagagtctatatagaaatacaatttataaaaaattcgaaattaaaaaaaaagaaatattaaaagacgagtctagagtccatataggaataaatataatttacaaataactaaaaattgatattaaaaatgattaatgactaacagatatataaaatataatatgaaaattcagaaataaaaataaataatattgaaagaagagcatagagtctatatagaaatacaatttacagaaaattcagaattaaaataaaatattaaaagacgagtgtagagtccatataggaatatatataatttacaaataactaaaatttgatattaaaaataattaataactaacacgtatataaaatataatatgaatattacatattagtggttttgtaaagttattgcaaaatttaaaattatgttgttattttaatatatttgaataatataatgagaaaacatatatgctattatatgagagaaaatataatgatgctagcggcgcaatctgcacgggccaatatgctagtttttaaataaaatggacggtcaaagttaggcgcggaaaaccatggctgcacttaaaatgggacgtaaggaatagcaaacattttaagacgtagttctagagaaatttcacgttaaatatatagttttatatatctctagttttttttataatagttttgtgaaatgtaatcaaaataattcctgaatccatctaactccaacgtcgtctccgatctccccgtccatctccctctccgcctccgccaacgcgaacgcccagaggtgcacgagagcgcgcgcgccgcgccgcgcctcgcctcgctgatccggcaagcaaaccgcggcgccgcgacgcgacgcgaaccccgccgcgccgcgagtgtgggggagcacgaatggtagccggccgcggttaggtaggtgggcgccgcggggtgtcgatagctccggagggtgggggtggggggagcagatccagatccagcgagggcgcgagcaatgg

SEQ ID NO: 144 - DNA, 1501 bp, Oryza sativa
gaaacacaagcgactctgactgacgtacacacggcgatgcgatgcaagtgcatcttaagaaataccgcctcaatttcgaaatgcacgacactacttacttttcgcataatattacactattcatcttattaatttttttaaaatacataaaagtataagttaagattatattttctttggtaataaaacaagttcaaataaaataaataatactccctccgtttttaatatatgatgtcattgaatattttagatacgtttgatcattcgttttattaaaaaaaataattatcatttattttattgtgacttgatttatcataaaatatttttatacatgtaatttttttgaataagacaaatgattaaatatttaaaaaaagttaatggtatttcctccgtttcacaatgtaactcattctagcatttttcatatttatattgatattaatgaatatatatatatatatatatatatatatatatatatatatatatatatattgcgcgagagaaagagagaggattctggtagcatcagcgagacgtgagcatgcatggcactagcggggagggagcggcacagcgcggcgcggggtcccagctgagggcgcagcggacgacagggacggtgcgcgctggggcgagggggcggtggcggcgagtggtggacggcgacgcccaacccgatcgccacagcctcgtcagcgcacacgcgcttcacatgaatttttatgtcgcgcccgcggcccgcccagccaccgcaccgcatcactgagcccgaggcaaggagcagccgctgccggccacacgtggaaagaaataggtgataagagcaaaattaattggatagccaactacttgctctaattcatctatagccaatttaataattcatttatataatagttacatactatactattaatacctggtcccgcctgttatacacatactgtgtcttagagtccgtgctatagccgactacaaatttgtagcccgttgctcttctctcttcttatttatctccttaaaatatgtttgcagctggtttatagcctgttattgtacctgctctaatcctcctgagtggttgggaatttgggtttgtttggtttagtgtggtatattttgaagggtagtattttaagtgggtgtgtttagattatcaaaatttatgttatggtggagaaaattttagaatggtgccaaattaaccataggcattaccattcacttggctctaaactaaaccattacatttactactccatccgtcccattttaaatgcaaccattagtttctgtgcccatctttgatcgtcctgtcttatttgaattttttttataattagtatttttgttgttataagatgataaaacatgaataatattttatgcgtgacttatgttctatttttttaaaaaaaaatttcaaataagacggacgatcaaagttgggtacggaaaatcatgggtacacttataatgagacggagag

SEQ ID NO: 145 - DNA, 1501 bp, Oryza sativa
gccgaggagggtgtcacctcagttgacactatctcttgggactcaggccgtctctgccacgctagccacctgtcctcccacagctcccgcggctctgctcgcactcccagtggcccgcgctcccccagctcgcgtgcgccgtactcaccagtgtactccccctacccacacccagttagcccttcctacacccccggacacaccccagttgcttcctcccgccgtggcccacgctttatccgcactgcgcggaagcgtgttgttggttcttccaccgtgttccgtttccgccacccagctcccccaccgccagcggcccgtgctgctgccggccctcgacaggtcccgccggtcccttcgcgccagccgatcgacgtttcttcaactgaggagccgactacaggaggcagccaggccgacgaggagtagaggaggcagtcttcagcagccgtccgtgtgataggccccttttgttccgccgccaactcttttggagtcgtggcgaggtagtgcgtgcgtgtgtttgttgtgggtgttgtttggtagtctggttctcctaggtggtgtgtgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccccttttctgggagtttagatggctagccgcccccgtcgtacagctcgtgcaccagcccgctttggttttgaagatggtagagttgaagcagaagcaaatcacgaaccagctaatgagcattctcaccacagcaaccgttcgcaccgtactgttccccgcaacgcagaggttgagcaacctcgccgcagtagccgctcgcatcgcacagtttcccgtgatgcagagctggagcagtctcaccgctctcaccgcactgccagtcacaattctggagaagaacgcctcccttccccacctcatgtggaaaacaacatgcaacacataatggcagttcagacacaaatcttgcaaggactaaccacagccatagccagctttcagcataatgcgcatggaaatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactccggttgagaagacgctctacgcctctcaccagctaagaggacctgccgcagattggtgggagaattaccgcaatgcacaccctgaacccactaacattgcttgggatgagttcgctacggctttccgtgcagctcatgtgcccgaaagcactattgacatgaagaaagaagaattcaacagacttaaacaaggcaacaacagtgtcaatgagtacctaagtcagt

SEQ ID NO: 146 - DNA, 1501 bp, Oryza sativa
aggtagtcactgccattcgtgtgattggaatgccgttttgtttgggaaatttgagagccatcgggtgagaatacgaaaaacaagctaaattctacttattcttagggcctgtttgggggagtttttagctactgcagcttctcccagaatcagaagctcccctaaacagtctagcttttggtctaaattataagaagctgtagttgtagaatccagaaaataaaaagctagaagctgggaaacccagttttttcagattcttagaagctggcaaccagccagctgtttctcagaatcttaagctccctcaaacagacccctagttcatttttcagattctacaactacagattttcagaatctgggtaaaaaactggactgtttgagggagtttttggcaactggagattctaggagaagttgcagctactagaagctcctccaaacagacccttagaatctagatgaaaagctagattgtttgaagagccgaagatgaaattgcagttacaagaagctcccttaaacatggcctgattggctgattatgttgtcaattatcaaaactgtcagctcctcgccatcaggcttccaaaacctgctagtgactggctgtagcctgtagcaactagcaaccggtttgtggtaagtgcataaaaaatcgttgaatgctcgcatggtttgatggtttgaatgctcgcattaagattcatgtgactgcaagccaaaaatctcaccaattcacggccagatcgatcgcgatcgagtgagcgcagaagtttgacactagctccggtcattcacgcacgtgggttttcgcggttgcttccttgctgttgaacatttttttttctcttttgtaactaatagctgttgaacagttatgttgctagcaaccttagctcgcagagaaaaaatgcgtacggtagcaactaactgacaacatactgtcattcgtgctcctttcctgttactactccctccgtcccggattttgagtttttccatactacgtttcaccactcgtcttattcaattttattttgcaaatataaaaaacgaaaagttgtgcttaaagtactgtagataataaagtaagtcacgaataaaataaataataattttaaatttttttaaataagacaagtggtcaaacgttgcaagtaaaaactcaaaatctctcatattatggtatatatattatggtacagggagtactaaacattaacgacgactagttgatccaaattaaatatatattttttgatggttcagcaatactaaggctgtgtttagatccaaagtttggatccaaacttcagtcattttccatcacatcaacctgtcatacacacacaacttttcagtcacatcatctccaatttcagtccttttccaaactttacaacgatctaaacacagcctaactaacaaaaccgttgactcaccaatcgccacacacattgtcgacaagtacaagcgccgtacgcaattaaaccct

SEQ ID NO: 147 - DNA, 1501 bp, Oryza sativa
atctgacccttttcttatacatatccacctgttagttggcatactatgttcttttgtttcatgtttgtcccttgttgctgttctttgtctgataacctgcacccaaatgaatagaaagtgaaaaaaattatgccttgttatcagcattgttgacactaaacttgtgggtctgtattccatgtaaacccttcttgcttcagagttcagattctagaggatataattagttacccgctatccttttcatttcatactaatgtggtttcttttcatgtttgctatcatatgtggcccgtaagttgcaacctaaactttgtatttgatttgtttcaggacttcatgccatatgacttctttgtgcagggacattctgattggaagaagtttaggccaggcttgccggaatatttgcctgaaatggaccgaatgtttgagggtgttgctgtggatggttccgcatcgtttgtggccactgccgaggagcctatagagtgtgatagctctgacgaagcggatggtgatgagcaagaggacgagctgacccctcttagtgttggcaacaaaaggacgagtccaagtaaaaagtccaagagtccagcagtgagggcaatggttagcaacatgagggagtacaatgaccttcaaaggagcaaaatcagcctaatgcaatccatgttgcaagttatgcaggatgtcgccgaagccaaacggaaagccgccgaagccgaaaggagagccgcggaagcccatatgatagccgccgaagctcaagccaacgctcatgagatgaagattaaaaaggtactcgagatggccggagtgtggggtcactccagaaggaagcccaaagctgttcatgggcgtggtcaacattacccagaatggtagcgcgatggatgcattcattcacacctgtccagcaggaaggatgctcatcatcaagaaatatgttgaggtcgacaactagtccatctcatgttctgttgtgtcattaattttaagttcatgtattattgtctgtttgttcaatcctgtgtatgattatgtatgtgtgtactatggttgtgatgtctgttatatgaacattgttatggtactaagtgtgatgcacttttaatacattgctgatttgaactatgtgctgcatggctgagatttatttgcaaatgttttgttattctttactaacataactcattgtttgctttgacaggatgcagggcagtcgttgtcgtcatcattctcgtcgcggtcgtcgttattctcgtcattctcgtcgtggtcgttgtcagcatcccacaatcgtcgtgctcgaagacagcgcatggatgaagacttaaacaagatgatgttggacttgttggacgatgatgacgaaggtttcttccacgttatgtttcagtatgccatccacattgacaagcatttgactagagtgagtataggcaacctgccttgactgggttgtaatgggtacataataagcttggggatagaaagg

SEQ ID NO: 148 - DNA, 1501 bp, Oryza sativa
tagtgtaccttctggttgagtagcatttacagtgctaattaagtagtgttcagctcaacaagaattagctcctggtattataacaggggttttagctggtaaaatttaatggaatggtccagcttgtgtccatttagggttcaagactgttgtgcctggtttgatgcatgacaaaattaccagggtgaaacaatctatgaacaaactgccaaccaagtatctatcctaggtgactaacatagtcaatcaaacacactttgttttgttcatgaggaggagggccactaaattagggtaaactagtactatatatatccagcagaattaggctgcgctcattactccacattcccaacacagctgctgcgcacggaaaacggagctgttcattagcatgtgattaattaagtattagctatttgttaaaaatagatcaatataatttttttaaacaacttttgtatagaaattttttttgcaaaagatacactgtttaatagtttgaaaaacgtgcgcgcggaaaaagaaagggggagttggtaactcctggtaacaacgtagccttagttcacatttttataattttaaacatttaagctaaaaaatttagacgaaaagacatcccttcaacattcttagaaagaaatcgtaagtgtgttgaagattgaacatctctgagcaagtacatctctaagcatttaagcagctttaaaccatgagtaccaaacaataataaaataaagttattttatccaatcagttgtgcttagacatttcctccaactaataatcttgttgatccatcaatttttgtcttagcataaaaaaggagtggaggaggagttgcccaactcctctaaccaaccaaagtctgacctggccagccaaacccctccacgcgtcacataaaccaacacatctccctggacacggtccatgaaccagaacccatcacagccgtccgtttctcccataaaagctactataatcgctcgaatcgacggctggtaacgcacgcaaggtgggcccaggcaatcgtacccaggggcggctatcgatggacccgtgcaccgggtccatgaacccagcacgtgcgcgcggcacaggtcaaccgcttcgagtctatggaccgggtccatgcaccgagagtgatagaatccttttcgtctcgtctcgtctccctcgcgagagcttcccaccattaaagcccatagcggcagcagcaggagcttccctctctttttggtccaaaatcatcgcccaaaatccgaggtaaatgaaattcgagatattatccaaatagtttgtttgaatacttatcggtttcccaaatatcttcgttgaggaaaaaaacaattttaaaaaagtattttgccatgcaattttatcgttcggagatgatggattagttcctttttccctttcttggcatgatagttcttgtggatttttaggttggagcttttgctcgggcgattgattttggaatcggaggagggga

SEQ ID NO: 149 - DNA, 1501 bp, Oryza sativa
gaggaagaaggaaagagaaagatggttgctacgcatgacaacggcgtagagtcgagtcttaatatttattaggaaatttttttgttgcgttgagtctaataaaggaaagatgactagtaagaaagtattttggtatattaatggttagagaccgtattgtcctaactattgtaacgtgatagcctctaattaacgtagtccatatcgatctctatttttgtacttgccctaatccaaacatgctctgcgttacgttggtgcagtgaacatgcatgccgcggctggtggatggatagcttgtgcatcgtgcataaactgcatatgcagcgaacgggtgcgggaatatgcatgtgtgcgcgcggcgcacatgccgccgaggagaagcaggggaatttattactcatccgatgatcaggagttaaaaatatgaatattatactactactccggtcgaggagccgccgacgtgagaagctttttacgggtgaatttaatgaacgtactgtagtattgaatactggtaactgtcacagtactccttcacaaccgtgtccttgattctggaacaagacacggagtacgtatatctagctgatgtatctcggtgcgtttacctttttttgtggaaacgaatttcatcttccaagtctttgcaaaaaaacggtttctagatacgaacaagctgttggaatttggatggaggttggaagaaacctggtgttggtggcgctagaccataaaaaaaacaatcctgtggtggactcgcaacaggccacagtgtcaagccacccaccgtggcccccccgaagagcatcctgcatccaacacccacagcgccgcgcctttcaggtgcacccgctgacttcgaccatcaaaattcgtttatacccgtaggtctccgcttcccatcccaaatcaccaattgcatttcaccaaaaaaaaaacctgtattcgaacgaacgacccaggactttgacaagtaaattcccagtgacctaaaaaaacgccaaagaaaatttcagaacacttgaaccagtagcgagacggaggaggaggtgagattgacgcggagggagacggacggaagaagccgcgcgttcccacggcacaacggagtcgacgctcgtccatccatccatccacaccgcgagcaaccgcgtgcgcgaaaaaatcccccttgcttcccacgctttcttttccttcttccgtattttcccataatccccctcactttttacacacgccaaaacgaatttcccccatgttccaaacttccaaagcttcccaaataaatccacaagcacaagtctcccctgccctatatttctccccctctccctatatataactctcacccgccacaaaacaggtaaacaactcgccacaagttagctcaagctcgagacaaagagggaaccaacagaaaccaccacggcggcggcggcgcgacacatcaccggagagatggcggtggcggtggcggcggcggcggcggtgagca

SEQ ID NO: 150 - DNA, 1501 bp, Oryza sativa
taattcacaagttgttaaactacataaattttaaaaacttgatgatcagagatagaagtactaagttcatggaaaaactagagcgtcaagtaatttgagaaacgaagcgattatttatttggttggctccgtcaaagtcgaaccagcagtgttataccaaattgttatggttatggataccacatacctaatagtagttgactaaacttagcagggtccaccacatactgtcttatacgaaaacaaacctcgtatacagaaagagtttcggataagaaaggacgaatagagttctatatggaaacaacaaggactactcgtattgtatctatattggtctccataggataagaaaggacgaatagagttctatatggaaacaacaaggactactcggattgtatccatattggtcttcctagttctatatggagaaggggacatctatgggtataaatacaagcccccctaggaggagaagggacaagtcacaagacataacacacacacaagccaacacacgccgccggatatcaacatcagaaataagcctagacataacccatccggtgcctacgtaggttatcccaaatattgtatttgcgtgatccagatgaataaagagcaacacctgcctacgtaggttatcccaaatattgtatttgtgtgatccagatgaataaagagcaacaccggctttggccaacaggatatatggctattacctatcagataagataaggggcccgaacctgtataaaaatcctcgtcttcatctcttttacctcaatcacgcatatactctggtaccaacgatccccataccatccaaataccgtagtcgcgatcccaaccgtcgacacaaatgatataaaatttatcaataaatataaatacaagtaatttaaagtattaccctaacaatcgtccctttttaaactttttttcttatctcaaacaacccctcctacttcaattcatcccttatttaatactccctccatcccttatttacgttctaaatctctactattataaaaattaaagacgtttctgccgttactttagtacgtcatctatgtatgagtcggtttttaagtttgtttatttttggaaatacatatctatatttgagactgtttttaaagttcattcgcttttagaaatacagaagaagtgaaatacagaaggagtcgtataagaaatctttctaaaaaaaactcgcatgctaacttgagacgaatggactcttatatatagctcatgattttataaaaaaatatatatccaagcaaattcccacagtaaattttaccttaactaaacaataaacaataataagattaaaatagtatccatctgttgtaacacatgggcattttttctagtataaaaaaatactccataagcaagggcttgtttgaatgaggtttttagctatgtgccattaaaaaagatgacccctgcctctatgccactaaaaagttctagcctcccagaa

SEQ ID NO: 151 - DNA, 1501 bp, Oryza sativa
gggaacaccactccacaggcatcctcgacggcacggacgaatcctactcctcggagaagccactatctgacacgtactcaaactctgggggtttggggggaaaatagagcaagactgagtaccaccaccgtactcagcaagtcataccggaataggggtatgatgcaggatataaccaaaggatagctagagcggttcatttgcataaagcgagcatttataaatagtagttgaaagcagtaaaaccattgtagtaattaatcaatatgaatcatccactgtccaacgctacaccacgttgcaacaggcccaaccatccacctgaactaatcaattccattagactaagctagggtgagactaatcacggtgaatctggttgaccacccataaccgcgggcacggctattcaaatagttttagtctgatcagaggtgtacaactgtacccacaagacacggccccacgacacgttaccgtgcgccgacatgccaccacgacatactggaaagaggccgtgacaggacccttcgcataaccccctctagccaagcacaccacacctcaggtttcaccccagtccccagcgggcaacgggtagtcccctctcgtgtctaggtgaatccggaagcgacagaggccgtcgcagggcccgccccgctccatcacgcccacccttgcctggatgcgttaactagaggaaagctacactacaagcccagccgttgcccacgctggcttgtggtaagtacgataagttcttccagggcatcccgcgaaccggtccttaaatgccatgggcgcgaccatcaaaaccatgcacccacagcccaccatttaatatattttaactaaccaacaccggagcggtggcattaaccaacatcattactagaatctgatatctatgcattaatgtaactcccccattgtgtgctagttgaactaagcatggctaagcaatccctagtccaatctctagtcatgttatatcccaagctaacaaaggagcatggtacaaaaatagcatggctgtaacagtaggtaagcatcccatagtaacattataaaacaatgcaaacattataaaacaatgcagtattcaagggaaaacgatagagcatttgcaatataggatcaacatgttcaagtgacaagcatgacttgccttgctctgctgctggaggaacttcggcgactatttcaaggtacaccggagcgtcgggagagccagaatctaagcgatatacaaagcaaacaatacaaacaggccataagacaattgaaacagagaacaaaaccatttttaatggattctgtgcatttttcttgatttactgagacttgaatgggcttaaacgaagctcggataaattagatatgaattttagaagattcactgtgtttttactataaacagaaaaatccttaattgatttattgtgaaataattaaaatcctggggagagagagggggcggcgccgacatgcgggccccaca

SEQ ID NO: 152 - DNA, 1501 bp, Oryza sativa
atgtgaatggatgtgaaatatgagatggctgtgaatgtgtggttgtgtgaaatatgttcatgtctgtgtatgtgaatgcatatgtatatgaatggttgaggctggggagctggggatattggatatctgtgtttgtttctgtcatttttgcagcgggcatggctagcaaaggcctgaggctagccaaaaaacaaaatttattttttttgtgtattatagtcatctgtgacgggccataactaaatgcccgattgagatgagatcatatgtgacgggctctagtttaggcccgattgaggtcagtaggcatctgtgacgggctatagtttaggcccgattgagatgagtatcatctgtgacgggctctagtttaggcccgataaaggttagtagtcatctgtgacgggctctagttgtggtccgatagagataggtcatctgtgacgggctatagtttgactggtcgtctgggtcaaagctatctgtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggcatcatttcaacgtgtttttcaatacgaatacaacaattctatttatgtattactagtcatcaacctgtgcacttgcatgcgctagaaaaattatgacatcaattaactgacgtggaagctttattggtgcatccaattactaaatataagatttattctttgtttctcaattctttcggtcaaaaacgtgcatgtgtgttattcatagaaacgtatgtagtatttgtaagaagtacagtatcgaatttccaaaaagttctgaccttgtgcgataatatacacacacattaacctacataggcaagctagctagacctagaaatataccatttctaaacctattcggtcacttactcacattgggcagcctaactaaactaacatggactcacatggcatgcaagccagccatggtactaactcgtctaccacgccatagtacgctacaaacacaactaagttatcttatgaaggactactcaatagtacacttaaaacattattactcgtttccttttaccttcatctgacgggtacgagctaagtgtatctgaaaatcatctccttctgtccatcggcgaaaacgtgcaaatttaaaattccctggtacgcaggactagatatgaagagtttgttcagagattgtgaaacaaacatatacatccatcaactatatacatgcataggatacatacatacaatgcaggtagccatttgcaccatattcataatatacaagtaggcagccatccgcaccttatccataccaagacgatccatttgcgcattatccacatcatcacataaagcttctgcctataaatagcagcagcaccttacattcaagaat

SEQ ID NO: 153 - DNA, 328 bp, Oryza sativa
agcataaccacagccataaaaacatctgattttagccccatcacgatgctccagcacaatgaaatgagaaaaaaaaagcacccattatacttccatgaaagtttatcccatggcactatattaatcgattccacacattcagtgatcgaaattaacaacaatctataccctcaaggccacaacatatccagaaaaaaaacagtagtaagaacaaatgctatgtgctaaacgcacgctaatttcccacagcatttcattgcactcccccaagccatctaccacgggccacgtactacgaaatgctaaaagaaaaaaaaaacctagacca

SEQ ID NO: 154 - DNA, 1178 bp, Oryza sativa
  unsure (1)..(1178): unsure at all n locations
ggcgtactaaaggnnngccctaangctcgcttnnngcnnngnngtnnnncaagggcntcgagcggtagttcgataccaataagattcattagccccgccccccacaaaaattttttaaaaaaaaacccccccccnccccccccccaaaattttcccccccccaaatttttttttccccccccccaaaaaaatttttaaaaaaaaaaatttaaaattggggggggccaaaccgggcccaaattgggttaattttttntaaaggatnnttattctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactagatataagattttttctttgtttctcaattctttcggtcaataacgagcatgtgtgttattcatagaaacggaggtaggtagtatttgtaagaagtacggtatcgaatttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcggctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaat

SEQ ID NO: 155 - DNA, 1501 bp, Oryza sativa
ccggcggccggccgccctctccccgcacgggatacagctcccctcccgtcctcttcctttcgtccctagatccggcggaggggaggggcgtcggcggctgtgcggccggaggggagtgcggatctgacggcggttggcgcggaggccggcgggaggcaggcggcactatggccggcgggcggcgggtgaaagcctatagccggattctagggtttcgttttttttaaaaaaaaattaagttttttcggatttttgtcttcccgtgggttgcgccacccgcacgcaaaaatcgtcatgttcccagacccctaggtgcgtgcgggctgcctacccgcacgcaaaaatcgttttagccctcacacaaaaatcttggttgtagtagtgaatggtgaaagtaaaggtggaaagtgagagctagttgtcaacatgatgggtagaaacgatttaaaggagttggcagtggtttgaggctgtgatcccacttgtacttcgctcaaccaagtatgagtggctgtctagtggccccatgtagatgtttcctaggagaagatgagaggtatggtgaagtttgggtgtaaattggactttaactccctctctctctttctttgtctctttgaaaatataatttaggatcaaagagatgattcaccaaggttgtttgtaggtatttggacgacaaataggcccatatatagatcattcactatgttgtgaactctgtgacattcttgtgacgaatatcattcgttacctatcatgcgtctctaatggcattctataaagaaagcttatctttttgttactaatctagtgacaatccttctgtcgtcatagagtctatgacgtccattttcgtcgccatcaagcccagaaatcgtcataagattccatgtggcctttcaaggcccatgtattcagggcaagcttgggaggggggagcggtacagccgctctaggctcccaaatcgcaggggcccccacccacacaccttgtcgggtcccaaaattaaagattcggtaacctacatgtttaaactatatcaatgtcacgccctgaaaatcgcctaatttaataaatcagtttttaatgcatttttagaaattaatttaaaaacctacaagctaaactcctataatctaggaaaaatttcaacataaaattgagctagataaaactttattaaatactttgcttgtttatctattttctagatttttctgggaattttttgagcaagggaagtatttttaataaacgaaacatcatttcacgaattattttaattgaaaaagtctttagaatcctccccttggccgtttggccatttccggcccaacatccctctccctcgcacgtggccgtgcggcccacgccaggccaatccaagccgagccgcccctcgtctcctctagtcatcgacatgggggcccacatgtcggggtcatcccgtacctccggctgggccgagccgagccgagcccgagcgccgccgcctct

SEQ ID NO: 156 - DNA, 1501 bp, Oryza sativa
ggtggtgcgctcgtcggcgttcctggtgtctagagcaccaccatcgccccactttgtcattcccgtcaactcgaatcatctccggttgtaccattgcgccactgacattgcctaggtcccaggagaacgacgcccacatatgatctagccaatacgccgccacgaacgccgtcggtcgccgttgctctcctactgcctctgcttctcttgctgccgagtcaccgacatgtgggcccagctgtttagctacttcattaggtgctaaggactttaattaggttctttttgtaaaattgctttgtttgccatgtgggcttttggacctaaatgcaattcacctaatgcccagggacctttttgtatagggtttagggcttaccctaaaacatgaaattactatttcatgcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcgggcgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagag

SEQ ID NO: 157 - DNA, 951 bp, Oryza sativa
atcaacagaaattaaaaacttgtagacgtacatgttcgatgtagacacatctcacagatacacacgcatatactactatattttttgccatgttattcaattggaccatgaggtcaatgctagattgtgtagatcagaaggcaattgcaatgaacattcttctcgattttttttagacgtacgtctttcttctcgaatttttttttgacgtctttcttctctaatttttaaccgaatgaaatatttgtccttaataagatgagagtagtttggtagctgtgcactgtgcaagggtactgtgacagccgtacgtccaatatccaactataaatatgtacagctgtatatacgtatggatacatgtcatccttcaaaacggtacttgtgtggcacgtgtatgtcaagaaagagctgtagtgtactgtgcaaatcatttaaaatcttgaagcatgcctgatcatgcataaacatttgaatcgaaattcacatgcacagtttcgaactcttggctggatccccgtagatgtccgttaaaacgcggtggatgtaagtgagttacattgctcaaattaatggacacaaaacatgtacatagtatatgcatgctatgcccaatatataccaactccaaccgggaaatagtatcttaattcagcatacagtaagctgaactgtatggattcaactattcatagtacggcaggccctacacaatttaattacgttgacactggccggtcttatacctaatacctccctgaccaacagatgcgaaaagaatctaaattaagcacgctgatttcattaataaaacgtctctaccattaagaattgacgactagctagctagtatatatgtgtgtatatatattaatagtactgctggaattatggagtattatatatatataaacgaagatcactagacgccgcaccgagacagatttacat

SEQ ID NO: 158 - DNA, 1501 bp, Oryza sativa
cacgcaaaaatagctcactctattttatttattctccactcctctctctctcccatcacccacactctctatgcccggctatctcctctgacctctcctactcctcctctcccctctcctctctctaggcggcgggctccggcggcgatatcaatttttacagaccatttggtacgtgatgatcgctttgccgcctgcaaaaactaggattggtgtcgaaacatgaattcggcaataataaaaggggtagcgcacgagacctaaaagtggatggatgcggagacaaggatttagagaggtaataccctaatcatgtttggggatttgaatccgccgggtgtagtatagatctgaccatcatatgtgctcatgccccctagagggcctcctgcccaccttatataggatggggggcaggattacaagatagaaaccttaaccaatacggtatcggtttcctaaatctactttataattttatcaaaccaggactttaggctattccataataaacagggaaacgtaatacccaagtcatgatccgttacatattccatagatataagttatcccctataatcagtcggaaaaccatatcgtgtgggtatgggatactcataatctccacaattggacatttggaaaaaccggatttatagtagtatgctactgtggcaaattattgatgttagaacataaaatccatcatgagcgtgagataccttcccttctccatacgtaatatcaataaaaatcgatgacaccactccattggagagagcttagtttttgtcccgattaataacatcttgtgagaattccatgatttacacacgtacgtggcaaaagaaacagtgcacaacgaaacgaaactgaattcagaaacagagtgcggcgaatatacctgaagtcctgaactctctgaacctgcaccaattattcagagtttcagatatgggcgatcgagaatcacacgagtttcttcagctacaagagacggtagtagatacaatctcgcccccccccccccccatttctgccgaaaagacagaacaacatatgtatgtaaagcataaaaaaactttcgacagaacagaataagaacatttcgactaggaaacggcaattccattctcactgcatgtccttgctttcgagtgccgtatcatagtgatatataatcgcatatatatcaaacggaacatattccaagtaattgtcttgtactacaccagaaggtgatcatccttttcatgcttctaatcttaaatacattcaagttggatgaaagaggatagcatagtgctcaactgacaactcacatgtctctatcagagcatctttcaatcactagaggattggtgctaaggaagctataccgaagacttgacctgaggtagtgacgcacttcgatggtggttctctctctgccttaatttctacttaagatcactccgacgccatgtctgaacatccaagaacacaccacactcgcaaaaaa

SEQ ID NO: 159 - DNA, 1501 bp, Oryza sativa
ttgaaaaccctgtcctagagacacttatcagtcatgttcaaacgacaatagcatcactgtttgcatttatcaaagtagttctggtaggtgttctttttgctaggtactccagtacatacctcacaggggaggctcctgcactcctgcttatagctagctctgttgtttctacctcttaattagctttcatttttttttatgatgagatggattgaaaccagactctacatccatagagcggttgtacagttgtacacagccaattttgctttcatatatggaacatgttatttgagttttgcatacctgtttagggtgtaagcgagtagtcagattatcatcccctaaacatgtgatcatgttaagcaggtaaccccagcaaaatctagatggctttcaataaaaagctaggtctttattacctttattcttaaaagaaaaaaaacatagacgtaggccacgatgcacattagccactcaataccattgcccacacaccatagctcctacaaggctacgacgaataaagtagatggagcttgatatgaatgtgtgtgtgcatctctgcctctctggccttgaactaacatgcaaaatacagagtaacatataaaatactcaggtggttttgtgtttaacaatatgttggaatcaatccagatagttggttcctagaaagatccagcctgacaaggttggcgagcttggacatgtctggaggtagcatgccagagaacaaattatttttcgctaaaaatctatggagtccagttgcagaagatgttggaattgcaccagagaacctattgtttcctatctaaatctacgagatgttggatgatatctaacttggcagagtaccggtgaagttgtttcctccaatcataactatggtaagcatcgcacacgaccatattttctctgggaagtccccaacaaagtggttgttggatgccttgataatgtggatggtgtcgcagtccccgaggctcaccggaaacactccatggcacgtgaatagccgaaggtcggtaagattcggcagcattccaacaccacttgggatttgtccaacgaggttgttgtagtacaagtatagaattttcaagttcttcaagttcacaatatcttctggtattgatccggtgagcttgttgatggacaaatcaagctcctgcaatttgagagctgagatgtcagaaccaatctcaccaatgaaattgtttccggagaggaacaacatctcgagcttctgaagcttccatatccactttgggattttttccttccaacttatttattgatatgtccaatagctcgagctctgtcaatgctgacagaacattagggatgttaccaatcaggttcatccatgatagccacagatatgtcagcttagtcagcttgccaaactcgtttggaattagactagccttgaacggattatatgccaatgttagcatctcaagctccacgagacctccaatggcagcaccctgat

SEQ ID NO: 160 - DNA, 739 bp, Oryza sativa
ccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctacttaaacaaattatagctagccattaaatccttcacatatttagcacatatatataacaccttatgtattatgtataatcgcaattccacatcacctactgtcaaacttaaaatttgccactcacaatttatgacacgtgagttttcatctatatataacatgtgagtccagtgatgaattcttaattgtcacttgtaagagtagcaaatagttaaatatctcctgtaaaaagcattgcaagtttactgcctaccaaaatttggtaacaccaaaaattaatagtgctacaagtggtagtaaagtgaacaaagccctgagtcttattagcacattctgagctcattcgagctcgtctcgttgacagccctaccgttagcccacatctttgttttttttttcattttaataataaaggttataaagacatagctttaaattgaagggtcaatttgatctatgctactgtaaatttggctattcagaaaaatactattataattcgcctattcataacca

SEQ ID NO: 161 - DNA, 1501 bp, Oryza sativa
tgaagttaaggtatacattagtaatccctaagtatgaggcataagaaagtttaataaaaaattggtttgtgatttgttaattgtttcgcattgttcaatgctagtatttattgtttgcacgtatttgtcattgttaaatgttagtagaggtatgtaagtatttgtatggttaaattagttcttagttagtacatgttattaatatgttctgtgttaaaaaatgtacaaagatattatattttatttcgattattaaactagtcatttgttactaatagttgtaagttagtacacggcaatgtagtataagttgtaatagggtaattatcgaaggattaaatgattaacgtcagacaatttgtcatgttttatcaggatgtcaggtgatatgcccattcgtctgtattatggcgatgctcctatacaaatatgcgatagtggggtggatttgactgtatatgccttccatgatactagtctgaatgcaccggagtatatgggtttgaacgacgtgttagggtggttgtataatatgtttggggtagatccagtgcatgataaatttgtcataaatgccgtgtggccagtgaggggtcaacatggatggcagtggagagtagtggaggttgcgtcaaccgggagttggaggaagtttgttagtaaagtaagggagaaaggctatagcctggcaatagtggtgtagaagaaaacatgtgttgatcgatcgggggagtcaagtcataccgtggtggaagaaactccgttggaaggtggacaagttgaaaatgtttggcggactgagcaaggtcgaggggaagaagtaatagagggtaatacacaaggagaggtcattgttcgtggtactaatcgtgaggccaatgactcagacgatgaagaaccggattcgcctatgcgtgttgattcagcggaggagaatgaggcggtagtggattagatggaagtggaaaacgaggaatacattgcgcttgtagtggaaggagaagatacaacactgtgggacaacgaaactaacatacccgatgattggacgaccatatcaatgagtcatatgaaggtaaacgatgatttagatgcccactggtgttatgatagtaagcaggtgaaagttggacagatgtttcatgacaaaggtcacttacaagatgcggtgaagaggtgggcatttgaccagaagcgtgaattcaaggtgaaggtttcaaataggacgacgtatgacgtgaagtgcacacagggtggatgtccttggagagtgcatggttacaagccacaacatgacactttatgggtagcttcgagggttgagcaacatacatgtttgttggagaatacccgtctggtgcacaggaacatgacagcggcatttgtggcacaaatggtatattcaaaggtggttagaaaaacatctttgtcccctttcacaataatgcatgacgtaaataaagagtacggatatgagatatcgtacgacaaggcttggagg

SEQ ID NO: 162 - DNA, 1501 bp, Oryza sativa
cacgcaaaaatagctcactctattttatttattctccactcctctctctcttccatcacccacactctctatgcccggctatctcctctgacctcttctactccttctctcccctcttctctctctaggcggcgggctccggcggcgatatcaatttttacagaccatttggtacgtgatgatcgctttgccgcctgccaaaactaggattggtgtcgaaacatgaattcggcaataataaaaggggtagcgcacgagacctaaaagtggatggatgccgagacaaggatttagagaggtaataccctaatcatgtttggggatttgaatccgccgggtgtagtatagatctgaccatcatatgtgctcatgccccctagagggcctcctgcccaccttatataggatgggggccaggattacaagatagaaaccttaaccaatacggtatcggtttcctaaatctactttataattttatcaaaccaggactttaggctattccataataaacagggaaacgtaatacccaagtcatgatccgttacatattccatagatataagttatcccctataatcagtcggaaaaccatatcgtgtgggtatgggatactcataatctccacaattggacatttggaaaaaccggatttatagtagtatgctactgtggcaaattattgatgttagaacataaaatccatcatgagcgtgagataccttcccttctccatacgtaatatcaataaaaatcgatgacaccactccattggagagagcttagtttttgtcccgattaataacatcttgtgagaattccatgatttacacacgtacgtggcaaaagaaacagtgcacaacgaaacgaaactgaattcagaaacagagtgcggcgaatatacctgaagtcctgaactctctgaacctgcaccaattattcagagtttcagatatgggcgatcgagaatcacacgagtttcttcagctacaagagacggtagtagatacaatctcgcccccccccccccccatttctgccgaaaagacagaacaacatatgtatgtaaagcataaaaaaactttcgacagaacagaataagaacatttcgactaggaaacggcaattccattctcactgcatgtccttgctttcgagtgccgtatcatagtgatatataatcgcatatatatcaaacggaacatattccaagtaattgtcttgtactacaccagaaggtgatcatccttttcatgcttctaatcttaaatacattcaagttggatgaaagaggatagcatagtgctcaactgacaactcacatgtctctatcagagcatctttcaatcactagaggattggtgctaaggaagctataccgaagacttgacctgaggtagtgacgcacttcgatggtggttctctctctgccttaatttctacttaagatcactccgacgccatgtctgaacatccaagaacacaccacactcgcaaaaaa

SEQ ID NO: 163 - DNA, 1501 bp, Oryza sativa
cgtaatttacagcgactcgtgtaggtgccacgtcagttttaaaccggatgcgccacgaagctgccgctttcctcgtcgctggcgccggcgccccacattttcccggccatcattcccgccgacgagctcttccacttcccgtctttcttccccttcgagaacgacggcgcgccgccggagtcgtcgcggcaggcggcggccacgctgaacgtgcggtcgtactggaccaactgctcgagcacctccttcatcgtcggccgcgacgccgggtcttcgccggtgcagatcatgccgagcaggaacaccgccacggcgtcctccaggaacgccgccctgtcctggatgctctcgtcgacaacatcgtgcagctcgccgccgaccttttacctccgccacgcccactccgccaggcaccagtctgcgccgccgtcgttcgccaccctcccgtcgtcagctccagcagcacgacactaaatttgtgatactggccttatcatgtgtagtactttattttgttttagattataagacgttttaggtttttgaatagattagtgcatagaatttatgtatagacttaatacatgtgtttaaaagttatataaatatcaatagatctagacgagaactggaaaagccaaaacattttagatggaacggagggaccgagggagtaggaaagagccaaggactcaagactgcaataggtcaaggtcttcgacaactaaggcgaatcttcttgggcctcttatttcaaatgaaatttgggactatttaggcccacatgtcttttggttcttaaaaataaatggactcttctgctagtggatcctcaggtcgatgccaaagaatactcaggctggacagtttatatatggaaaatggtctgatgttactcctgaatatactgaggctgtgtttagaggtccagggataaaaatttttgctgtgtcacatcggatatacagacatatttaaagtattaaacgtagtctaataacaaaacaaattacagaatccacccgtaaactgcgagacaaatttattaagcctaattaggcttaaaagatttatctcgtaatttacacgcaatctgtgcaattagaatttttttatctatatttaatactttatgtatgtgtccaaatattcgatgtgataggatgaaaaaacttgccaagggatcaccctgaactcattttcattttggaagaactacaacacaaaggtatatatgtaagggtctgaactctgatttccccgaagcaaacaattgtgtccgggccctcatgttccaagaaacgcaaggaaatagactacaattactaagattttacaaaagtacaatgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctga

SEQ ID NO: 164 - DNA, 1501 bp, Oryza sativa
cttgtcccttctcagagcagggcatttgaagatgatcatagcagcagaaactttcccttgtctttttcatgacatacatagtagaagctccacttgtcatgctgtagtttaattgattctgctgcagtttttgccatcatttgtgtcctgaccaaactgttgctaaggcaagtgatagttactgtgcagctaattacggccacaatttctttaaagtgaaggtaccactattgccttcaccaagcagcaagcaccatgaaaacatcccatgtgagattgacatattcttagacatgtagtcaatctagtactattcttctttggttatacatatgtgtcctgtgtgtgtaaccatgcaagatgctcaaatttgttccaactttgcagacatggcattttcaattgtaataaaataaatggaccaataagaactcctttaaaaaatagatacacttcatgtttcaaaattgttccaattttactggcgtgacacttttaattgtaataaaataaaataacctataaccactccttgaaaaaaaaatatacactccgtatcttttcaaagtacctttgtctttattaattagtagtgccaccaaaggaaaagaacagaacacaaataaattaaaatggaaaaggaagaaagagaaaacagagaaatatcactcatatatactccaatagaatagagatatacaagagaaagaaacctacccaaatactgtattaactaatccaactgaatttcaaagttcaggtcagaaactacgggtgcttgtagccatgttcatctttgctatctggtctactcccaaatcaccatcagtactacggtatgaccctcatctatgttaattaattatgtttagtcttacaaaagcaattattaattagtttcagagcatggaaatttgcaggaggcccaaatggagccaatggaaagtttcacaaacggccataactgactcattgaccaaaagaaaaaataaagaagggaggaaaacaaaagcattcctcgtgcatcacaagtggcattgatttgagatcagcttcttggcttgtgtggattcatacccaactccagtagtagttgcagttgacaaggcactcaacatcacatgatatcacctagcttgttgattaattgttgaaatgggaactgaccggtcaaagaaaaggtgatgagaaatttgagaggtccaattaggtctatggtcaaggaaaagttggttcttgattcttctacttggtcctcttatctcctaaggattatgttctgattgaaaagcagcaacctatcaacacttttgttttgtgccatccatcacaattcacataatgtattataagtaaattattttctccatcaagtaaaatggtctttgattcccttcacagtaagatcaacgcgtactttcacttttgtatcatgacataccaaaataagtttcgcttgacagcagaatacaacaagaaaccttacaaagtacaaatgatt

SEQ ID NO: 165 - DNA, 1501 bp, Oryza sativa
tgtactttgtattttctggatcaaattatctggacagatgtagtagaatattttcttagatgatagatcggaacccgtcctctacatccaacagggttgtacacggccaatggatagatgtagattatagctgattagagttttgttgggattgtggttcaaatctatataccatccaaatcaataataatcttggcctaccgagacactccgatggagtataggaatttcgcggaaattttacagtttttgtagttagtagggaataggaaacttctcatagattttgctgcttctgaagcccttgctataaattagaaagtaatggagaccattggccatttctttggcagaaagttgcagagggcaagggatcactaagccgaacttttatgactgacttgcaccaatttgttattggaccaatgacttttgcatctttctttcttcttcttttttttatttgctccctggccgtattgctgtggcaatctgtggtgccatactgccatttgttgtagtatctggaatggtgtaaagtttccgtgatgtcaggccacgagaaaatggatgtttatcctgggaaagatgaaggaaattccattaattacacagcagataatagttggatatttttcactgacttgcatcccttctcccttttcatacctatcttagcttcctttctcttctcctgtcttgaattgagtgttttgtttaaaactaagtgtttgcatttgcagtatatatccttggcttgtaaaatgtattacccatatttcttggcgtcatgtaaaaaaattattttccgtattgccttatttgtttcattgacatgctcttttaacctttttttttgttcagtttacatttctaaacaaacattttttgttttcaccaaataattgcaaacagtttttgattttcatagaattagcaaattagtatgttttagaaattagcaattaagtcgttagagttatgtactactggatgaccatttaagggccaacagcctgttgagtgtggagcccaaggcccaaagcatcagaaaaaggctcagtactatctacctgtagtatatgggcctcattgcctttagcctttagcattgaaggtttggctctcatacagtaaaccaccatatactgggttggaaagctaccgaatgcattgattagtcctctcaaaaagtataaaaagagttgctctctcaaaataaaaaggagaagaagaagaaagggtgttgattagtagcaaatgaatttttctttaccttctgttgttcatctcaccatccttgcataaatcagtagcaaatgcatataccttctgatgcattttcaccatcattggaaaatcaacaaatgtccatccatagaaatatcatctaatccaatataaatctatacattatgaaacatgattactgttcatttatttatgatcattttctaagcatgattctatatatacatcatgttattcatctcaccatcct

SEQ ID NO: 166 - DNA, 1501 bp, Oryza sativa
taaaacactgctaaactgtttattttgaatgaaaaactctgttaaactttgttctgggatatccttatgaggatgaaattacaaaacaatttttttatctgggcccaactaggagtattatgggcctgtaaatactagacaaagttttcggaatgcatatagtacttacttttcggaatgctaaaattaagttcaagcacaaaaccctctcaagaagaaattaacaatgtacaaatgcatttttagattaatccatgtagctgacaaaatatctaacttgattttttttctatgcctttttcttctaatgttttgtaagaaaaattgtcaggaaagatgtttgtaggaaacactaatgtccaattaaacaaacaagtaattaagcccctgttgctcaaatatggatatgattattctcttgaaacagaagctgatttcatccactgtgtcatgaggaaactgaagatcactgcctcctcaagaacacatgcagaaacagacaggcagacataaaagaaatgtacaccctgaggcataaattttgccaaacagataacaggagatgaacccctcttgctccctcttcactcccaacatgcgagaaaaaaaaaatcagcagcagctgtatttacacacacacacgcaaaagaggctcatatggcaccacaaaatctgatgctctcctgagcctatctccttctccatcttcttcttcttcttattgctgcattttttttctctctcgctcttttgccggagtaaactgacagaagggcagggggacggattcattggctgctgattgcagatgcatcaggcaaaaccaggactaaagctgttgtagtactaaaaactgggagaaagaaaacaaaacaaagaaagttcagtaacaaatgttgttgttcttcttcttctttcgagtgccgtgcattgcaagcgcacggtctcctcatcatcttcttgctgttcttgttgtctctactgcttcgccggggccggcgacggcgagctgccgggccacgccggcttgcgcggcgacggcggcagcagctgctgctgctgcttctgggcctccagctccgacgtcagcatctcgaacatgacctgcacatccttgtagtcgcaggtctgcacgtcctcatgtagcttcaggaggccacggctgcctgcacaccatatattgcagtttgtgattagtttttcagatgtaatggtagttcttgccagttccaggatgtatagagtcatgcttagaaaatgatcagaaataaatgagcagcaatcatgtttcagaatgtatagatgtatattggattagatgatttttcgatagatggacacttgttcattttccaatgatggtgaaaatgcatcagaaggtatatgcatttgctactgatttatgcaaggatggtgagatgaataacatgatgtatatatagaatcatgcttagaaaatgatcataaataaatgaacagtaatcatgtttcataatgtata

SEQ ID NO: 167 - DNA, 1501 bp, Oryza sativa
ttacagggacaatgccgacaaagttggtgaagctgggtattacgttgtggtacctgatttcttccatggacaaccttacaatggagacccaagtataaacgttacaaaatggatcacacttcactctccggtaatttgtttcaccgtttacatagggggtgtttagatcctagggatattttttagcccaccccttttagccccaaaatagctcaaggggatccaaacaggaggaagtttacatcttgtagacacgtggtgtgactgttgtttcttttttccccctattcataactatttagggctatggtcttgtaattttttaatgctatatcaatatgaaatcttacatggttcgtttcaaaacgccaagtaataatgatcatagttgcataaaaaaaaccttttccatatggtgcttattgtggagtcaattaatggatattgatcagtatattcaatttgaatttcaggtaaaagcagctgaagatgctaaatcaatctttgctgctctaaaaagggaaggcaaatctgttattggaattggaggttattgttggggtggtaagcgaaactaaccagcgaaagaaaaatgtctttacatatcatacaccagtacattaggattacactctaaattttttttgcaaattcctagttagattccacagctagatttagatcatattatagtctcagcacaagttcaactgacagcgaagtttgctgtggaggtggccaaaaccaatgaagttgaagcgattgtcatctctcatccttcagaggtgattgctgatgatatgaaaggtgaatttaacttgttttgatttgatgcttaattggttgcactacatatacacgaattatctagtcattttatgtaagttgtatccaagtagcctttgttttgttacttagttcacattgaacacaggtgtcaaatgccccattgaaatccttggaggtcagaatgaccatataacaccaccaagtttggtggaccagtttgtgaatgtgttgcgtcaaacaactgaggtgagttgctgttgtgtttcattggcacctgatgccaaatgatcttaaattttgtaaaaaaaaatacatattagaaagcacaagaataactgaaacagagtttattcaacccccccccccccaaaaaaaaaaactgaaacggtaaacagacaagatataaatctaccagaaatgatgagatattaaaagatcatgctggctctaattggtagtcaacatttggaaagttgtttttgagaagaacatttgggaaatttacaataactaaagtctgaacactagtacattattgcaattaaagttccatacatgtacatggccataaattcggaaaatatcctatatcttcttgacttgttctatatttgcaagaagaccctaattttttcttcaacacaaccactcaatgatgtttaagaaaagatgcaaattacaaagtgcctctaatggactgcatctttgttgc

SEQ ID NO: 168 - DNA, 1501 bp, Oryza sativa
ctgccttgcagaccaaatcatcaccacaagagagctcggtgtacgtacaaataaattcaaaatttcgttacgtacatatagatttgttgtttactaattaatttcatacattcataggttattcgcatgagggataactcatacacaaggaatttatcgcggcggttcaagaacaactcatgggattcatcaacgaacaagtccttgatcctgaggtgaattctactacgacggaaatacaattcataggtcgctagctaggacataatgaattgtaattaatacatgtctatttttctatatgtacacatttactttagtgtaaatatatattttggtcatatgtatgcacataaaatgttaagtgctttaatatatacatatgcatttgcatacatatatgtataaatacatatatattatgcatgtatatgtattgaaaaacatatataaatataatatatatatatatatatatatataggatgactcttatatacacccgggtgtacatactccctcccctcataccattgattaactttgagatctgtacctgttaacgggttggcagtgcagagtcacgcagagtcacgcagtatgtacccattagccgaacgatgcgtggtattaatttgaaaagtgattaattaccgataatgcataactaaccacctgaagaataggtcagtgcagctagtgggtggtgaggaacggtatctgcatcgtcaaagtcacgtactgcttcattaggattttggtttgctccgtcctggtcgagtataagccaccgcgcggagctggtgattttggatggatgacgttgtgaagaaccacaccgatttcaattgtaccacagggtctaggtatgttatactgatttgatgattgatttttcagtatgtgccgttgggtttttttcatttgatttatgggtgtgaacaagaatgattctggatcattgattcagtcaaattattatggatgaatgcaacccttccttcggcatacctgatggcgattcaatcccacatggtgtccagacaaggtgagatcaagataccatattttctgaattgtagaaataatcggccgatactgatgcatattgagttgtgttctgcagtcctgtagccatggaggaggacatgtcattgacagttggctcgcatgattcaggtcatggaactccggtgacaaggtatctttcttggcatagttatcagttgatcatatactttggaattgagtggtataaaatcattttctgtctctattacagaagtgtgctcccttcactagattggactgaaggaaacccagctgaaaaagatggggcagggataccgatggaaaggtttggatctcatgttgatttcttttcgctttatttgattttaatggcatgttgttggttgtatgttctgaagactgaatgaatacaatcttttcagaatggtagtagataatgttgacagcagtgctgccattcctctggagt

SEQ ID NO: 169 - DNA, 1501 bp, Oryza sativa
ggcggcgcacgcacaacggtgaaccggcacgaccccgacaaggccggtaagtttctgaaacccgaagcttacattttatgattttatttggatttgatttggatttaattagttaagatatttcaatgtcctgtataatgaggttattatggggagtggacgatatattatctgttaactcaaccgatcgctttttgtgataatggtctcgcagcaataatattattgtaggttgtccataatagtatgaatagttggactcagtggcggactcaactttgaaatatatatgggatggaaaacggagatgttcactcgataagagcaatcgaacacaacacatatcttatatcttatttatagttcaatcacaaaactgcctcgatcattgtttatggcgtacgcgtgtgtaataccccgtatattaaaagatatttaggtttttttagtttgggttgacttgttaaaataaagatgttaacagaaataaataaaagaaaaatatctttagaagtgggccaacctgagaagacccataaacccagcccattagttctcccctaaaacctagagagaggggaaccgaatcccacctcccctcatagtgccgccacccctctccctagccgtagcctccttcctcccctcctcctgtgttcgcatctctccgctctacaacaaattgctctccctaaatctccaccttcatagcttggatcaagaagcgaagtagaaaaatggaacgaggaggaggagaggagtagagggaggggttagaccgaagtctcccctattgtctcctcacaagttctctaaagaaaccctaggtgagacttatccccttgttgtatcagttgttctagcatggctttagtgctttaattcgtggttagggaaagatagagaatgagtttgggtagttgtggttcggtttgttgcggttcggtttgctgcagttctgcatatggccagatttgtagtgcttcagtatttcgatgttttgggctctaaatgtataactaggaagttgtagataatgtttggatctatcttctgaccaaagggcgcaattttatctcaagtggtttaggagatataattttttagtatgactgttgtttttgtgtcaaaatctggataatagtagattgaactgtttttagaggggttaaacagtggaatcatgtcacgcccggaatttctatccaaaactccaaacgcttacatgtgtgtaaaacctttgtccaggaatcagccgaggcacacaataacaaattgataatagagtacaattattaatctaattacgaagcgaatataaggtcattacagaggtagatagtttctctcaaacaataaagatgtaagtagcggaaaataagataaacggcgcaggagactctatcccacaagcagcatgaccagggctacgcctaatcctccacaccttcagcatcattatagaactcctcttctgatgaatgattgcaaggtgagtata

SEQ ID NO: 170 - DNA, 1046 bp, Oryza sativa
attaccgaaccctaaccctagatccgccactccccgccgtcaccgctggccggctccaggcgggggactgtgtcgccgcgagatccgtgcggagtgcagccgccacagccggatgacggatcctggcgtggggagggcggtgccgctcctggccgccttctcctcgtcgtcgtcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgcgcctgcaccgccgtcgtgtggagctgaggccgacgccgaccgccgttgtcgttgccatcgcccgcgcgccaaaaggagacgagaggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccatgaaaatctatcgtttagtagtgattatcatgaaaagtgtcagggttatggataagatataccctctacccttggatacacgttctatactgata

SEQ ID NO: 171 - DNA, 1501 bp, Oryza sativa
ttcagacacgaatgaaaaaactaatttcataacttggctggaaaccgcgagacgaatcctttgagcctaattaatccgttattagcacatatgggttactgtagcacttatggctaatcatggactaattaggctcaaaagattcgtctcgcgatttccccctaactgtgcaggtagtttttcttttaatctatatttcatgctatatgtatgtgtctaaagattcgatacgatgtttttggaaaaaaaactctttaaactcttttggggaactaaaccaggcctgaatatattggtcttgtggtcctgtgttctagtgtgtgtggctccccagcacaagccttggatcctactcttctcgacctcagtgtcaggtctcattcatttgtgatgaaacaccatcccttctggactctactgtcagtgccgccgtccttccatctattctgattcgatggccgtggataagcttgatttctctgtccttttttttccttgtttatttatctatctgtcaactctcatccccctttcggaaagatgattttcacatgaacacgagtttgtgtgttcaacgctatagatggataatatatataccattgtggttttattcgtggtcgtgtgtgttttatcgtgtactgatcgaagcacggtaatatagcgtacgtgtaaagtgtaatgtaaagtgtaatgtgtgtgttagctttcgctttactgtatgaagaagtattctatgccattgatgtttttttcacacgcagaaatattttcttccaagtggaggggttctttcagtttttattatttatttttgtgaatgaaaattttgactccaacaaaatccttttatttatataaatctggggcgaagttgactcctgtttattcagagagagagatagaacggatcaaaaggttagtctggaatcatgtttctgtcattactaattcttaattcctcattaattcctagaaggacacatttgcaacatcatactacttaattcagttttatgcattcctagaaacttctttaccatctatattacaccctttgtcccaaattataatgcttatatttttttcacagtcttcagtgatatattttgactattattttattttatgttacgttcccaatgagtatgaaattagcatcatatgaaaataatttgaaatgaatataaaactaatgatataacatgtataatacttaacatatatatagttagtatggttattagttaaaagttatcaaattagatttttcagaagatcacgccctgtaatttagaacggagggagtaatagtcgaaaatgcgcatcaacaacttatatgattggtgtgagtccaaaagtaggccaagacatattggggtatttttaccattgcctttctgttatttctgttaggttagcatgtccatgatgcaatccatgggattggcattgcttgcaagttaactaggaacccataatttgttcacaaagttgggga

SEQ ID NO: 172 - DNA, 1501 bp, Oryza sativa
tgcggcggcgggcgcggcatagcgagcggtaggaggaaagggttcggcggggagctcaccgacaagaggaagcggcgtcggcggatcggagggagtcgtggtgaggtggtcgcgatggtgggacggaacggcaccgggtgggcgcggccggggaggaagagaggagaggtggcgcccggagctcctcgtcacgcgcccacgcacgcaccggttcctccggtgctcggcggcggacggcgacgacgagatcgagtcgagcggcaacagggcggcgacggttgttcggctacaatggcgcggtggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggcggcgaaggcggtggatcgagcggcggaaaatcgaaccgcgggagcgggaggattagcacgggctggcgcggtcaagttgggggtggcgagctggcgctggcgtctgcgtctctgcctccgagcgcttgcggccaaggagtggaggcatggcgtcgttgcttgggagggaaaaagagagggaggacggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcgggttttgggcggcgacggcgggaatcggcgccgggaggggagagagcagagagagagagcgaagacgggagagagaaagaacgagagagcgagagagctctctctcggctcacatgcgtgcaacgcacgtgcgaggggggttaagatgatgggctgggaggggagatgggccgggggagaaaacggcccacaaaaaatccgagggaggcaaaatagactttttcggaggggattgattcgaagagaatttgaacttggaatttgacttagattttggaattgggatctcgatgagaggaaggagtagacggaggattcaagatggggttttggatattttggatctggggaagtatttggcgatgattcaaagagagggatagaatttcagagtttgatttggagacttgagtcggaagaggaatttcgagggggcaaatttgtgatggtgacgagagggatcaaggacggatttgaattgagatcttggcacaacttagactcgcacacaaagaacgaaaattttcgcaattaggatttttgccgaattagtttttaacgcctcacgaaaagcggagcgttacaga

SEQ ID NO: 173 - DNA, 1501 bp, Oryza sativa
tgaagtgagtaatgaatttgacttgacaaattagatgaagagttggctatatgagtgtttaaaaagtctaattcgtataatttggatagtatgttggagatactcataggactcaccaacataggtgtgtctctgtatgtgcgtgagtgtgtttgcttctgacttgtacaagaaaaaaaaaagtaggatttgtcaaaaagaatttaattggaatgagaaacttgtgcaagcgtgttggtgcatcttccatttaattgaaataaaaacagtttaccataaaaaatgaacattttccacgccattactttctatatagaaattaaatcagtctctttctatagcggttcatgtgtcaattttctttctgtgcgattgcgatgtggctacaaatgggacactcgattttatggtgaaaaattagatgctctcccctactacattgttgcatttttggctagtgcaagaggtgtctatccatacgcatgcaaagctacacactttatatctcatttccatatattttattttagcctccttctcgtatctttaaactatttttttcataaattatttatcatataaacgatctgatcgtaccgttgtatttgttataattaaatatttacagcaagatctcacacgattatattttaataaaaaaataatatgatttgtgctagaaaagaaaactagaaaaagaggaggatgacaaagaaaatttacctcagtaacggcgcttggaaacctgaggagttgaaccaaattaacaatcacacatgcagcagcaattaaaattaaattagcggttcatcagtccataatcatcattatggaatgaagaaatggaagtagtgataactgatcagtgcttaattaattagctagctcaggcaatcatatgtgcgtactaaccgtagacgtcggaggcgaggacgacggcccggtcggagtgggcggcgccggtgacgtaggcctcgtagcccgccaggtcgtggactaccacgccggcctcgccgccgccggcggccttcatgtccggcgggtgctcaaagcactgcaagcgcggcggagcagccgcggcggcggcgccggccgccgcggcgagcgcggcgaggcagaggatcaggaggctcaacgaagcagttgccatatggttaatttgcatactgatgagtgagagatgatgcttgggcttttgtacatgcctttaaccggtagagtcagctgcacgctgcaatcctgcgccccttttttcttgtaaaaaaaacaaagtgaaactattacactttgtattacgtataatataaactattacactttatattataattggtttgattttttttaatcaaacttcttttaactttgaccgagttcgtagaaaaaaatagtaacattttcaatacaaaacaaatattgtagcaatgtacatgctgctaatttttactataaacttaatcaaatttaaagaattttaaccaagaaaaaagtcaaacaactt

SEQ ID NO: 174 - DNA, 1501 bp, Oryza sativa
tgatatactaagtcgtgtttagaaccataatctctagcctgcttcctgattgccaataagggtttcatcggggtttcagccaatgaattatctggatgtttatctaatcgtttagattttatgacatcagacctccagccgatgtatgctttaaccttcggataagtacttacactctcatattattattagccgattggtttctattggattatattatttttatattttattatcatcagccgattgtctttacatcattatctacatatgatatatagccgattactcaaaaccccattgacatcggctatcgactggaattactccaccggcttgtcagccaatcagctatttgatatgttgtttacatgtcttgtcaattgtaggatcaaactgactggcacgccgcatataacctttggacctacactggagctaaatagatctcccaggccagtatgtgtttttttgcatcaacacgtggctgaggttagggtggccaaatcttagcgccccaagctcgtggcagtggtggtacaaataggttgtgtataggggtagagacgagggtgtatcaattagattcctaagcttaactctataatcgcattaaaaattcattgatgcatttttaaaattttgaagatacaacaaacaaaccgtaggtaggtttcttgcagtaatacttgtctacttaggttcaaagtggtagtacaaatgctcgtattcatcggtaatatgggcgctcatatttagaactaattacggtcgagtgtatgtgatcataaaaaaaagaaacacatagagcatactttatcaatcacaaaataaacgaatcttgaataggatttgatataacctgtccgcattcgttgtcatagcttatatcaaattcttatctagattggtatatttattttggaacggaatgactagtactaaccaaacaaccccagtaccaatctgagcacatacaagaaacaacaatccttggggaaaacattaaaaaaaaaagaaaaaaaagggggcaaaactgcccagccgtgaactgggcctggaggacgtgaactggactcatggtaatcttaccacatggcccaccttatatggaaggctcgatctcgcttcccgtcctgccgtccctctcctccccgatggcggcgcttcccgacgtccggcggcaagcagccagctgcggatgcgccatctctgctcctggaggacccgcatccatcggccgtggtctccgcggcatcggcgacggcggcggccttgcggcgcgaagcttcagctccggccagatcaacggcgcccttgccgccgggcctccgtggagagcaggtaggcctcgtctctactcctagcttggtctgcgcgacgcgcttcggctcgcactgaatccatcccgcaattagttttgtcccacctcgctgattttgcgacagagcgacctctttataaactctggttgattctgttgtgttgcctccccggagac

SEQ ID NO: 175 - DNA, 1501 bp, Oryza sativa
aaggtccttcacaaagaaaccaaactcgtcaaattcaattgagcatttgttgtcgcgggtaaattgacgaacagaaagtaagtttcgaaccaaggagggagcgacaaggatgtttttaagagcaaacctagtagttcctataggtagaaaagaagtaccacgacatataaccggaatagtatgaccattaccaatggtaataaaggtatgagagttagggaggcgtgtaacgagaataccgtcggtcgaggacatatgcgaagtagctcctgtgtcaagcacccatggacttggactgttcacagatagttgattaagagcagcaacaagaccagcttggtcccagttgggctggacttgcggcattggaggccatcctggagttggtggagacacataggaaccggcaaaagctgtgtgagcttgaggatacgggccaaggaggccagcactgttgccgggattgctgggagggcgccatgtagaggcctgcgcagcccatggattgaagcagaaccacgggccggcaggacgaagaccggcctgctgctgttggtagaagttgccacccgaatttccgtaaccgctgccgccggagttgttttggcgaccattgccgccaccaccaccattgtatttgttggaattaaatcgttataacaagatatcacatgattatattccaattaaagaaaaatataagtttcaaactattaatacttaatgtttcaaactattaataaatctcgcagtaacgtgtcgtgttactgcacatatgcgattgttactaccgaacaaggtatgattcatatagtaacatagtgggtttgtgttcacaaaatttgaacagatatacaaagaaaacaaacactgatctcaaatcacacagggtcatagggtgaatttattgagagagtttgttgtaaaccatgagatcatgggttctagtcttcaattcaccaaattatttttaatttttctagaaaaagagtaaagaatgggagaaaaaaataaagagaaaggaagaatgggagaaagaaataaagagaaatgatgaagagaaaaaccgaagaaaaagaaaaaaaaagtggagatcgagcgccctccagcccccctctccccccattttcttcttcctctacctcttttcccccttctcctccctcacaactctatggagtccagcggggtagaggaggctcaagccccctccgcccccacgctagctccgccactgtaggtagcaaaaggagacgcacctacgacatgtttagtgtcgcatcgacgttgcaatcctacgtccttaacaaggaataaaatcaattggtgagttggaagttttcaacttgaatttgaaagttaaaaagttagaatctaaagttttaaaatctatacataattaattttttaaaattttcgagttgaaagatttgaaagtttaaattagatgcaaactttgtatacatgtatatgtatttttatacatcaaaagtatatacat

SEQ ID NO: 176 - DNA, 1501 bp, Oryza sativa
gggggaggcgacaacgctggatggggaggagacaccaggacaggcgacggaggcgggagtgagagacagcgacggaggcgggatggaggggatcagccgatgaaggagagggatggacgggaattatactgataaattacgataataccctacgaaaattattatctcttgacaaatatacccttccacatttctaccgccactaactctaatgggagtagaactagatctcaaccctacgattaaacacgatcaacggcttagattactttctactgcaagtagaaagcaccggagcggggctcttacaactaaacttggagggcttagagccatgatctcttctactaaatgactattcctttcgagaggaacttcttctcctccaaatcactggtgtgttgcctctctaatctatctatacatctaatgttggatgttatgtcatcatctgattggtccacgtggtgcctataaagataaattcgagttgtcagggacaaaaataaaaagaatccaaaaccatatatggaagaatctggcaccgtgctgcgtgacttgcgggctgcggctggctggcacaagcagaagtgtgggcagcttggtctgtatgggtctggtgtagtgctaagggtgtgtttggttggaggaatatcttagatgggagatgatgatccagttttaatttagtatgtctaggtggtgggcaaggatggataatacggcccggagagagaacattccacagagatgctggatgaggatatccacaattgctaatcttgatcattagtaattgattagcaataattaatgtattttgttgttagttagtaattaacttatcaaaattagggttgattagatataattagtctattctgttattaattagtataaattatgtctatatcaatgataattaacatattttattattaattaatatgttattgttttcattcaatccattctcatccacctgaccaatcaagaagctggatccatatccacacaactaaacaaataactggagcaccacatccttgcaagtatggatgaccatatcctatccaatatacctatgaaccaaactgcacacgttaaatgggccaattggcctagcagacagcatgacaggggaagaagaaagaaaaatataaatcaattttagattcaggcatatactagaaaataagcagcaacgttgtgagaatatgtgtttttgctgtgttttttaaaagaaaattagcagcagaaataagcataactaagaaagaaaagtgcaactgttcctattgaaattatcgatttgctctaactttagctagaaattttagaaaacataaaaataattaaggatttcattaaaaaatacacctttatttctcagatatgtctatcctcaattgtcaaacacattcaaaattcactttgtacaagtaaaactacatgtcaattaacacaatactcccactactttcaaatgtatgatctttac

SEQ ID NO: 177 - DNA, 1501 bp, Oryza sativa
ggctgtgccctcgccatcgctgcatccggtaggagacaggagctcgcagtctcgcaccatcgccaccgcgccacgtgtgccacaccctcccccacccgccatgacgagcgcctccgagctcttcaccacccgccgcacccgtgaggcccgcctctcctcccacagacgcgctccgtgacccgcacggcctcgcagatcgccatcaattggtgatcttttggtggcaatattgtctgcattccatcaattttggtctgaaatttatttaaaaatttaaatttcagttgtcaaatttgtgatcaaataattctatcatgcaaatgagtgtttttttttcgcattgagaattttgttttcccaaataggctagcatataagtatgaaataagggcaatataggctcagttcgaaagttcgtttagcttttgcaattctatcatttatcgtgatcacgttttccaaattattaaatggtgtgtgtttgcaaaacctttttacatataagtttattttaaaaaatgaaatatactcattttcaattttataattgttaatatctaattaattattcactaataacctcctaccttgtttcgtgtggaacatatcagtttattccaaacataggttggaatgcagcccaaagaaaattataagtcaactctttttcacaaacacacaaaagaattacacgtcaatatattagtacaagtcaactcatgatcaaaactatttggatgaggcaaaaatcatatgtatagcaaggtttgagagaaaaattatgggctaatgtttaaaaaagaactaagccgaagttgcctaacacatttgaaaacaatgctagtggtgatatccataccactaaaatatctctaacttcgaatcttgatgagcgcttgtctaaatttagagttaaaatatatttataatttatatttcaagatgaatgtagcattattccattactccatacaacataacctctccatcatgtaaaaaaacctagtacaaatacgacgaattaaatttgaaaatatactgttcatccaagtttttttttagaaatataccgtcgatctcgcacaaccattacgcgaaaatgacatagatgtgacgtcgcggacggtattgcgcggtctcgcggaacggaacagtctcgctgaaccaatcagcgacaccgtctaacggctccatttgattagtgattaactacctaattaactattaactaataataaaagtgattaattatcctaattagcgactaattaataattagttaattgactaatcaggataattaattactaattaaatcggcatgacaccggtatcgctgtttggttcactttcgttccataagaccgcacggtctcacacttttactttgtgaccatccgcgacgtcacgctcacatcattttcgcacaacggttgtacgagatcgacagtatattttcgtaaaaaattgtgcatctcaaatattctaaaaaaatttcaat

SEQ ID NO: 178 - DNA, 1501 bp, Oryza sativa
gatcgagagccggctgctcgccattggacgtcgggaagcggcgccctcgacggaggtcgggaggggatcgatgaagtatgaggtccagttcgcatctgggctgctttttttttttcaaaacaacggttcatggttattcatttatgcttttctttttctgtttgacttgtgatctgttaagagtgcacatcgctccttccattaaaaaaaactatttgtgacttgtaatcggaggatgtgtcatatttagaattaaattttaaaaaactgttcattgaaatttttttagaatatttgagatgcacaattttttacgaaaatatactgtcgatctcgtacaaccgttgtgcgaaaatgatgtgagcgtgacgtcgcggatggtcacaaagtaaaagtgtgagaccgtgcggtcttatggaacgaaagtgaaccaaacagcgataccggtgtcatgccgatttaattagtaattaattatcctgattagtcaattaactaattattaattagtcgctaattaggataattaatcacttttattattagttaatagttaattaggtagttaatcactaatcaaatggagccgttagacggtgtcgctgattggttcagcgagactgttccgttccgcgagaccgcgcaataccgtccgcgacgtcacatctatgtcattttcgcgtaatggttgtgcgagatcgacggtatatttctaaaaaaaaacttggatgaacagtatattttcaaatttaattcgtcgtatttgtactaggtttttttacatgatggagaggttatgttgtatggagtaatggaataatgctacattcatcttgaaatataaattataaatatattttaactctaaatttagacaagcgctcatcaagattcgaagttagagatattttagtggtatggatatcaccactagcattgttttcaaatgtgttaggcaacttcggcttagttcttttttaaacattagcccataatttttctctcaaaccttgctatacatatgatttttgcctcatccaaatagttttgatcatgagttgacttgtactaatatattgacgtgtaattcttttgtgtgtttgtgaaaaagagttgacttataattttctttgggctgcattccaacctatgtttggaataaactgatatgttccacacgaaacaaggtaggaggttattagtgaataattaattagatattaacaattataaaattgaaaatgagtatatttcattttttaaaataaacttatatgtaaaaaggttttgcaaacacacaccatttaataatttggaaaacgtgatcacgataaatgatagaattgcaaaagctaaacgaactttcgaactgagcctatattgcccttatttcatacttatatgctagcctatttgggaaaacaaaattctcaatgcgaaaaaaaaacactcatttgcatgatagaattatttgatcacaaatttgacaactgaaatttaa

SEQ ID NO: 179 - DNA, 1501 bp, Oryza sativa
acaatccaacgttttttgcgtactactatatattgttaagcataaattaaaagacgaaacacacgtaaaactaaatgcatattcagatagtgagtcctgacccatcaaacttgtcccggagaatcgcatccagacgtcttcccatctcaggggtcatgtggctcgtccaaccccctgccacccccttccggaaatacgagtcgtgagagaacttgatgaacacaccttgggcgccttccttgttggccttctggctcatgagattctccatgctacagagctctacgatctccgtgacaacaccagcttcttcctcggagctagtgaatggctgcccgacgaactcggctagctccctgatgctgtctgttgggtcttgaagcagccgctcatatctaaggaagagcaccctgcttgggttcgctttgcttgccctccagtactcgagaatgtgattccaaacagggcccccgaagcatgtgccctcgcagaaggactcgtacagattttgtagcccattgcgcttcaggaagtgccacatggagaccaatgcatccttctgatccctgcacatgtacatttatatgttttgacagctccttcttttttattgcaaaaaaaaggaataagacttaacaatggtgttttaacaaatagcaaaatcgaaaaactacgtaactacagttcaaacctggttaccacctagctagttattgcattggacgaagattatgaggcatatctgtattttggggtacctagctcaattaaggctggacattatatgttaaactttaatttgtctttagatcgatcgatgtgctctttttttaattacacatggcatgctgcagtgattatattatagtgttcgatgtgtgtgctctaatactttattcacgatgcaattatcaaattgtggtttggatttttgatgaatgataggagtaaaacattgttgatcatgatgtgttccatgaaaacgatgaacatatatcatatgagaattatatttgtcacaagcaacttgttaatttttgcctttttatgtctttcagtgatctcggttcttcgcacatgcaccaagcaaaatttgaaaatggtggtattattccatcccacttgtttacattaacaatcttagttaattatcacttcatcatggtacaaatataatgggccgcaaattgaatattatatatatcgacatgtctatctatatataccacacacatatacagaaagagaaagagagagtatgtgtataagatcttatgtatttactcccggtctgttgatgagagagattaaagaggaatatatgtgcccaaattatggctatatatagaggttgtttaattatatacaccctccatttgatatataagtagtttgacttttttattagtcaaatttctttaggtcacatttataacattaaattagttttattaaatttaacattgaatatattttgataatatgtttgttttatattaga

SEQ ID NO: 180 - DNA, 1501 bp, Oryza sativa
cgtgattcatgagtagcctactgatcagtcactgccatttctctatttgataaacgtttataatattggctcctgcatgcatcgttgttgatcgagttggtttcttcaggatttgaagcgcctttgctgaggtacacttcgtccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacaacaataatacgtcattacatgtatagtcattaattaattataatccattaaacattacatcacatatacgtcattacaagtcgtactttttgtcgttacaagaaaccaacagctattttttgttgaacaacttgacaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctat

SEQ ID NO: 181 - DNA, 1501 bp, Oryza sativa
aagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccgctggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcaccgccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagat

SEQ ID NO: 182 - DNA, 1501 bp, Oryza sativa
ttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttatcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattctaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattatcaacagctagtggaaatactcaaataatactgctatgcccaggaaacactagtaattactacctccgtccctcatataaagtcatataaaggatattcactatttttaaaatactaatgtcactcgtcttatttaaataatttgtgcaaatataaaaaagaaaagttgggcttaaaatactttaggccgttccataatatgcagggaaacgt

SEQ ID NO: 183 - DNA, 1501 bp, Oryza sativa
ttttaagtacttaagagacactaaaatttttagtggaaatttacgtaccttctaatatctggaggtactaaaatttttaatgcaaattttcataccttctagtattgaagatactgaaaaatctaaattttacgctaaaaaatatggaagctcataaacaactgtaaaatcactcttctttccttgaatgaaataaaaaaatacgcaaatattaaggaatgacctagtatcaaataattagaagtttcgaatccaggtcgtgtagcccaccaccttgtgaagctagccggaaaacccctgaacgtttctcttcttgaatgaaatcgcttagcacctaaaaagaaaaacaacttttatgaaaaaagaaaggggggagaaacacctggcgcgcagctacatgtacacccaccattttcttttctttcaataaaattaagcttgtacttcctccgtcccaaaataaagctatttttgaggttggcataggtattaagaaagtaggtgagaataattggaggaagtgtgtgattggttgaaaagagaaagtaggtgaagaagaatggtcgtgattggttgagaggaggaggtaggtgaagaaataactttattttaggacaagacactgtgctagaaatagctacattttaggacggtgggagtagtacattttaatcatccactaaatcaagcatgatcggcttaattcctgatcagaacttggtggtggcgcaggaccgcgtgcagtgggatacgcatgatttcatcatgcacgacgcccatgaaaagagaacacagtacatgtggcagcatgtatgggaatggatagcactagctagctgggccccccgtgacaggcacgggctccaggaagagaccagccgacgttcacgggttctccatatggcattgggtatacctgtcccttgttccagacgttactactgtctagtgctgtctgtgacaggtttgtttggcaaatggaatttttcggcagatcagccggttgcccgtgcacacttcaccgcgcccaattgcgaaaatgcatgtgattctcgcgaggtttggttggtgcgacacgcacatcctgagactgagaggccgggtttctgtgcatgtccgtcaggccgtctgctggtgttgacctaccaaccgtcccccagtttggttcggtatacgtgtgcgtccgggaagggcggaaggctatagccattgatcacttttcgattgcccgatatgtctgtggtgagagaaatcaatgcccgatcgagcctatgttcgtcatgcacacattggctgtgtttagttggatccaaagtttggattttgattaaaattagagatgatgtgactgaaaagttgggtgtgtatgacaggttgatgtgatggaaaagtactgaagtttggatccaaactttggatctaaactcagccattgtctagctagccatgcatcacattgttaatttgtgcatgttttgcttccaattttgaaaagggaagg

SEQ ID NO: 184 - DNA, 1501 bp, Oryza sativa
tgcgcaagggcaattttggcggaccattcgacgcgtacgtcgtgcacgcgcgccgccatgccatgccaggcgagcgagcgcgcgcgtgttccccctcttctctccacctcacatgcttcaagttgctaggagagcatcctcccttgtaaggaggtctccttctcctagaataagtaaggtggtattaaactccccattaatgctatttcatgaggtgggcttttgtgatttttcaaataattaatctttgaatgggctaaggcccctctattaattccaacagatacatgaccgagtctgtcctgtgttattggataatctattttcttttttttaaaaaaaaaaccaacatactgctacagcagaagggttcgacaactaattttctcttttactgcttttctataagtgtgaagaaaatttgtatagcttccttgcacagtacagaaatttgtctatatgttttaagatttttgcatgttttagttgttctcaaagtatagtctctcatattccacatagaatattctgtgttgttgatttgtgtatgtgcatcattttttgtacgtttgtgcaaaatatattttatagccattatcttttgggtaagtggttcttttttcatctgccgcataagaatatttgcttcaaaaaacaaaaatatgaaaaaaaaagaagaaggagagatcttaaaacacatacactggcttcttttctgtgcagggaataagaattgaagtgcatgagttaaaaggcttagcatgagattccaaattattttgacctactagtactatcattcatcctcttgcttcattccatagcaacacttatcctcctcttgtttttcttttttcttttttttccatttttctctctaagtcttagagtctaagaagaacatacacttacacttgttgatttgtgtatacgaatcatcttttgtacgtttatgcaaaatatattttgtatgtgtactagaacatagacatacacatacacttgttgatttgtgtatgtgaatcatctttgtacgtttatgcaaaatatatttttgagccattatcttttgggtaagtggttcttctttcatctaccgtataagaatatttgcttcaaaaaacgaaaatatgaaaaaaaagaagaagaagaaggagagatcttaaaacacatacactggcttcttttctgtgcagggaaaagaattgaagtgcatgagttaaaaggcttagcatgagattccaaattatttggacgtactagtactctctccgttacataatataagtcacaactacttttttttgatgttacataatataaggcatgaatgcatgcatacacttaactaggacatcttctccattaaattatcacttttttaaatcctccactctcaagatctctaattctactgtttgcatgcattatatttattagggtgatccaaactaggagatgataataatggtttcttggtttttgggttgagggtggttgt

SEQ ID NO: 185 - DNA, 1501 bp, Oryza sativa
ttcttagattgtaatcagatgcattttgtgaaggataaagtcatcaacagtaaattaattgtgtaaaaaagatgtatttgtttcatgatcattaatttaattggtgcacttggcaatggtacattcgatgcaacatattatattttgtttttttttaaaaagctggttcttagtgtctaattgcatgctaaacagggagacaatctgccaggactaatatcttttgccaggaatagtttgtctgccagtaattcattgtctgtcgggaaaactaaagaattgccggtactcttccgccagtcaaaaagatatctaactctcaatttttttcataggaacaaaccattagtggtgataattgacatgttgtgtgctaactatgtttggttaactaaagaaataatgtttattattttccaacggagccaaaattctatgaatatcatatcttttatgtcattgacaatggaacgaattattaatgaataatgttagatttatgttcatgaaacattcaattaatgccagctataaacattcaattattgaaacattcaattaagtcagctataaacatattttaagcagataaaagaggagagatgtgtttttatctctcctcttttatctacttaaaatatgtttatagctgacttatagtctgctattgtagctactctaataaagtttagtctttcattgtagcccgctattgtagctactctaatgacgtgaagtttagcctttcattgtagcctgctgcttttatctctcctcttttacctgcttaaaatatgtttatagctgacttatagtctgctattgtagctactataatgaagtttagcctttcaataatgaactggtttccggttatcattcaatgattcatcaatatgtgaaaatgttggacagtaaacggaaatggaaagaaagatacttctacaaattattctatttctatgaaagtgtaaaaagagctcagtatttattttatattttctattttgaaattgagatggaaatgacacattctattttttacattaacattttagatgggaacaaacaacatatgttagatggatcttaagattctaattttacacaattgataacttcagcttcaaaagatcataaatggtgaaaaacgtgccttgcacgtgcacgctcactagttaatactaaagtccttgatgatcaacaagtttcttcttgctaaaacaaaatgatcttctgatacagacaagaagcttcttttccattgccaatggaactggttgcacatgctcttgtcttcctgcagaagtgttgctggcatctatgttaccccgatacgaggatacggatacgcgatacggggataccgggatacggcttattttgaaaaacatggatacgaggatacgtctatatatacataataaattaagaaaaataatgcactcctcaaagaaaatgggagaattgattgaggccaaaataatgaacatgcaaataa

SEQ ID NO: 186 - DNA, 1501 bp, Oryza sativa
ctatttctgtcttcacccaatgcaacgcatgggcattttgctagtagatatagatatagatatagattagatatagatagatatctacctacctatattataattaataatataataaaaatataaatctatcatatacctacccctaattaaaaaattcagtccgcttcgtctgtcatctgtatgttttgagtccaagtcggtcttcaaggaaaaaaaaatccccgtgctagatacccaaattaatcaatcaaccaaaaacagcacgaaaataccaaatttaacctagatatcatgaatttgatcccaagaaatctaatcccccaattcgatccatctgagccaagacacaatacataaacgatagaaaatgaatcacgaaatcacaaatccaaaatcatccagggaaaattaactcacaaaaactaaatcagcgacgccactggtcatgggaggcgaggacgccgcttctacgaggagggtgccgccgccgaggctgtcgataccgtccgttgtgttgtggcggagaagagggtgaggacgccgccgaggagccagggggagggcaccgcggctgagacgccggctgccaagggaagggaagggcgccctgggtgagtggtaggggaagcgacgtcctcggtggggggagagggagggcgcgctggctgaagggtaggggaagcggcgttgccggtgggggaggagggggccggagagagggactgagggagaggaattaacgcgccgcggagagaggagagaaggtggggaaggaaagagataataaggtcgatggggccaagcattgagacgccgctctcttctctagtctagtctcatcccaaacacttgatttcctctaaagcgacacatgtcccccctccttctctcctaccatgtggttcccaattctttatttttttttctcccggtgagatgcagggtttcccaaaccaccagagccggggttaccgtgccccggcggtaagcacggttaccacacggtaaccgtggtaactgtgaaaaaccgtacaaaaccgtgcaaaatttatcaaaaatttaaattattttttaaatttatttaaatttaaggaggttaccgcggtatttatattaccgtatccccgcggtaagcccggttaccggcggtaagggaaaccctggtgagatgttgagcttgggtcggaccatccacgcggtgttgagcgccattgagctcatagtggcagccgggaattggagtcaaggcatcaagctaagccctaccaactttttcttcaaacttccaacttttccatcacatcaaaactttcctacacacataaactttcaacttttttcttcaaactttcaattttaagttaaacttccaattttcgcatggaacacaccgtgctgccgtcctactgaatgaaagataaatcacgtgcatgcgttatctttttttttcgaacagtcagaccgttgccgacgttttatataaagaagaatgtgtctc

SEQ ID NO: 187 - DNA, 1501 bp, Oryza sativa
gatgtgatgtattctaatacaatgaatattagcatacttcacctccaattctaatttattttttttacgaaggaatactctattcgtaaaaaattatacatataattaggtgatctcacataattaggtttagatttatttattattattttttaagaccgaaagtccgaaagcataaaaaacccaccgacctcttgccacacaagtcacgaggtacagctacatctaacatccagatcctcaaactcgtggattcaccggaacaaaaatagggacaatcagagggaccaaagcataaaacgcgcaaaacaaaaggtgcgctctctctcgcttctgttctgtctgcccgctttgcctctttttccctttcctttctctctcgagccttcctcttcctcttcctcttcctcctctactccacctcccctctcgccgctccagatcgattcccccccccacctcgcccgcgcgaattccccgctccgatctccgccgcctccctcccaggtcggtgctctcgatcttccgccgcttgctttttttttttgtttttttttggagatagtttgcttgagctttggtggactaatggtggactcgccgcttatcgcggcggcatgcgcgtggaggtatccggaggtgagcggagggggggaggcggccctggttagggtaggaggagacggggttcaggagggggtggggggtggggtggagttgcggcggggagcttcgcatttgctggttatttgggaggtatggagccgggttgggtgggggctaatcgcgtgaggttttaagcttggttgctatgaggggaggaatggtttggggggtggtgatgcttcagtgagctgtgttctgtccagcctcgcgcggcgggcggcgcctagtggttgggagactgggagtgctcatttgattgattgatccagattcgtgcctctcggtgcctgcttaaccatttggaattggatcattgttcaattgtgtagacataacccttaggaagcgcaaacttcttagcttgctgcattgctttgacagttctagtcattgtttggggaacttagggtcatgtcccatggtcatgttggttgtgaaatgcaaatgtgctagtcagacttctacaatacattggagtgtgtatttcgatgcggaaatggcgtactgcatatttttcacattctatatggggcatgtagtcaccattagtgatatgatagtatgcctgttttggttcatccttactttaatgttagtagacattgtatcatcaaagctgactttctttatataaccagaatacctaatacttggcatgtcttcggtcgtgtttcttaacaactgaactatctagtttaattttcgtaaaaaaggaaaaccaagtgcattttcgtttgctaattaattactgcccaccttttctacccctgtttacagcatactattagctctcctgtgaaagagaagaattgagaggtttctttaacatcaagga

SEQ ID NO: 188 - DNA, 1501 bp, Oryza sativa
cttgatattaaccacagccaaattaattagggcaagaagctaggtcgcttagataaaaagaatataattttgggatgtggtatgattttcgtcaaggaatttttagggatgtagaaatggagaacgaaccattagttactgacatcacaaatctactagtaactcttataactctatatattaaaagtatgtatcttttttggcagttggtacaccaaaagcaagctttatttgtccatttgggttagtgatgaaatggatgagcaatgaggtagtacatgttctctcaaaaaaaaaaggaaaaaaaatgggaagacataactaagcatttgaaagaagagaaatgacattctttcttttccccttcacatctgcccttcaattctcagaggagaaagatgatagggaaacatcagtcattgtcactgttgcaacctctgatcaccactttgtgatgtagaaatctccactagtgacagctaatgatttgcctctctcagggatacttaatgaggaaatatcaaacacaagagtaaaaactttcactggctggctccaaggtttaaaaaaaaaagagattagtcttgccctctctgtctcaagatgctatttaggctgtgtttaggagtaaggattgggaacccttctctcctgcacataaaacaaagcatgcattagcgcatgattaattgagtgttaactaaaataaactttaaaaaattaatatgatattttaaagcaacttttctataaaaaaaacttttataaaaacacaccgttcagtactttggaaagtatatcaaaaaaaaatgagggaggtgagttaggaaaagagagggaagaatacaaccttaggaccactttgaaacaccgttcagaaaaccgccacaaatattttataaaaaagtttaagcactccaaaaagcgaaatatggataccagaatttgaaccatatcatcatcgaaaaaggataataccagattatgctaccagagtcctggtgactgtgaaaggtcactgcctcactggtgtcaacatccgttgtcgtgttaggtcaaactcgaaggagcctctgtgctccttgcaaacattgtgagtttttactggacatccgccaatcatccacttgcaaacatttgagcttttataatgcttctattttatatccctccaaaaattcatcacccaagtagattaaggtttagagttacttttggtaagttcatctcatcacaaaaacacttgtatgcaaacataatcttgctctgactccgagtgagatattgtacttccgtggtcagtaaaaactcaaaactggggcacacgcttgcattagaatatgacaaaagttaggctgatcatatcacatcaaaatatgaacttaataaacacgagcaggtaagaggccatcaggctcaagctcaactcacattcagaataacacaagccattttcatgagcaagtatttgcaagaatgtaacaattctcagataaatgaa

SEQ ID NO: 189 - DNA, 1501 bp, Oryza sativa
agacaaggagcaccggtcaccaaggacatcgggctagcagtaggcggtggtgcatcgtgtgtgtcttttcatcactgaagtcttgtggagatgaagagttgaatacacagaagataagcgtgcgctgtggggcagcaaggacggcgtgcagctgccaccgactttcgcccccacaacgcttgtcacgctgcctcggccggcctccgccgccgctgaccgtgcgctgtaccctataggtagcctctccatgccgtccgggtcgaggtgcaccgccgccgcgtgagagccctccccatctctccttttctcgagctcggctcgccggacccgtgttgtcatcgtcgctgtcgctgtccgcttccacccaccaaacgcgtccctctccttcgacggtgggcacgtcgtgcgcgcatgcggggtgggaggaacggcgtgacaagacggacggcaaagagtatatgggcacggcggacgcgggcggctgccgatgagggaggagatgccaccggcggcggcggcggcggcgactctccgctggctagcgtccagcccgcggtgacaacgacggccgcacgccgcactcccccacacaccccgcgcgcggcgcccgacgcctccgacatgccgccgcccacgaccgcgaaccacccgtagcaacccggccctcagcccctcgtccgcctccttcgccgacgacgacgccgcccgacgcacacgcggtcgagactgcctgctagcccctgcccggttttgcagttttcaccaactcgccgggagctcgcttcggaggatgaagacgacgccgacgccgcacgcgaacgaaagcgaggtcgcagcccgcctcgctcgcctgctccgcggttctcctgcgcatgcggcgaacagctccgcggtcggggcacccgccgagtccatcgccgccgcgtggccccttctcccgtgtcgccgcgccgccgtgtcgccccttctcccgcgtccccgcgtcacctatcgccggcgccgcccagctcctcccccgctggcgccgcccagtttttacgcaccagccatccgccgcgccagccgaaccgtacccagctggccagctgctttcgtgggaggagagagaggaagagaggtggagatgggaggggaagtagaggctgacacgtgggacccatgtgggtcccatgctgagtcagctgctacgtcagttaaaaccggagtcaaaaccgtcgagggatctagttttcactggttttataagttagaggaggtattatatccggttttacggttcggagacgattttgtaactcgatgacaagctgagggaccttcggtgtactttttccttttccaaattgtaacgggccgagtgggccggaaatggcatgaacgccaacttaacgcatttccattttcgaaagaaaaaaaaaaccacacgaattcccaatttcaaacgccgatctctccgtctcgccggccaccgcaaccacccacccacccactctaccaccca

SEQ ID NO: 190 - DNA, 1501 bp, Oryza sativa
aagagggggttccattttataggatgggggcgggagccgggctcgggagggggcggaacggcgacgggaatggcggccggcggccatggttggtggccgggaaaagcgcgaccgttcccgacgattgggggcgccattcaagggggaaattggggggaattgcagaggattcaatggggtttaatttcccctatttaattttggaatccccggttttatttaggcggattttgggaaggcaccgagttatggttttcgcgaaaaacaaaagtaccgcccccgcccgaggggaacaaaaaaactcgccccggggggggggcccccaatgggcacgggggcgcttatcgagggggtgtttaccgggggttaccgggacgatacgggccgttttgggggggctcggctgggccgggacacggcccagatgggagggggcagggcggcctgggccgggcaggccgggaggggagggaggaacggcccgagagagagagggaggagggagtgggccgggaggggaggagaggaggcccaagagaaggagggagaggaggagagggagaggaagagagggaggaaagggagacttcggccgcgggccgaggggagagagggaggactttgggccaaaattggcccaaaagaaaaggaggattatttttagattttctttttattaaactttgataattgtttttgttgtttaataattatttccggtgctctgaaaattcaagtaaaatttgagggctcctttttagaccaagaagaatttaacaaaaattctccgagccacattcgaatttttcttgtacgtattttaatgtttgccaatttcttttcgaattttaattaattctattattccttttagaaaatgatttttatttcgggatgaatttatcaggacgtgacacctataggcacacagtcgggtctctcggtggaggcagcgctagacactagcgcttggctttttgaaatttctaacattagatttttttttctctgttgaactcattgcttaatctgagagaagcttaatttcttaaaaggaaaattaatcttataagaaacacccaactagacattaagatatggtagcagaggagatacattaatgttttgatatgcccttattgctagcaatgtcgccgtaagacgcaaaatttctaacctcattgccaagttttgactggatgccagtgatatgcccttattgctacaatgtcgcgcaaaatttctaacctcattgccaagttttgactggatgccagtgatatgcccttattgctacaatgtcgccgtacgatgcaaaatttctaacctcattgccaagttttgattggatgccagtgagagatgatctggtagatgaataattttctatcatactctaccgatactattgttagcatggtaacgctttgtcatttaatgtagttttgtttttaatggtaattctactctacttaacaaattaaattctctgtggattagg

SEQ ID NO: 191 - DNA, 1501 bp, Oryza sativa; identical to SEQ ID NO: 173

SEQ ID NO: 192 - DNA, 1501 bp, Oryza sativa
tagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggtcgtgcctgggccgtgagtccggcacgtgggctggcacggcacggcccggtgcgtcggtcgggccgtgccggcccgacaagctcggcccaggcacggccgggcctgggccgtgccgtgccgggcggcccacatggccaactatagctacagccggggctatgttgcatgtacagtgcaaacagtaaaagaaattgtgttgggcaggggtggattcaacgtgggggtgggggccttgagttcccccaccctctctggacctatggacaacccccaccctatgccctcttcaaaaatttcgccatggatgatagagtaggaggtgcgctaggtatctggatagctagaggttgaaaaagcgtgaaattgggccgatgaatgcatttgggccaggctcacttagaaaaggaatccccttaaaaaggaataaatccactttgactccctgaaatttaacccaaatttaatgcatgaccctcaaccgcaaaaccagatatcttgacccctaaactattaaaacctgtgcaatttaactcccttggcggttttgctgacgtggtgcctacgtggcaatgttgactggtatgtggcattgacgtggcgcttaggtggtatttgaattaaaaacttatatgtgggacccatttgtcattaaaaaaattttgtggggcccacatatcatcctctctttctttctctttctctccccttcggtcgtccgcacggagcacgggctggagcggcggcgggcgggaccagagtggtggtggtcagcgggagttgaagcgacagcggtgggttggagctgaagcgggtggaggcagaggagaagaaggcggcattggactacaaggtcgcacctcctcgcggtggcagaggaggaggagaaggaggcggtcccacgccatctgctcggatgtccccctggtaccctcgggccacactagtgcccagctcttggcccgccgaagctgtcaaccgccgcccccctcgatctcgttggcatcggcatcggcgctgccatcttgtcccgcctccttgccgtccctcgagcgctagctgccgctccagctccatcccaccaccgttgccgctctagctagctcccgcgtcagagagagagagagaggaaggagggagggtcgagatatccggtattgtggttaagggatacgaattagactcggtcactagttaagggagtcatagtggacttactccccttagaaaatacttctaggctgcaggcccacaggccacatctagcccccagcggcccagcccaagtttccattccccaatccccagccccaaatccctagcactagccaag

SEQ ID NO: 193 - DNA, 1489 bp, Oryza sativa
ggaaggggagaagggggaggagaggaggaaggggaggagctggaggagaggggacgaggaagagagttagagaggatagatctgaggagagggggtgagattcgatctgtctaagttataactgtggatgagaagataagtgatagggattatatactacgtgtttaattttagtcccggttggtattaccaaccgggactaatgatcaagagtaccaaccgtgactaaaatggtgatatttagtcccggttattgacaccaaccgggactaaagatcctcggccccctgacatacatctgacagggtatgaaccaggactaaagatcaagatcaaaatttttatctttagtcccggttctttttggaaccgggactattgtggattttgccagaccgaccaaagatggtttctccaccagtggaaagatgaatcctttcactactttagattttttaaatttttagctaatatttaactaaatatacgctaaactgttgtttcgttttgcgtgcaatgaggaaagtgttttcaactccaactgacgaacacaacctacagctggagctgtgccaaacggtatagattctctattttttggagcggagttagtagagctgctccacaaatttgtactacgggggtggagctaggtttttgctactccacagcttcactccaccgcaaaagacccactaccctttaattttttagtctatttataccaaaatgctactgaactaccccttcctaccccatctcccgttctcgctcatccccatcttcatcccttgacaccggcggcgccgttggtgtcggcagcggcaggcggtggtggcaggtgttggtggagtggcggcgagggccacgagcggcaacggtggcgggagacggcacgtgggcggtggagtgtggtcggcggcggcagggcgaggtgcgagagtagcgtcggctgcggcagcaggcagggccatgcgcgtgcggtggcggaggcagtggggcgacaccaaccaggtgttcaactaaatgccaacaagggacgtgttggtgtggagctaatcaatctagccaaatacttatatacccacttcagctcctataggagctagctatcactggagttagagtttaaagttgggagttggagcttggagtcctactaaacgggcctaagaatccggataagaatattgatcattcgagagctagaaatttttggagaaactgtggccgctaaaatctcgtccagatagtgcctatagtaacctgccaaataaagtattgtagagaatctcatccggctgtcaaggccatctggccatgcataccaaatcttttctcaacagcaaaccaatatacggagtatagtaagtactagggtcttataagagtcgatactcgctcttgctgccgccatggcgaacaagggaggagagccggcagcaagagcagctgtgcgccatggtggaggccccgtcgcgttcaagga

SEQ ID NO: 194 - DNA, 665 bp, Oryza sativa
gaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtgg

SEQ ID NO: 195 - DNA, 1501 bp, Oryza sativa
gtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcggccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacagcaataatacgtcattacatgtatagtcgttgttgattagtaatccattaagcatcgcatcgcatatgggtcattacgagtcgtgctttttgtcgttacaagaacccaacagctattttttgttgaacagcttggcaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccattt

SEQ ID NO: 196 - DNA, 1501 bp, Oryza sativa
aagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccggtggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcacccccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagat

SEQ ID NO: 197 - DNA, 1501 bp, Oryza sativa
cacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggatgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagagactccgaacttggcctcgagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtctaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctcctgtcggcggcggcgtatcacctccgccaacagaggcggcagcaactctagacatggcgatgagcagtcgtgcgggaggcactccccaaaaacctgatcacccgcctacccggtgtagatctcag

SEQ ID NO: 198 - DNA, 432 bp, Oryza sativa
ttcgtcgctccccatggaagttcttttttatttttcttttaagctcttgatcgaactcctgcatgcacgagccaccagcgtgtgtgttcaactgtgttcatcatccaaatgcattccaggcgaggcaacatgcatgcagattattgcagtgtttggccagcctgacatccccatgaatcctaacatgccatgtcccctatctcaaacattccccacgaacatgcctcgcatgttcctgcaaattctatcatcttctcgatgatcaacctgttctcgattggttattataaatacaattccgctcgaaatcgaatagcaacagcaagaacaagaacaagaacaagaagatcaggaagaatcaattgaagaattaatattccatggcaatgccgtgttccggtgagcggtgccgccgcgtgtggtggtcggcgg

SEQ ID NO: 199 - DNA, 1501 bp, Oryza sativa
atgctcgcgaagatcgtgggcaactcatcggggcgacatgttgggcaagacgttgtggtgaggcattctcgccgtttttgttttgcgcagcggggaggatcatcgatgacttcctgattacgaggagggatctcgtggtcatgtgttcttgcagctgtgtgttgatggttgttataaaccaattgcgaccgtctatataaccgaaataaaggagaactagctatgcttgcaatgcatgtttgttatagaataatctatctccacttttacttggactttacttgtttgcagatattgctacacaaatggaaattcatcaagaggtagacttatgcgtgtatgggcctctaaacccattaaaatattatcaaatgggcccaaacactacactactagctagaccgaggaatcaacgagaagcacattgacctagttttgggccagtttgtcacaccccgaagttttcctcccaagccaaaattgtaatttataaatgaccctaagaaaataccggtgcaaatcaggagaaaaccctaagaaagtaatgcaaataataatcggatttgacatgtggaattttttcttgagttctacatgtcgaaattcattaacaggatttttagtggaattttcagagggacccacggcgccggccggtgcgagcctgggtgcgcccggtccaccgtgggccgtggggctgccacgtgggccccacccccgtggacccggtccgcgcgcccctcccctcggctgatgcaataaacccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcgtttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgtttcaaattattgcattatcgctttatttaaattcccgcgttatcactgttttatttagccatgcctatttatctttgttatgaccttattattattgctattgttattatttccttgttcaccctagaataaacaaaaccccaactagtggacactctactcacgggatcactagtatgattttaggtagatgcttcgcttttaattaggtaacattaggtggttttacaactctagactttgggatgttctcatcacctggacacactggaattgttggattattgtggaattggattcacacctccccctctattcaaaatccccaaaatggttttaggctgggctcggggtgcatggttttgatagtagcacctcggccatataaggaccggt

SEQ ID NO: 200 - DNA, 1501 bp, Oryza sativa
agaaatggataaaggaggaccagcggaggagatgggccgaaggccaggccaggtgggcctagcccacgttcggccgaaccccttggttcggccgaaccaaaatctcagccgttcaggctggggtttggcgtggatggtcctgatcatctcctgatggcggttgcggggcatttccgacaattcgcatcgtgtaacagtcatacctacctctatataaggagtttcactccttcactcttacacacacttccaagattgagctaaattataagaggctctattgtactatattgtatactagaataggaagagagtagagtagaagaagtcggaagaattctggagttgtcggtaatcttctctcatttcttttattttgttcattactctgatttcaatataatattcttcctgagtaatttagatttatcttgtgagaattatctcttggttagttcctaaatagcatacgggattatcgttcactataatcaactgaaatatagagattgctttggtgagttataaatactaaagtagatattaattgcttagacgtggtgtttaggtaattgttatccagtaattactgtgtatcccacagtacgtttgaggtaggtgtagaggtggtgacagccctcgagatcacttaagtcttccctgtccgggtacgtagtagagcaacatctgggaatagcgggttaccagtgcctgaagtattacgttaggattaaacttaaactttcctagacactatttctcaccagtgaatcctcgctatcccgccctatcctttgcttggtgttcttggatgaaccggaggaagaactgaccacacatgtttccttggattcgataccctttggaatactccgtaggggaagtgctacatctgtatacccgtgcgcttgcggattttatctgtgatcgtaagaattaccagtagactgcgaggcctacgcagatggactcgataatgacgcgagcgatcagacggctctgccagcgtcgaatgatagcgctaaaacaggagggctctcgaattagattttactattggaagcccgacaaccagtctacttgataatctgttacccaaatgagtggtgatgacgacaagtacgtgttctggtcttctggtgcgcaaaacgacgcatatccccaaattcccaaaccaaattccgaacagaaagcacatcgacgtgggaaaaacagattctcaacaaaggagaaacaaacattactagtgttttggacatgacgtagacagacaacagtaaaaaagttcaggggacagattctaataattgagtggatgtagactcatttaacgtggatcttataatctatatgttatttataaaaatcaaatttaatttaatttatatgtttgtaaagtaatatattatatactaatatattttattatttttcttaaaaaattatagctacttagttaatatgcaatgaacgagtgagtgtctatctactaaatcagagc

SEQ ID NO: 201 - DNA, 1501 bp, Oryza sativa
ttttgtttattctagggtgaacaaggaaataataacaatagcaataataataaggtcataacaaagataaataggcatggctaaataaaacagtgataacgcgggaatttaaataaagcgataatgcaataatttgaaacaacataattttacaaactgggattcaatatgttcaaagatgatgtgacttgccttgctcgctttcccaaacgtcggcttcaacttccacgaagagcggatcttccgaagctgcagcgtctacacgaccaacggaaacgaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcgggtttattgcatcagccgaggggaggggcgcgcggaccgggtccacgggggtggggcccacgtggcagccccacggcccacggtggaccgggcgcacccaggctcgcaccggccggcgccgtgggtccctctgaaaattccactaaaaatcctgttaatgaatttcgacatgtagaactcaagaaaaaattccacatgtcaaatccgattattatttgcattactttcttagggttttctcctgatttgcaccggtattttcttagggtcatttataaattacaattttggcttgggaggaaaacttcggggtgtgacaaactggcccaaaactaggtcaatgtgcttctcgttgattcctcggtctagctagtagtgtagtgtttgggcccatttgataatattttaatgggtttagaggcccatacacgcataagtctacctcttgatgaatttccatttgtgtagcaatatctgcaaacaagtaaagtccaagtaaaagtggagatagattattctataacaaacatgcattgcaagcatagctagttctcctttatttcggttatatagacggtcgcaattggtttataacaaccatcaacacacagctgcaagaacacatgaccacgagatccctcctcgtaatcaggaagtcatcgatgatcctccccgctgcgcaaaacaaaaacggcgagaatgcctcaccacaacgtcttgcccaacatgtcgccccgatgagttgcccacgatcttcgcgagcatctgaacagccgaaggcataattgacaagaccaacggaacaatggccatcgacaacatcgcgatcggaatcgccaaggcaatcgtctacacgagaaccaaaaccaagaccaaattcgaaatctttaagatcaacagcgttagcaggacaagaacggaggaggtcagcgcaatcatcatgaagacagtcggcgaagcggttcacgatctccagctccaaggcgagatcaagtccatgacatacgatattgagatcgcaca

SEQ ID NO: 202 - DNA, 1501 bp, Oryza sativa
ttggattatgaatcaacggtagagatggttcaaaggacataactgtaaaacttgatcttccaagggtgtttagcgaaaaagctagcattcattctagggaaattctcccctcctctcgcccttctccggcgattcacgaaccgcctccaacgttggcctccgccgcacctagccaattcccatccctaaaaaccctagcccacagagcctccctcttcacttcacctgcgaacgctatgttgttgtttttgtttgatggattttacccgatgatgacgaatgccctgaatattctgaagtgcttttcagttgtatcatttccccctctttagatgtgccgcactgcaattttttttctgtgagcacaattagaatttaacttgtctctcccattaccaaataacttcgttacagattgcatattcgggttaggtagagcaaaaatcaattgtcgtgatgaatcctgaagccaagctctgaacaaaaatagttatccctcttgctgaatatgatggcattgttaggatatctaaaaataacttagaaacatgccacaatggatgattttgtaccgtagcaccggtggctattatatataagcttacctcttctttatagtgcttacatttctctccagttcattacttcatttcatgccaagtttccaattagcctatcaatttatttaacccatccgttcatgctaccatcacttaacacgagacatgagtatatcaatgacatgcattgcattgtcattagttttacaagacatacttttaccatcacctggcaaaccatagagcatattaaggtcagataacatgatatccagggttcttagctgctaccatagatcatggccatagtgctttgtttttgttttccattttcttggtgtcttactaaacatatagctaggatatgttattttttccaaataccagttctgagaaacctgatagctctttatattcatccacactccacaacaattaaacacacatgcatagaaatataaacactcctcctttgagaaggaatatttatgttgtcaatttcatttgcctaaaactaacgatcaggttagggaagacaagaaaatttttttgtcaattttgaatattttagctgatcagattttgttatcacgatgagtaatgtccgtgaatataatgtctgtcttccctgcaagacttctgaatataattttcaattggtaaacttccttgatatatgttctgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctttagggggca

SEQ ID NO: 203 - DNA, 1501 bp, Oryza sativa
agcaagacgtagatgagcacagtgcaacatagtactaagacaagccggtcccaaataaggtgtgtggaagtacgtatggtgcttgaatagacgtcaacatgttcggtccttaacaacccagacaaggctacttgcatcagggaaaatgaccatcccgtcatcgccctatcacacgtccaagctaaagcatgtttccatattaatcattgagtgaggtaatcagattttaatgcccataaatcgcgggtggtgaataagttcatccgatggctccatccatcgatttctaacaacagtagacctaagcatggctaagcattcgatgatagaataaaccatcctaaccatttacaattgaaggtgacaaggttacatggcaacaatatattaaaggaagggaaatgcatgaacttggatataaacaactctacccgttaccgacattttaaggcaattcaacttatgcatatatatagtttttgcaagcaaataagttttgtgaaatcataggttcaatatccatagacgcttgccttgctgctgtgcggaaacacactcaacctctgagtcttgctccacgtattccaaattctccgaatctaccaataagaggcaaatatgcaaataagattcaaataaatatgcatatgcaacatgctctataaatcatggcctaattacagtaggtagagagtatgataaactaattttaggaacaagaatcaactcatttacatttatggtttgagaggtataaaaataacaagccatatacactgaaaatggcattgtttcagttacatatgaactaacctaagtcatatgaaaaactgacattttcttaacagaagttgaaaagttttcctttacaaacataaggtctacaaggttatgaatacacagggatttgattcattcaaagatgagttaaaatgaaatacttatggctttttgaagttttcccatttctcaacaaggtccagcttcttctccaattgagcagcaatcatagacagccatggctgagctcgatctcaagctcgctggcagcaaacgatggctctaattggggcaaggtcaaaagagaccatgcagatcaagtctttgagattccattcctatactctacccagcccagtggtggccggacaggtgcaggcagcggctgcaagtgccagcgctcgggatgtcatgcatgtaacgatgcagcgctgtgggtggatcgctctattgcatgcatgtcaagaacatcacatgcaagaaaaacatacattaaggacttgatcctactgctaagaagacactttttggcttgaggtgaagagctgatacctcaccaaaacagggaagcaaagaagacaccgagcagttgtcaccaaaggacagaaaacaacgtgcaacctgctcctatccttgaaatcttgaaccggcgaccggtggaggaggctaggaatgctcagcatattagggaacctaagagagaagctatggatggggaagg

SEQ ID NO: 204 - DNA, 1501 bp, Oryza sativa
gtatatgaaaataacatacctaatagtatacacggataaaaaaggaaattatcttctcggaatataaggtgttagagtcctaatcgggaaagataaagttttcttagttcgtatcttgttatatttctccgagttctactgggagaggaagataatcttcactataaatacaagacctcctaaaaaaaagaggggacacgccaacagaggcaaatacctatctagacaaacccaatgtagcagccacatagctagacatgagggatctataactaccttcaatctcaccgagttcatgttcgaggaataagagtacactagctgtcgactaggtgtgagacctctatgacgccaagtcaacaaagtccagattaggtcatttcaaacatctactcgtgtgataccgatatataaaagacaccgattttggccaaaatgagtagggttattacctgtcagttaaggaaaccaaacttatataaaaatctatgtctcccatctcggttacctctgcttataccctggtttcaaccattcttatactatacaaataccgtctgcggatataacccgtcgataattccaaatgatggtattatagtttaattttgatttattcacgttattaatttacagccaaaatttcgggtgccccgctaaacagactacacgagtccgaggtagggtccacaatttcgtcccctaatattcgggattttgtagctcctctgaacgagaattttcataatataccacccaatatgcactgctttcaatctggccgctagcaagctcatcctcccccacgccggcgagctcctcctcccccacgcgccgtttgcccgcacgcatctggcgagctcgctcgtgtcgtccccgagctcagccgtcgccgctccggctgccgccatggcgccccgagccatcgccagtccaacctccggcaccgcagcctcgagccgccagagctcgacgccctccgccctcccccgctgctcccctctcctccggcccttcaccgcgtgcgccgatggtggcgacgaatggtcgacggcgcggctaacgcgggcagcgacggacgggcgatggtggggctgacgccagcggcaatggataagcgacggcgcagctgatgcgggcgcgagcggcggcggactgacgacggtggcgccgggaggacggaggacgacgacacgactgacgccaggggacggagtggtacagaacgaagaaaattcacactctagtgatgtatattccgaaagtaatgtgaattgggtgataaattctggaagcagtgcgtattgggtggtatattctgaaaattctccctctaaaccgctcaaatttcacgaaattcgtcaaagttccaatttggaattcaacgaaatttattaaacctgctactaaattaagtcagaccattttctcagtagcgaaaccacttctgtttgctctcccccgatgccatccaccgccgccgccgccgccgccgagatgg

SEQ ID NO: 205 - DNA, 824 bp, Oryza sativa
ataaagcatacctcctctatatatgtgggttcacggtatatgaaaataacatacctaatagtatacacggataaaaaaggaaattatcttctcggaatataaggtgttagagtcctaatcgggaaagataaagttttcttagttcgtatcttgttatatttctccgagttctactgggagaggaagataatcttcactataaatacaagacctcctaaaaaaaagaggggacacgccaacagaggcaaatacctatctagacaaacccaatgtagcagccacatagctagacatgagggatctataactaccttcaatctcaccgagttcatgttcgaggaataagagtacactagctgtcgactaggtgtgagacctctatgacgccaagtcaacaaagtccagattaggtcatttcaaacatctactcgtgtgataccgatatataaaagacaccgattttggccaaaatgagtagggttattacctgtcagttaaggaaaccaaacttatataaaaatctatgtctcccatctcggttacctctgcttataccctggtttcaaccattcttatactatacaaataccgtctgcggatataacccgtcgataattccaaatgatggtattatagtttaattttgatttattcacgttattaatttacagccaaaatttcgggtgccccgctaaacagactacacgagtccgaggtagggtccacaatttcgtcccctaatattcgggattttgtagctcctctgaacgagaattttcataatataccacccaatatgcactgctttcaatctggccgctagc

SEQ ID NO: 206 - DNA, 1501 bp, Oryza sativa
tgtttgtgtgcgtgcatagcatgtttaacccacatggaaatcatggcgtcttttttatgtgaattctgtctttgtttgaatcgtattttgtacagactttcctcgttttggacgtagtaataagtagtaaatcttgtcacaaattagctgttgatggtttgatcgttgcaaattgcaattatgcaggatgattttatctttagttttttttaggctcttgtttgcaataagaacaggagattctttttttttagagatgaagaacaagacatatttaagtctgaatcattatctaaagaaatgttttaagtgtggatactgaacaaaactgtgtttatgctatgcaaaatacatttatgcattagaccacattacaaaatcaaacttgtttaaaaacaagtttgatttttgtaatatgggcctaatatatgagcctctaactctgcgattttttttagtttttaattttatttattaaaatatttaaaaaataattttcgttttgaaaatattgcaaaactagtcgcccatcgcttaaaggcgactagttttgtaaatttttcaaatagaaaactatttttttaaatattttaataaaaaattaaaaattaaaaaaattcctaagtctgcaacctcacagcccaatacattactgggcccaaggcccaaatcttctagtaaccaaagtccaaaggctattctgaaccgaagtcctcccacaccaaaacttcgaggcccccgtcgcggcaccctcctccgccgccggatctccaccggagtacggcgccggccaccccctcctcccccggatcttcaccgccggtgagtcccccgctccttcccataatctctcggtgagtctccgcctcttcccgtcctcctccttgctcccccgcgccccgcctcctcaagcgcacggccggcgaacacccagaggcgctgtgtgcggccggcctcctatcgttgtcccacccccaacgtagccttctcttctccccactgccggatcctcgcttgcgcggccggggagcagcgttggagccaggggtgcgaccttcctccatcttggttcgaatggtagcgtttgtttcctagaggaattggggggctcagctgagaaccatggccggcgttagtttctggccatcttagcacaatgacactacggagtattaatttgtactaggtgaggttatttccacctccaatctgagtttagttttagttagaccgctacatcaatccaagcttgcaaggtaggaacagaaactagtgaccagtttgctaatgtatttatcatgatgcaattacctttgtttttgaactaatctttagcttagatatggaatccgtgaatgaaatggcatttcccctttctgtttcactttcatttcattccagaaattcattgtgaatagagttttcgtatagcagcataaagatcttctgaattcatgtaattctaatgtagtggagcggtacaggtgaagtactgaggtga

SEQ ID NO: 207 - DNA, 1501 bp, Oryza sativa
gacagctggcgacggcaccgaggaagagaggaggggagggagtggcggccgccgcgccaccaccacttgactagtcgactactctttctctgagctcctgctaggtggaattggtgcaagttcggataccgtgtcgttgtcgttgggccctctcgtcattttcgtgtgcgctatttatcgtttttttttgtttcaattgataaaaatgatttgtcgcgattgctctttttttttatgtagatgcctacaaccataagattcataatgaaacgcatctcaaccaaacaaggaaaaaggttttgtgcccactctagaaaattgaatgacataggagtatcaaagcaacctacattattatcttgccaccaaacataagctatcgtccggttctataccttaattgttttacaaagttaatctcaactacccataaagatcacaccaaatacaatgaggttattcggtaattttgttatgtagctgttcaggctacacgggatagcgcagccactcggctactcggctacaggtctagactacatcctagccattcatctgttgtagctactgatttatccgctgagctactgttgtctgtcgcaggctcgcagcaggcagcgctgcagtagctaactctttcgaacagatttaatatgaaagttcaatctatatataaagattgaactacatttggactacatatataaaggcaaaaaaaagataaataaaaaaacgagtcccatctctatacattacatgcattaatccttcccgcttaccatagaaacaaagtggcctaggtcatgtgctgcacggtgcttatcattgatgcagaaaacctgtgagcaaatgtacatgaaacatggcacgtactcaccgaaagaacagaaaagaatcgcatatccatgggaaaagaaatggagagcatcctgtgataaagccatgatgcattaagacgacgtacattgataggatcctgtgaagaaagagagagaaaagacgatcgtcacatactggtgttcgagtggtgacccaaaaaaaaaaaaaaacaaccaccagatgatcagtccgtgcatgcagggacgccccggacagtccagccatgtgacacggacagattggtcatgattcatcctactacacgttagtacgtactcatccgtaaaaaaaaaactcaaatttgttatactacatgacatatttctagattcatttttttttactgagggagcaggaataccagtactaaccagggttaatattaccatcggtaaacgcgcggttaccgggcttaccgcggggtacgataatataaataccacggtaacctccttaaattcaaataatttttaaaaataatttgaattttttgataaattttgcacggtttttcacggtaaccgtccttaccgccggggccggggttaccacgccccggcggtttggaaaaccctggtactaaccatgtgattgagcaatgcacgtacattgcgcgtgcgca

SEQ ID NO: 208 - DNA, 1501 bp, Oryza sativa
gatggatatagatggatacctcactatacgacaatggagtaatatacttgtaccaatcgtttataagcgtgtatatatatgctttgtaaaatcggtgaagaaagaatggtataatttcgaatatttatttatttattggcgagagagagagagagatgtagaccttgagctgcgcggtgacggtgtcctcctggttgggcggcgcgatgatgggcgtgccggtgcgcgacggcgagccaacgatggcgaaggagttgtgcgtcgtgagccatgtgtaccggttgaacgcgaggtccgtcccctgcaatgcatcaatggattgaggaggaatttggttgctgcattgcgaaatgatagaggagtgatgtgtacgtacgtgcgccttggggtcaaggggcgttgtccgcgagcacacgggtggtcccatcccgggcagcggtgagcaggtggcgcaccgcatccccgccccgcagctcgacgccgacgacgccgtgcacgtgtcgcccaccagcgcgccgccctcgcccccggcgacgcagcatgcggcaacaatggcgagcagcagagccagagggaacgtcgacgcggcggccatcgcaggaagatcgatgcaggcggatggttcatccgttgcgcgcgttggtgcatgcccgcgcggcgcacacacacacagataatatcgttggttgaaaactgtgacaaagtcgcggggaagccggggagcacacgtactagaaatagacacggccgcccggttgttgggatcggatttcttcttctacctctagctagctccgatccgttgttgtacgtacgtactgcttgtacgggacgatggcatactactattacacacactaatgcgtggggtaataagtcggtgtacattattacagcggtcttaattaatcaagccaaggcagcgagcgagagattgttagtggcactggcagctaaattaggtggctgcaatgcaatgcatgtgatactggactgcgctgagtggggggtggtgtgccagaatggctgcctgcctgctgcccccacccgctgtctctgctggactccactttctcgcctctactgtttgccatggcccaaataccggcccgtcttgtttagcctgcaccaaagttcaggacaaaccctacttaaattcaacaaattttggaggcaaacttattactagtaggtttccaacaaactttggtcaatcctcagcgtggcacatgccttcaattgggtgttgggagcaggtggtagcaaaagatagggattgtcacggggagacacccacataaaagcgcagagccccaaaagcaaatccttccttgtcaccaccgtagtacctgtaccacacccaagagaagagagggagagattcaggaaaaaaaaaaaacaagaagaagaaaacctcggccggcgcagccaaaaccctccttcactctctctccttcaacactgagctgagctccacactccgcgccgccatccagccaaa

SEQ ID NO: 209 - DNA, 1501 bp, Oryza sativa
gccaagttcatgccagctcgtccagaaaggatatgatcatatgaatatgaatccacggtcgattccgtcgatctcgccggtcgccacagccttgccgtcacctgtcgcgcaagggaaggaagcgtgaactgttgcctcgctgagccacactgggctgtgtatgttcttattcagtttttcttcttcttccacggagccgaagcgaagcccagaagcgaggctgcaactattgcaaatgtcagtctccagcgtctctagccgtcgccgttgtgcatcggtacttgcagagtgagcgctttgccgctggctggcagctcagctcgatcagggacgagtcaactcagagggaagagctgtatgcgtgctttgtggagcaggagcatctcacagattcttcgcaggaaacactactattcccagtcgcccacttctgtttgatccttgtgtcagttcagagaaaaggattactatctgtaatcctgtactccaacacgagttcagaaacgaaacctttggcgaaaaatggacagtatatgatactcggatcgaacagctaaacctgtctctgatcaacactagtatactgctgtagttgtattttttcagacaggattctgaactgaagcagcagtcatccgggcaccggctcttcttaaactgctcctccccttctgctcgtgctgtaattcttcgtgacagtgaagaactgaatcctatcttactctactaacttcttaagcttgacatgtgaagatgccacatcatcatctactaacaaaataccacatcatcatccactaacaaaatgccacatcatcatctattaatccactaattaacaagatgccacattatcatccactaacaatcatcacatttaaacatcatgtaaacatgctatatctttatagctattataatttaagagcttttcaaatataaacatgttaaattatcatccaacataattcatataatgtttcaatgtatatctttattatattttatgatatcctatatacttatatagttcatcctcacttagttagtacttaaatgattaatctatggtccaaattatctttctcctttttttcctttaattaagtcatatcacatcaattgtttttagcctttagatgattattctacggtccaaactatatccctatttttcttcttccataaagtcatactgaatcaccattctacatactatttaaatttaaattatcataaactacattaatttacttaatctgatgttatctagctatcttatacgttatttttttttgttatcatactaaattcccgcaacaatacgcggggtttcacctaattgtgattatagtagatggcttgtgctcgtaaaatgcatagatttggtggcattgactggttctgtctgcttgctcatgctgttggagcttagctgcaatctgtcagtgataattcctgggcagttgcaccattatgctcgtctgagccatggagactg

SEQ ID NO: 210 - DNA, 855 bp, Oryza sativa
tgattctgtggataacaagtaccagcaaaaaagtactaggcccgggctggcttttttgcatgggggccccttgccgccctagggtttccgtgctccctctcccgtctgccgtcaccgcccgtccctcccccgtttgccacgtcagcttgccgccctagtggagggcggcatggtctatttttgtaattttttttgtgccgatggattatttctgtaaatattaaaagaaaaaaaaattaaaaatgaaaaaaaattcgaacctgcgtcgcctctccctgcgaaagcccaaactgttcacccgctgaacaacacgggccgtctctacagttcattcatccacactgcaacgcaagcacagccgtcgcgaaaacgccggaaagtacacgagtacgttacccccctccccctctctctcgccgcgacgccacacgacacgacacgcgacgacgcgacgcccaactcctcacgcttcccttcccttcccttcccccatccatcctctcctccgactccgacctcccgcaaccgcagcgccgcccgatccgccgccaccgccaccgccaccgccggcagctcgatcccccgcactcggtaagctccccgccgatccttccccgccactcgtgctagggcttcccggatggatcgccgtttcggttttggtcggacgaatcgaatccctaacttggtgccgtttctgctgctaccagggggggttttggaattggcgaatggtggcgaacgaggtggttgcggcggcggcggtggtggaagaaccggcgcccgcgtcggcgggggcggttgacccgatgaggctggcgtcgcggtggcggtcgccggcggagtggggggccg

SEQ ID NO: 211 - DNA, 1501 bp, Oryza sativa
accaatcataatcatatctacttaatttctccgtattctttaatcttaaccaattataactatctccttttagtttcacatttatccttaatcctcatgaacaactactctctccattcacaaatatacacatttctagaatttgatatttattcacaagtataagtattttaggagtattatttttcataaatgttcactagttgcatcaatactcgggaccttttctaattaagtaaactctcgtaagcatcaaagtaattgtaactcatccttaaattttgttaaaaactctaacaatacttatatttatgaacgggggaagtaacaaaccagctatcttccataccagtataccaccgttacttgtcagggctagcggtgcagattgtagaaaaatttccgtgccatctttaactagtgctatttttgttgttttcctctcttggtgcagtcacaaactaacaacacattgattaagatggagtgcttgatgaacaattaacacctacaccgttcatgtattttgggattgagatgcagtacatttgctactatggctacagaataagttactgtacacaatttgagccctctattttattgatctaatggttcaaattgtttgctacagtaaattgctataatattttactaatgtacctaagtcatctattttgaatccagtgatactcgtgttattgcttaccttgtaggcacactagccactgcatcttaaccagatccatgtatttgataatacagcgtactaagtgtgtttataatactacttgttaatattgctgataatttagttttatgaatgcgctgcaaatatataacgattggcaaaaagtcgagtgaattttcccttctggtgataatatcatgtgtcccgtcccgtgccttctgggcgaaggtagcaaaggcagatgtggacggcgtgtttttcagcacggggtggaaggaacagatcaacagattctatagagtgctgattgactctggctggcaagcagaattcctctccccactctcccgcggtacaatgcacgaagtacatgtgcagcgttgtcgaccccgattttagaaatcgaaaatttttaatgtttatcagtaccaatcccatcagtagtcggtacatatatatagccgaatcacaaatatcacgaataaattcaggctaagagaaacatatcacgaatgaattcaggctaagagagttaaatgcttacattagagccaggcaggccaacaactatcagaggacaacagcagaagacaaaataatacaagggcccggttgacatgccacaagcagtcgactggggaacgagacctagattagaaccgcactccgatcatcttgttaggtacgcaagcgtacaaacaagggcttctcttcaacactctactaaaagatatatatagagtaacaatgagtacaaaagtactcagcaagccaccacacaaaatgcagtaatgtacaggacaatacaag

SEQ ID NO: 212 - DNA, 1501 bp, Oryza sativa
agcggggacgataaaataaatttaccctagctgcttgtccagttgtcttgttggaggataatttctgaactcattagttttcccacatgtacaagaaaaaaaatgcacagctcaacccatgtactccctcaattctgttatactgatttctgaagtactaaatttgtcacaaaatgtattgatttctagccgtatctatcattatttcataactcaagaagtttatctttttaataccccttatttaccacctaacaacactattctactatgaatgaaaggtacttcggtcttttttttactctactaaattttcttacgattctaacattatttagttcaactaaataataataataacattttcgacataaagcaaatatatcataataagaaaaataaattacaatggtgatttaataaaactaatcttgtgttatatatagaagttgctacatttttaaataaacctggtcaaattttaagagtagaaatttaacttatttggacagagggaatatttatttgagtaaaacatgcagccctgttactttaaaaacgaatactccctccgtcaaaaaaaaaaagacaaactctaggtttccgtgtccaactttgactattcgtcttatatgatttttttttataattcgtatttttattgttgttagatgataaaacatgattaatattttatgcgtgacttgtctttttaattttttttataatttttttaaataagacggacggtcaaacgttgggcacgaaaatcagagtttgtctttttttgacggaggaagtaggtcaaagaggataaatatggggatttgacatgttctgggcacggtacaaacttcctcacaagccacgccaagccacgcccttgcatgccaatgattactcgaaaacatctttagcagatctctataatagtaggatgtggattatttttataactatttaggtgacatgcacgaaatgaggggatattccttcgagtgatgaattctcctttatagtactccaatagtagtatatgacccatagtataaaaacctaatatgggatgggagattttatattactataaatttggacatactatctgtcaatattcgtagtattagaaaatatctaacccggttctagttttttatattttgagactgacggagtattaagccttcaattaactaattaatatcctgaagctgttggtccaagcacatgcgaaccttttcagaactggttaggaatgggcgctactatcccagtccggatccagccaactgcccccatccaacagagaacataccaacaatatgaacttggagaatttaatatggatatggatttgcttgcataaaaaaatcttattatttctccgcgataaaacagcaaagcaaagtgcgtggaaactcccgttaaatgatcctgcagaagcgccctcctcctcctcctccttcctcttcctccaatttccaaaccctaccaccgacca

SEQ ID NO: 213 - DNA, 1501 bp, Oryza sativa
cgcgtgtaacaccctaaaaattcccgataataaaaatcactaaaattttaaactttttaaaacttttacatcatactggatgttatggttgttattgcttgccaaactgtaaatcgtctcaatagaaaaatcaaattaaaagatgcacatctaagtaataactaaagtttacgacaatatattgttaaccctataagtatttatgcacaagaacgcaaagccaaataaagcacaagccaattattagtttctataatgtagattacaaattgaatgttaaatacttgaaccatgttgacaagtgtcatgacatctaagtaactaggaaaatagtcgccactacaacgaccctatatataaaggagtgtttcactagaataattaaattaatatttatatgttcatcaagtctctcatgggatggattcactcatgtaaaataatttgtcatgcaaataaattgagctttatatataaaatgcgttctagattaatattgcaccaagtctcaatttaattttatggaataatagattaaacatgtccatgtaaaatacattgttatacaaataaacttgaccaatgtgctattgtattattaaaggtcacattagaatatttaattagtttttttaagaaatatcaaagcctatatgttatattggataatttaatggaaagcaaattcatttgggaactaatgaataaccaaataaatatttaaataaaacatttgaattctcaaaacccaaaatgtatagatgacatttcaattcaaacccaatcacattcacttttacagtttagccccaccctctccctctattccccttttctttcttttggcgcactattcattgtccgccaaccgttcgatctcggcccaacctcgcgcctctctcccgtgcgccgcgccgcccctccggtcgctgctatgccgcgtgcctgccttccctattcgtgcgccacattatgcgtgcccgtgcgccgcatcgcgtcacgccacgccgcgcgggcccgccgccgaccgagccgccgaaatcccgcgcaaaagctgcggctccacgcgcgcgcgtcatcgccgtcgccatcgcgcgtcgcctcggagcagatggataacggccactgcgccatcccgcgtcacccctagccctagccaactacctttggacaggagaaccgccctcaccaagccgccactctgccacagctcccatgtgcgcgcatcgccatggccacgtccgtcaccaatgatgtcccggcgcccttctttgtatccggtgggtaaaacgaagtccccttccccagctagggctaaaactcgcagactataggatatagggtgatgatggagccacaaaacctcaatgcccttatccgattgccattagggctctagctcagctattgtgtgttggcatccttatcctccatagttttcttacatcctaagccaagccaggccatcaaaaccccatccccctctgcctttctctagtca

SEQ ID NO: 214 - DNA, 1501 bp, Oryza sativa
tttttttatcagctgtgcgaacaatatcgatgagatcatgacttctatagaagatctccattttatagatcttccaggctgcagctcatggatatggttttaataaagaaagccagcctataccgaccttcaataagaggtttcaacttttcctcaagccagtcgatattcttctccaagtaatccatgcaatacacaaggcctgacacaaatttcaacagcataccataagcgaacatacaaaagaaataacaggtttgattcctgaagtctggggctctgggccaaacctccatttggaccaagcgaatgctcagacatgacatcactcagttttatgaggtcctcaatgtttatggcgcattcatatcttaatcaccgctgtcaaggatacatttcaggtttaactgcagaacaacaatccaacaagtgaaacaagataatatggcaaatggagcatttcagagctcaaagtgcagaggatacggcaacacatcattcgcaggatcgagattgataaccgcaactttcctgcaacgcaacagtgaagcacataagtcaaaacatttagcataattgcaaatttgcaagttggggaaaccttccatgagcaagctccctgcctccatgggagaaaattgcccatctcccctcactctcccaaccttctctctctatcggcataaagccggcatactcaattcgaaatctacctactatctgaatcaagcgacctagttcttgctttccacaaattcctacccgaactgcatagcgagtccatgcccaggaggtaagcaatacgcttctgcaaccaacagaacgcaaggccgaccagaaatttggaacaaacaaacaaacaaacacctagcaccggaaccgcgagcacgaagggagtagcttgcgagggttggagcagcagaagcacgagctactcacctgccgacgagggagaggaactgggacatcccgttgcagtaggtcgtcttgccggagcccggcggcccgatcaccacctgcccgaacaccatcctccgcccggctagagcctacctcctggcgctcgctggacgggtgcaggtagggttttcgccggagatggcggtggcggcggcggtgtcagcgccggcgacgcgaagagaaatcttctagaacagcaagacgagacggctttacttggcccacaaaatataaactcttcgattgctttgacggcccacggcccagagcccacagctcgaggcccacggacaacggcacagtggtgggctttagctcttttctgggtcgtcgcggctgctcgttgcaagcgcatgcgccgccttctcactccgccatggccggcggcggcggcggctgctccggccagcgccgccgccgcctccgccgtcacagtagaggcggtgctggccctgctggagcgcgcgatctccgcgggggacgtgcgccgcctcggcgcggcggtgcacgcgctcctcgtcaagacggcgctcacccacca

SEQ ID NO: 215 - DNA, 1501 bp, Oryza sativa
gtggcggcgggtagaggagagctcggggaaccttttaaaggggctcggaggcggcgacgaaggcccacggcggccggcgacgagaaggaaacttcggggttcgaaggaaagaggccgatccgaatcgaactcgattccacgaacttccaaaacgaattagccgatgtttccaaaggggaaaaggtagaggagatccctaggatcatttcccctctatcaattcggccggagaaggaaaggagcggccggatttggaaggaaacggcggcggcgctcggttagggtttcgggcggcggccgacgcgaggaagacgaagactgacagacgggccccacctgtcagcaggcggacgcgcgcgcgcgcggcggcggactgggccggcttgggccgaggagagagagaagaggtttgggccgactttcggcccaaagccaaaagagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaatcatttctaaaaattccaattaaacaacaatttatatattttgaatttttcaggatgtgacagcctccaccgcgcacattgactacacgcggatacgatgaacggataaggctgcgttctaaagtgcatagttcaatgggcttggatgggctactggagtcgtcactctagactaatgttgtcttgggctcaatgcttcctgtagatgtaggtgtgggagtttgacgccgttgttgatgtgaaccttacggcagccgtccgtcaccggtcttctccttcctccctatgttgtgaagtcgacgcaaggggcagctcaccccattgtccagcagttcaccccattccctttcccgtaagagtgcacagcacggaccggcagtcgtcgaggcggaggaggagagcatcggcgtgccgtgcggagcagcggccgctgctccttgccataggtgccgtacagccgatcgacatcgacaactcgtgagcaggctcttggagaccgcatcgaggggaatcggataccgcatcgagtgcaaaggggcgcggcgtgcgcagtaggcggcagcgattccagccgcgtccgggctacgcggcattgattcctgctgcggtcatgcagccttgaaggttgttttgatcaatcgctgcgtcgatctcgtggaagacagtctgcatcgacgaggcattgggcatcgaggcatcgattcctgctgcgctcgtgaagccttgcaggatgatttgatcaatcgctgcatcgatctcatgcaatacagtgggtctgcatcgacgacggccacattcatttcgaaaatgcgccattgaagagccgaggcctcctattttagagacccctcggtcgcaaa

SEQ ID NO: 216 - DNA, 1501 bp, Oryza sativa
gaccaagagcatcaatgaaagcggcgtagtgttcagctcttggttcaacaccatggtcctgcattgattcaagaatccggcggccatcagagactagaccagcatggctgcaagctgtgaggacagcgagaaaagtgacataggttggttgtacttcatctttaagcatcctctcaaacactgcaagtgactgctttccctggccattgtgcgagaaccctgtcaccatggagttccaagagatgatgtccctctcaagcatcctgtcaaacaccgccatggccgctaccatgtcgccacacttggaatacatgtcaataagggcattgtggatgaaaacgttgaaagggtctgaaccgatgctcctgcgcaagatgaagccatgcacttccttccctcgggcgacaagaccaaccttggcgcacgcacccagacatgacacgagggcaaagggggttggcactaccccctcacctgtcatcctttcaaaaagctcgagagcgatctcctcctccccattctgctcatgcccagagatgagtgctgtccatgctatggcgtcctgcgctggcatcatgtcgaatacttgcacagcatcgtcaagcatgcttgcccggcaataccctgcaatcatcgatgtccaagaaaccgagtcacggatggtcatctggtcgaataccccccgtgcatcctccaccctcccggccttgctgtaggcgtccaccattgcgttggccatgatgacagtcacctccatacccgacaccaccaccgcgccatgcaactcgcggaggtgcctcgcatcccggagccccgcgcacgcgctcgcggcgctgaccaccgtgaaccggtcgatggccacctgctgctgccccaggcccctgtccctggccagctgggcgaacacgcggagcgcctcagactcgcggccgtgacgcgcgagcgacgagatgacggtgttgtaggagacgacgttgcgggaggcgggcggcattccgtcgagcaggcggagggcgtcggggagggtgccgcggccccgggccagcgccgccagaagggagttgtacgagtgcgcgttcttgtgcgggaggtcgtcgaaggcggcgagcgatgccgccggggtggggagcagcgcgtagagcgcgacgaggcggttggagaggagggtgtggtgggtgagcgccgtcttgacgaggagcgcgtgcaccgccgcgccgaggcggcgcacgtcccccgcggagatcgcgcgctccagcagggccagcaccgcctctactgtgacggcggaggcggcggcggcgctggccggagcagccgccgccgccgccggccatggcggagtgagaaggcggcgcatgcgcttgcaacgagcagccgcgacgacccagaaaagagctaaagcccaccactgtgccgttgtccgtgggcctcgagctgtgggctctgggccgtgggccgtcaaagcaatcgaagagtttatattttgtgggccaagtaaagc

SEQ ID NO: 217 - DNA, 1501 bp, Oryza sativa
tcatatcacataaaaaaactttcctacacatgaattttcaactttttttttccaaactcccaatttttttcaaactttcaacttcttttaggaactaaacacatcctttaactgaattttagtatgaatttagcataatacctgaatgttaggacctgaatttgtagtatgagttcagtattttgcaggaattttagtaagaggctgggtgacaattctgacgaattggctgaatgaattgatcgaagcagccagggaaggcttgataagcctggatgacaaatgtctgaactgatttcctgcgcacacacccatttccgacgctttcaaacagaggcacattcctcaattcttgcaaactattcgacaaaacactccggttagacacgaaataaaatggtagaaagagtaatcttggagacgttcatgccaaataataggaattggaaaggataatttacatagaaatattcgaagtcgtaccgagtgtagcacaaaatccattcattgctggcctttctattagggctgatcacctgataaaatttttcaccctcacgtcgaatgtttggacacatgtatggaatattaaatataagttttaaaaaataattaattgtatagattgtgactaatttgcaagacgaattttttaagtctaattgctctatgatttgacaatgtgatgctatattaaatatttgctaatgacggattaattatgtttaataacttcatctaatagtttacaggcggaatatgtaatttgttttgtgattagtttacgtttaatatttcaaatatgtgtcagtatatacgatgtaacacgccaaaattttacacctatgaatctaaacacccccttagtgtgcgtgaagattctgacgccaaagttgttcggcgaccccatcaattgtggtacttaatattgtggttaatattgtggtttatacgaagttctcggtttcaaagcagtaagaaaattttgttcccacataatggttctggtattaacatacaaccattttctcctatgtatttagttctagaaatgtttactactaaagtatttttttgtcttctattgtagttatccttttcatcttttttatataaatagaccacgtttaaaaaatacaaaaatatataaggataataccccacttaattatagagcgaagccatttacttccgccttgcaaataagtggcaaaaaacctatttcgcttgttagtggaagcttggagctatcaaaaaccctaatgagtgaacgttcagtcacatgtgctcggagtgccaattggttgtcctctctttttgacgcacctaaacacctttcctggtatttatttatgcatggaatagatggatgttcgagttcaatccagaggttttcaatctataaactttacataaacttccaatgtataaatgtaatacattgaggaacttttgatttataaactttttttgtacatatgaactttcagtctataagctt

SEQ ID NO: 218 - DNA, 474 bp, Oryza sativa
ttcctccctattaccgaacgagcctttcccccctcctccgccgccggagcagcagcagcagccgccgccgccgcagccgcacgagacgaggcgcggcgaggcgaagcgcgcgtgaggtggagctggaggagaaggccgctttctttttttttacttccttttttttctttttttttttgttttggttctctcctgctgcttgcgctgccgctaggagaagtactactagtaataaaagcgcgggggtgcgggacagctagctgccttgcctacgtgctgcgtgcgtcgcaacccgcggccaggtgcggcgcgggccccgcggatcggggggtggggcccacgcgacagcgagcggggacgatctcgggtggggcccacgtgacagtgacacgggttgggcgtggcctggacggtgggtatgtgtgtgtgttgggggccgtacggattggcgggttgtggggcccagggggggaa

SEQ ID NO: 219 - DNA, 1501 bp, Oryza sativa
tttgaattccatccatgcatctatccagtatttaatcttgtccatgtaaacttgttttacatcgttgcatattcatcatcgacaatgatacgcttggtgataaatactatgcatgatcttaagtttacctgctatcaagttttaatcctgtttaaatacggttcttagcgtgttttcgtggtcatgttcctgagcccatggaaaaggttacatgaccacgtatgttagcaatgcaaaatggtcgttttgaagtcaatatttgcgagtatttttataacatagagtagttattaactaccaacaaaattgcagttttttccaatcacagtacaaaagtacgtcatcctggtgactttagcagagaaaaattactccctgaagtagttttttttttccaccaatagaaaccagaagtgatgtgcccaacaaaccaatttgaattaatcctcctaatttcgtgtgctctgaaccaagagagcccaattctccaaagtttggcgagctctgctaatcaaaattcctacctttaggtgagctaacagtccaataaaagattaatttatagtaaatcacgtcgtaggaagttacatatatagctagcaacctgcagtttcaccaactccgtttgcaacttctgaagaagaaaaagtcacaatggcgtcacgagttctgaagaagtctctcttcaatctgcatgccaaattgccaatttggatggaagaaaagaaaactgtgttctgaaattaacagaatggtgaaaacaaataggttcatgtaagaatagagtcaaaggtagaaaaaaagaaaaataataaggaacaaagctattagggattaaagcgataatgaagagggaattggcacgatgatggagacgatgactagttgtagatgtaagcctggaccgttgaagcatggaactgactgttcttgatgacttcttacaagaggagatgaagaaagagagccattcctttaaaaaaaacaagaagaaagaaagaaagctatgacacatatgactttctggtcttggtctgaaagtaatagaggagatgttatgaaattggtcgtttgaagaaaagtagaaaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggtt

SEQ ID NO: 220 - DNA, 1501 bp, Oryza sativa
gctgttcgtgtctctgtttctttccttcttcttcttttttttctgttctaagtatttttcaaaaaaacaaaacaaaaaaaaataaaaacagagagagttttgtcttggttcttggctggtttgcatcatgttgattgggaaagcaaaaatctctctttcgaagccccccatctgccctactgttgctgctgctgttactactactgcctccatcagccgtcggctgcagtcgccgaccggtgggccccactcgtccactttgttgcaaaatctctgtgtctttattgtttcttctggtcgcgatcagagggaggagagaattaattaattaattaattaattaaaggggaaagaaaatcatggatgttatgattggagattggatggttggcttgtgacggcgcatgtacactgtagtcgtatctctctggtagcaccacgtacaattaattagttaattaattgcatagagttttttttttgttcatttttgtttgcttgttttgggaagcctttgattgatgtagcagtagcagtagtatagtactgtagttaccgtgccacacgctgctgataggaggaaggggggcgcgtggcctatctggaccgtcggatggagatcggacggaagggagtgctccacgtggcatcgagattccaatcggggaggcgccgccgcccgccgcacctgcggaaagcggattccctttttgggaaagcgtaaagcgcgcgtggctggctgcctggcctcctctcgcgcagcggattgggcccgcctgtcggtgacaggtgccccaccgggccacgtggctggctgaccaccagtggtagttgactactccgcaattaactactcctacctggataaaaggcaattatgtgccaatcagaaattcagaaatgtgaattcctcttaccagttgacttgagaccatgtggattaccaaggcaaagatgatttggtctatcaccctgctgattaatctaccctccgttcaaaaaaaaaatcaaaccctatatttaaatttggacatatttgattttttttacagagtagtaggttaggtttaggtcttaggacatctctgtgattagtgattaatccccaattgtttcaagtacttgcttgcctatttgtaagtaactttatactctctgtttgtttcagaaaaacaacaaaaaaaaaggaacatttcacattagtatcttcatacaaaatcgttcacctaactacaaactatatacaatagtgaaccgatgacctttctcgcacttaaaaatcttgaacaagattacttgttttgttaaaaaaaactattcccttcatcatgtggatatagtaatctacaactgaaatggatgttttataatagatgtatcccatccgattctagattgttatattctgagacagagcgagtaaatctgatcattttgcatttaacttttcacgattatttgctctttaaactccatattgttcaaaactgggcaatgctcc

SEQ ID NO: 221 - DNA, 1501 bp, Oryza sativa
ctaaaaagaacacacctatattccgaaattttcaaattcctttttccccatccctcaaagctaatccttttatgtataaccctatcatggtcactattcactaacatgtcccggctatatagttctatgtgtttagtacgttcctctcattttacttataagtggagatgttgaatatataggttgtgggtctggtattaggggagaaagtaggtagtccgcaaaccccctttagggtgtgtttagttcacgctaaaattaaaagtttggttgaaattgaaataatttgatggaaaagttagaaatttatgtgtgtaggaaagttttgatgtgatagaaaagttaaaaatttgaagaaaaagtttggaattaaacgaggccttaggtcgcttaccctataaccctataagtgggctacgggctaggcacttacgcttaactgtggttccagtttcatacagtcacagactcatagtacatctctttcacaaacattaattaataacctgtttaaccaaaaggtaagggtataataatctactcacttcgtactattctaagtgtagttctggtttctatgtctaacgtttcaccgtctgtcttattttaaaaacataaaaaattaagtcatgtataaagtacttcctccgtcccaaaatataggtatttttaaggttggtacggacattaagaaagtaggtgagaatgattggagaaggtgtgtgattggttgaaaaaaaaagtaggtgaaggataatggttctgattggttgagaggaggaggtaggtagaaaaatagcttcattttgagacacggtactgtgctacaaatagctacattttaggacggaggtagcactactcatgttttgtcatctaacaacaataaaataataatcataaaaagcatttcaaataagaagtacggtaaaatgttgaacgcttaaatacacaaccgtacttgaaatgggatggagggagcagacgagtagtaaccatttaaaaatgcttgatttgattccccggggtccactgcccatttgcccccaaggaggaggaaatatagaaaaacaaaaggagaaataagtttcttttttcaaaaaaaagagaaagaaaaccgggcgacctgtgctgttctgccacctcgcgccgcgcggcgcatttgcgccatttgtttagctcgccatgtccgccaccaccttccctcaccagcatcgcctcgccgcccagctgctgccgctgcgcttgcgcgtcctcactggaaagatggcccccctctgctctggcccctctccactgcggtatgaatgaatgatgcgccttttctccctccccccgcccagatcgatcgccagacctgcactttccagttccccatccatgctctgtctgcttcatcctgtcccagcttcttcttcttcttcttcttgttgttgttgttgttcttggtgcgggagggtgttcttggggtagggagcagcatcggcggcggcggcggtca

SEQ ID NO: 222 - DNA, 1501 bp, Oryza sativa
gtgatttaaagaggagaatctgaccctgtttaaatgggactaaaacttttaagtccctatcacatcagatgtttagacactaattataaatattaaacatagactattaataaaacccattctataatcctggactaatttgcgagacgaatctattgagcctaattaatccatgattagcctatgggatgcgacagtaaacatgcgctaattacagattaattaggcttaaaaaatttgtcacgcgaattagctctcatttatgtaattagttttataagtagtccatgtttaatactctaaattcatctgatatgacagagactaaagtttagtccctggatccaaacaccccctctatgcaccctatcaaggtttcctaccattcctcaccccttccctctgcgcatctatctccttttttttcatggacttgcatcctccattactaggcagtggaggcaatgcatcaaccgtcctcccacaccgctgtcaatggcaaggattaatggtgtctgctgctagttcagtcagtggtcgagggattgcgattgaaacacgatatgggatttgaagtgaactttatttttaattagtaggagtagtccttacaggcccaataaacggtttaggcagtcccggacactaactagcccagcccacacacactagtcttttctcgaattttttttatttataattttttttattaaaagttttacaaaaataattttccattttgaaaattgacggaagtagtcgcctaccgccctctgggctcccagagggcggcgaaaatgacgtggcagccggccgttcgctctcgggcgacagccgtcaacgaaatttgcaggcggcccccttgccgccctccgctagggcgattttatactgtgcggggggccgcctgcaaatgggcggcgaggggggcatggaattttgcaggcggcccccttgccaccctccgctagggcgattttgtactgtggggggggccgcctgcaaatgggcggcgatggggcatggaattttgcaggcggcccccttgccgccctgggggagggcgatttttgcctcccccctataaagcccagcccctcctctgtgaaatttcattatattcactaaaaatccaaaaaaaacgaaagagagagaggggagggcagcagaaggggagcggcgaagccctgctggttcgctaattcatcacatgtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacagatgtagtttagtttgatctggagaatgtaacgtaattttagaaatttagagaacaatgttgtagagaatgtaacttagggcgtagcacagaaatgcgaggttaacgcagttattgttttcatcaggcacaa

SEQ ID NO: 223 - DNA, 1501 bp, Oryza sativa
ggaacatttcctctgagtctatctctctcatctgattcctgcgtttttcctgtggtccaatcaaacggtcattcctatggttttcctgtgttttgcaatcctctgttttacaattatattcctgtcagaatcttgtgtttttcttattcctctgttttttcattcctacgattcaacgattcaggggggcaaatcaacacatggtccagttcaagcagcaagtgggcagaaaaaaaggcagcacaaaaccgagaaaaagggtgacgggatgcaacagtgccaacaacgaaaacgtctctcatctcttttgctttgctgcagcctttttcttccacgagcatcagagcatgcatgtgaatctcccatctcttcgcgaagaaagcaggaagaggaggcgtggaggatcgagtggcactaccagtttttgcccgcatcgggccatcatttttaaacgaaacagacatggggcgcacgtacggcggcacgaatacgtagtactacgtacagctgcagcgctccattttcctatgccgcttttgatgcaaccaaacgtaatgcttcgttgcaacggaccgccaccttagcgaaagcgtgcgctcatctttgttccaccatcgcatctaattatcattccaaggattatacgtatcttatcatctgcttgttagctcatctgccatagccattttaagttggttttaagattttcttgatcttaggctattttttggcattaggttttataaacagccaataacatgtactagtacataaaagatgtattcatatagattaaatttcaaaaaattacaactatattgacaaaactatcattttgctgcaacattagtggtctatttcaatttgttgtaacaatattgtggggaattattacaaatctataacttttacgtgatatgctgctacatgctatatgggcaacgaaacctagggcacctttgatttagaggaaaaacataggaactttggagtatttcaatcctgtaggaaaaaaattctatgaatgcctttgaaacaaaagattgaatcctatcatatcatttgaaaatcctatggaatggacaaacctaagattttggaggaaatttagcgagagtttcaacctcactatgccgaaccatgctagctgtgacgggcctaaaccatcacctctgacggattcggcccctcgtcagagattagtggtcagtgatgactttcttcacctttgtcgggtgaagggccgtcagtggtgaccagcccctataacgagccgtgtatagaacccatcacaggtaactattatctcaaacggcccattagtttgtgagacgtcagtgatgtctataatccagcaaaagaaaaggaaaaatagattgcaacccatcacaggagtgaaaaaaccctagcaagaaaattggcgcacgctgccatggtggtgcttgctgtcaccgcatcaccatcacaaaaacttcaaactgaccgacaactagtgttcaga

SEQ ID NO: 224 - DNA, 830 bp, Oryza sativa
tctcatctatctcttccacttcttctctatctctcctctctttctctatgcaggggaggaggggaggcgcggcggcgctggcccggccgccagatccggcagaggcgggaggggcgggggcgccagcgccggcccggccaccagatccggcaagggtgggaggggaggcgcggcggcggcgccggcctagccgccagattcgtcaggggcgggaggggaggcgcgttggcgaacgacggatctggagccgtggcacggtagcggccgatggcgggaggggaggcggccgaggcccgacggcggcatcggtctccacctccgccgcctctgtcggcgacacctccaaccgtgcctctgcctccgcccgcgccagccggccaccacctacgcctccacctcccccctccttcccttcagatccatcaccgccaccccccgacggcgcctcccccgcctcccggctgccaacgccatcgacgcctccctcacctccaccaccgaccgcgctagccgccggatccggcctccacgaggccggggatgcgcagatctgaacactagttgtcggtcagtttgaagtttttgtgatggtgatgcggtgacagcaagcaccaccatggcagcgtgcgccaattttcttgctagggttttttcactcctgtgatgggttgcaatctatttttccttttcttttgctggattatagacatcactgacgtctcacaaactaatgggccgtttgagataatagttacctgtgatgggttctatacacggctcgttataggggctggtcaccactgacggcccttcacccgacaaaggtgaag

SEQ ID NO: 225 - DNA, 1501 bp, Oryza sativa
tccatgaatcaagttaatatgattgtattaactaaattaatggaactgttaaaaaactaaatgaatggaagaatgacaaatcattcacataatatcccagaatatgtgcatgcttcgagccaaaagaaaacctaaatcacactataaattcaacatcattgtctagagccaagtggaggggaacacaatgaggtatctatgggtgaagtggagacaacgtcgctcatccatcgagctagagttgagcttgtagatttgctcctagcctctgtcaccccgccgcccacaccctatgcgtctcccttccccagctatcaaaaaaggttatcacttctctatctttgcttcgttgtttcatcgagctatgtagatggtaggatctggcctcttcgagcgtagcgaggatgaaggggaggcgatcaggatggatctagtcttgttgtcactacctctccccataccttgacgatgacaaaggcggatctgaccgctccccaagttcgagataactggatttggtggccacccgtcgaggagaggtggatttgttggccccattgctcgttggccaggattaggtggttgggagaaaatggagagagtagagagagagagagagagcaagagaggaggagagacgtatgcgctcggagtctcgagtggttgcaaatgaaactgatcggtttgatatatttttctagctcactaaaaactaggcactattttttttgttgtgttttaatagaaaaccaacatatataactattatcagtgccaaatttttttacagaatcagcatttataattatcattcgtgtcacggtgccagtttttatcagtcaggaaaacccttagcgccggcttttttttttcttcttcaactaaccggggtacgtttgggcgtttggctgcctggctgggtcatggaacggaacggaacgtgtcaacgagttggcatcaagttttgtcatgtactgtaatctgtacttttcggtcagaaaaaaaactgaacattgtttttcataaagaattgtgatctgtacagtacattcctgtgatccatttgacccggtcgtggaagaatccgtgcgttttttttttcgacttgtgcgcatgaagcatgcagaactgaacaagtatgcaagatgcaataaacggcggcgtcacattttgaatagaactgtaaaaaaaaaacccaacatattggaacaataattccattatgaataagattttatttacacagcttcagatctaaagtttttaaactgggtatttctaaccttataatttcatagatttagatctatgatcacgttaataacattttgacaaatcattttgtttctattttgatgaaatttaaagttttaaagcactataatttaatatacaaacttcaaatcaaacgtgaaccgaagtctataataacatgcctaaacttattacaagtatgaatggagtattcaaagtaccctatgtttacagtttgggagttcaa

SEQ ID NO: 226 - DNA, 552 bp, Oryza sativa
ccccacttttatcctacgtggcggctgagtcagcatgggacccacgtggccatgtcatcaccctctctctttccctctctctttctctctctctgttctctgggaggccggccggcgagcggggtcgtggggaggagacggcggccggcgacgcggcggcggtgacgcgggagaagggaaaacagcggtagcagaggccacagccgccgtcgagtgaggaggtggggccagcgagggggcggggagaccggcggcgagcgacagagagggaggaggcaggtcttgcgagggggtcggggaggccagtgagctcgccctcacccctcctccaatgccgcgacgctcgcctccgcgccaaccaccacggagcaccgtgccggcgtgcccatcgtctgcgtcggcaccgcggggacagagcaaagaggacggggggagcacggtggcgccagcatccgagggcgtcgcggcactggtcctcaatagctgggggaggagctaggtgcgggcggcagtcgccgagggcgtcgcggcatcggtcctcaagcaccctca

SEQ ID NO: 227 - DNA, 1501 bp, Oryza sativa
ttacaatgaactgaaacaattttttgctatttacttaaatattatttttatataaggtgaaacagcaccagatttaaacaagtgaaacattttcgatcaacttagtgaaacaattccaatatacctggtggaacatcgcaacatttaaaaataattcaataataagctaattttttttgtcggaatatatccatgtgtggtcttgttttgaagatttaattataacgaatttaatggtgcaattggatcatgatttggattagtaatttaagagaaaaatcagtttaaaatagttttgcacgtaaatcgggcgctgacgtcccgattttttcccacccacgatcgggcgcccgatttgtaggggtccaggttatccaggccaacccgttttaggaccggcctcatctttacttatgcttatacttgttagtcaaaatttgaatttttaacattaaatttagtattgattttgaaagttttttcatcatagtttatttttcagtttttgcttttagatcgctgagaacacgtatataaaaattttattcataaatttttttttgtttgtaaatataccgtttgtcttttttctgtgaataagccaaacaatgaccctgatttcgtgtcgtggttttatatctgacaaattttgatgagaaatttgatcaaaaaatgcatagcaaaatcgctcatatgatctgatgtatgtgagccacaactttgcaagtggtggacgagccgattgaagtcattgaactcgttccctcttctacggttctaccccaacactgtccttgcaactttatcggttagaatgctaagctaaatctgtgattgccgttgcatctagccacgtcgtcatacacgggtagcagtagcaccaaaaggcactctcgtacttcaagatatacttgttttctcggacggatcaaattccattgttctagaatgtcctgtttaacatcacactcgattggacattaccttttttctctctcaaaaacaatcggaatgaaacagctctaaagaacgtgctaagtgtacctactgaatccaaccttaaatccgtagcgtacgtaacccctgctccgttcatcatcccctgccagtatgccttgtgtaccttgttcgtttctttgcaatattcattccgacaaatgcacgcagcctcttttgtatcggttaccctattgataaaagatcacgccgagacacatgggggatcgtctcttttccttgccggagatgatagttgctccaagcaagaatcaggggctagctcttctttatctttgagctttctcttttcctcgccgtcctgtaatcctctgcagcaaggcaagcacctaatccatccctataaatacccatcggcgtctctgcctcctcacagcgagccacacaggttaagtcactttcacctgcaaatccacaagcacattgctcgatcaccgaggaagaaaactagctagcttaatcaccgggaagagttgagcaatgg

SEQ ID NO: 228 - DNA, 1501 bp, Oryza sativa
  unsure (1)..(1501): unsure at all n locations
ctcccctcgctctgcccgcgcgccgcgtgcgcgtgcgcatgcgcgtgagccgatgccgagccgagctctccctctctctctcgttctcccgctctccctccccgctccatccccggaaaactctccgcgcgtcgttacctcgcgcgcgcgcccgcgcggtcgccgccgtcgtcagccgcctgctgcctgtgcctgcgccgtccggccacgcgccctgcggcactgcgccgcctgtgccgcgccctaccccacgagccagcgcgcgtgccctgccgcgcctgaacccgcgcctgccgccctgtagccgcgcccttccaaaccgcccccgccgtcatcgccgtcgtcactacccggccccgccaccaccgcgcatgcttccaagggttggaggcagagctcctcctcccactgcctcgtcgccctctccctccttccttcttttcccaaagtggcaagaggcaagtctcctttccctctgtcttttcttctcccccttccccccctccgccggcgtcatcctccctgtcgccgttttggccgctagccggagagccagctcgctggcttgaccgcccaatgtcagttcctccctcccaaaccgacattgctgccctataaacccgagcccctccccaaaccaatcttccccattttcgccctcgccattgccgcaccctgccctgttcgccgtcgccgttcgtcgtcgcgcgtgtcggaggagccggcacgagcgaggacgcgtgacgtggactccgggcgcaccctctccttcctcttccccggcccgaggccagagcgatcacgccccgcgccgtcggccatcgtcactgcgccccttcaccccgcactgtagtgcctcctccccgttctccctcctcgttcctcctcttccccttagctttcggtagaagctcgtatagcctccccgtagctagctggtgccgcctcgaccgctgccgccgctcgctgtgtgctcgccgccgtcgccgcccgtgctccgtagcgcccgcacgtcgtcggcctctctcgtagtgtctccgtctaatccgatgctagaaacggacttccggtggccgcgtagatgctctagtccggaggaatcgaaccctagtcgcgtcgttgccgtttccctcttttctcgccgccggttgccgccgccgcaatccgccgccttcgaactccctccggcgaatccgagccgttggctcgtctcccctcgtctcgtgcaaccacccggtgtgctcgctntcgcctgtatcgctgtggttcgccccgccgttcgcagctgccgtcagctgtccgttccggccgtcgccttcttcaacctcccgccggcccgcgtggcagccacgtaggcgccacgtcggcgcctgctcggccaagatcgggtcaagccgaccccggtccgccgctcccttttgccccgctcgcgcgcgcagtccaccgcgagccgtgaggctgcgtgtggggccgccgcatccgcacccaccacgagccgcgc

SEQ ID NO: 229 - DNA, 1501 bp, Oryza sativa
tctgtagcccgattcacttctctctccacatttatcttcttaaaatatgtttgcagctggtttatactctgctattgtatatgctgttaaagataaacttgaataaccaatccgaaaataaactaccctaggaagtaggatcttctttggtcaataatttttgattgctgacctcaggaacaggattgacactggtgcgcgaatttcatgcgtggcatgaccaattgaccagtcgcatccgaagggaaaacttgccatgactgacgagagtatccacaccacacggtccacaccgggaaatttaactatttgccactcttatgagtgccaactctccatatgccactattagatttggcctaacatatttgccactagagagagattacatcctaattttttgccactttcgctgagttggagcgccacatcatcatgccaatgtggactggcctggcgaaattacctttgtgcccttgtgcagaaacgagaaaacagggggaaacagaaacgcatcggcatccatctctttctctcgaccacagctgctcaaaccctaccgtcgccgccctgaaactctaccgccgccgccgctgcgcctgaaacccccgccgcctccgccgccgcctggatccctattggcgccgccgcctgaaccctactgccgccgccgcctggaacccacacgcgccggccggccggcgaggccgctactgcgtgacgcagagcgagtcccgtcgcggccggcgggagcctcacgcggccgccccgctgccggccctgacgccactgcgtcgcggccggctctcacgacccagccggcagcggcagggcgagtccccccgctagctcctcccctccaccgcgcctgcacgcgacgccaacgcatcggccggtcatccgggacgtatagctggcggaggtgaagtggatctgatcgtgatgaagccctcggagtgtcctccttggtaaattcattccccttctctgtattccccttctcttgactttgtgtgaggtgtgcagcatgctgttagaattgatcctggctccattttttttgtcaggattgatcctggcaatgctgttagagttgttgttaaatgtgcttcatatgtagcaaacttagagtatggattgctatcaatgtcagagcaagagcatgattggtgggttgataaatgcaaaggttatagtttagataaattctgtgatgatatgactagcaaggtaatatgggggcctagccaagaaattgtagtgtggggattagactttgatagtgggactgaatggaaggtaaccaacaatgaacagtttgagaagtggtttcagtctgggtggaaagagaaagtggtatatcttggggtagaagtggttactaaaaagggatacaagcctgctgaaagctatgtagatcgagttgagtcaacaactcaagttgtcactagtgttttaagtgtagatcttggggttccatcaattgctgaaggtagtgtga

SEQ ID NO: 230 - DNA, 1501 bp, Oryza sativa
ccccacactacaatttcttggctaggcccccatattaccttgctagtcatatcatcacagaatttatctaaactataacctttgcatttatcaacccaccaatcatgctcttgctctgacattgatagcaatccatactctaagtttgctacatatgaagcacatttaacaacaactctaacagcattgccaggatcaatcctgacaaaaaaaatggagccaggatcaattctaacagcatgctgcacacctcacacaaagtcaagagaaggggaatacagagaaggggaatgaatttaccaaggaggacactccgagggcttcatcacgatcagatccacttcacctccgccagctatacgtcccggatgaccggccgatgcgttggcgtcgcgtgcaggcgcggtggaggggaggagctagcggggggactcgccctgccgctgccggctgggtcgtgagagccggccgcgacgcagtggcgtcagggccggcagcggggcggccgcgtgaggctcccgccggccgcgacgggactcgctctgcgtcacgcagtagcggcctcgccggccggccggcgcgtgtgggttccaggcggcggcggcagtagggttcaggcggcggcgccaatagggatccaggcggcggcggaggcggcgggggtttcaggcgcagcggcggcggcggtagagtttcagggcggcgacggtagggtttgagcagctgtggtcgagagaaagagatggatgccgatgcgtttctgtttccccctgttttctcgtttctgcacaagggcacaaaggtaatttcgccaggccagtccacattggcatgatgatgtggcgctccaactcagcgaaagtggcaaaaaattaggatgtaatctctctctagtggcaaatatgttaggccaaatctaatagtggcatatggagagttggcactcataagagtggcaaatagttaaatttcccggtgtggaccgtgtggtgtggatactctcgtcagtcatggcaagttttcccttcggatgcgactggtcaattggtcatgccacgcatgaaattcgcgcaccagtgtcaatcctgttcctgaggtcagcaatcaaaaattattgaccaaagaagatcctacttcctagggtagtttattttcggattggttattcaagtttatctttaacagcatatacaatagcagagtataaaccagctgcaaacatattttaagaagataaatgtggagagagaagtgaatcgggctacagatttgtagccagctgtagcacggactccaaaacgtagtgtgtgtataacaggtaggatcagatattaataagctattagattagctatatatgaattggagctagtacttggctataatattaaacttgctctaagggtcactttcaaaccgcaaatgaaaatggctacaccgtagcttcctataataacgtttcccaaactgtaggtccgtttgatataactctaacatttaa

SEQ ID NO: 231 - DNA, 1501 bp, Oryza sativa
ggtaaacttatagctgaattaccttccgattgtgttgaatgatttaaaacagtcttaatttgaactccatccgtcttagaatataagtacttttagagttagatacagatattaagaaagttggtaggattaaataggagatcgagtgttgcggttggaggagaagtgaagttaggtgggaaaattgaatggtggggaattgtgattgattaaaaagagaatgttggtgaagaaattgttatattttaggacaaattttaaaagcgagaagttgttatattttcataaggagagaatgcattaatttcatttgtttttgctctcgtgttcctgataagttcctgcgcaactgctcacacattgcacaggtgatactatacgtacatgtgcatacataaagtttggccagttgtacttgtacatatccctgcctgcagggatggggacattatcatagaagattttgcggggtgacgaaattactcccacatacgtactgctaatgacgaggctaagcaagtcagtgtaattaatcttttggtccatccaataatggtactatagttagtgtataattaactactctgacaggtacatgcgctaccgctgactgatcctagtgtaggacagttcatgcataaagcataaaaaccaagcaagcatgcatgtgtaacatgaaaggggcctaactaactcctattgtgttccacaccaactgatgcacaatataaaattttagttagcacctgcatgcgcagtcgttgcgtcttgcgtgaatgtcctcatgacgccctaaacaaagcatgtgaaaacaaactctgtcgagaaaacaagcagccgcaacgctctctcaacgactctacacccacaatatagtgagatctatatatcagcaacacgtaagctgcaattgcagacttattgggctatggtttgttggtaccccaggcttctcataatttaggacttgccaaaaatgtatggttagcaggagtacaggtgtcgcgaattgaagctagactaatctgaagaacgtacgtgtggccagttaggattgcgacagaataaaagttggagaccaagtagtagtacaacacaggagttgtaccgtataccgctcgttgaacctttcacttagcagatactgagaccaatttctcctcgatttccatgcagtttacatacactagctaggctggtttgattattttctctaaactgaactacctggtcagtgatcacctgaatggaaaaacagaggaaccaggaccactgtactggactatactcaacggtgcactgcaaagtcttctttattgccaatgattgtaactgaatcatctttgccaggagacaccggaggaggaatgacggaatgttcgctccaaaactcctataaatacagctccccgagctgcagctcagagcacacagaacttcacagcagcagcacagtgcaatattgcaaatggagagctcagcagctgagaactggtgggtg

SEQ ID NO: 232 - DNA, 1501 bp, Oryza sativa
taaggtggtctctaatttaagacaacagatatgctaatgattaaagcttagacgatgtagtggggccaaatattcgtgtgttggcctgttgggaagggtgttgttgtaaatcgcctcacaattattgagattgtcaccaacctcaaaaacatgtaaagattctttttttgctacctccattatcgtagaatacagtaacctagtagacttatcctaatactacgaatgctcccatgtttttatattttgagatgagtttattatttgagtttaacactatacattaggtgttaaaaaaactgagaacaagtacaatagcagactataagtcaactataaatacatttcgaggagataaaggatgtgagagagcaccaacgggctatagatttgtagccagctgcagcacgaactccaagatatatgtgtatataataggtggaatcatatattaattgtgtttacaggtaactattgtatgaactagctattagattaactatagataatttagagctagtagttggctatactattaaacttgttgcgaggcggtattgcaacccttagcatatgacagtaacaagagttgaagagttaaattcatgaatccctgtatttcttttcagaagaacagagaataaaaaaaaagaagaaaaggataccctttattaaagcttgatgatatcagcttagtgtataattatttgagattgaggggaatgttccatgttttgttgaactcttttccctcctacttctttattaaacgagatttgtttgatgtatcagggtgtcacgttgtcatgttatgtttttgttctggagattcttcttttctttaaaaaatgatctggagactcttttaatctgatatatttcgtctgctgtagtatgttcactctctcaagatatttgcaacaacttaattaccttagcacatgagtagtagaattactaggagttattttgcactatactttctttctgaagatatttgcacttgacatatagtagtagaataatctgaaacttcctttggtaagcagatcttgaacaaatcaaggcgaaacagaatctttccctttcctttttttcaccctgaaatcttctcagaccttgctattttcgactagatcttgttaaagcacacaaattatgatgttttctaatgaacatcatcgcctggttgcttgcgggtgtgatgatgatatgatgcacaagacaaccttggcagcagagatgagccttgtctttccctttggcatccagcgctttgctctttagctcttttcccccctttgatttttgtctttagatttacctcttggcaagcaaagcgtgttatgctccccactttggcatgtatataagcacacccaagctatcctccaaacggcaggaacacaccaccatctgcataatacttccttctcaaatcccaaccaacagttgcagtagagtcactagccgcccactgcaactgaaatggcgccggcga

SEQ ID NO: 233 - DNA, 1501 bp, Oryza sativa
cgcatccattgcagaattgtggaccaaatggctgacgaaatgtgggattaaaacttgacagaatgacaggttaggcataattagcaattggcaagtggatgtgaaccgattgtagctttagtctccatctccatgcatgtgaagtcgcatgcctcgcctcacatgcgcgcacgctcgatgaattcacggcgaaattatagcgtttgcaatggccacttgcagttgcatcaggtcgtaaggtagcattagtattccgtgttgctgatgttgtacttaggttcctaggacgcctgatcataagcagccaagctgtgtcttaacatgatagtacatatagatatgcttccattccttgcaaaccactcaaatcctgacgattcggcatgatcagtctatcagagttttttgcgtagatcacaagccaatcttttcgtcccaatcaatccctactggatagcaatcaagcagatgaatgatagacaaaaattgctagattgattccaacaaaatcaagatgtcgagtgggaaaccactatcactgtgcgtgagatatggtcgtggatgcatgattttatcacggattcaattcatgttacccgtaaggccgctttgaaacaaagaaaaaacatagaaattctaaaggatttgtttccagtaggaaacaaccctttgttcctttcaaggggcaatacttatttctttaaaattcttatggaatggatcattttagagtaataatgtacagttccgaagagaaacatgagggctcaccttaagttttcttactacaatgtcttaaatttttatgtttttcttgtatgcaaatcaaacgataattttgaaagtttctcgtgtttcaaaatcctataaaaacccaatgactatgaaaccctatttctatgttttttctgtgtgccaatcaatcagtaattttgaaagtttcctatgttttaaaatcctataagaatacaatgactaggagattctattcagttgttttttcctattcatgtcttttcgcaattgtacatttcgaaggaaccctaatattatttcaataggaatcaattatttaattgggttttcgtctagccccaggaatcaataaaaaaataagtgctaaatttcatttcatatcagtgaataaaccgaagagagagacctttctcactccgcgtcgcactatactccgcggaattattttcttacttttatcttttgagcacattaaaagagatactttcggatagataagaaaaaggaaatttcttgcaactcaaaagacgaaggaaaatagtcaagttagccggtgtacataaaaataagactccgctaacgtaccgctcctgacgtgggtgactaacatataggctcgcttattagagaacccatatatcagtcacccagtgttaacacagaggtcagtaggtcaaaggaacggattccgtttatatagacactgtacttttttttgtttgtaactgaatatatacacttggca

SEQ ID NO: 234 - DNA, 1501 bp, Oryza sativa
caagcatcaacaacagctcattagcatcagaagttacataaagaagtcattggaatataatggctacatcccagaaatcttttctagatccttctcatacgaaaatgtggtgtttgcacaaaactgagatggtaactcttaactcaggtgcatcatacaaaggtatacaacttgataaatttgtactagaatattatcagttaagggtaaaacaacaagaacataccgtctctttccattcagtggtaccatcatgactctgtcctcccatcctagcccagcgacacctgtacccattatcaccacgatcgtctccactctccctgtaccaggtgcttccatcttcatttgtcccagactccttgactgcttcatccagaaggttgattccccattccttctcactagcaataccagtgtctataaggcaggtggcaaagaaaacaaatgcatttccttagcaaagctgaaaaatacacttggaactgcgggtcgggtgtttccttttggagtacactatgtctatcacaaaatttggaagtatcagcaaggaacccacctctcttcggcggagtatcacgggattgaggagctggccctcttggcgtgcaccgtggatagaaattctgttgtttccactgcctcctagaactatactagtgaaaacaaagtctaccatcaaaattcattctctgaacaaagagcattcgtgcaacagcagaaaggtacggtttattccactacataaagcgtgtgtcaaaagcattggcacattaacttgtcactacgacaattcagcataaagcaaaaaacaatccatatgttggaatgattagacaacatgttactgtaagtggcaaatgcgaggcctgactggataaggcagaaaaatgggccatgttcagtgacgagccgccgtgcacgtaccgaggagaagggaaggggagtgacggcattgcggtgaggctggcgcgacgcctgccccgggcggcagcggcgggcttgttcccgtcgatgcgccactcctcggtgcgctccggcgcggccgccgcggccttggagaggcgcctccgcggctcctgctgcgcgcggcagcagcatcggatcgcgcggcgtcgcggggcggggcacggccagtgcgccgcccccctcgcggtcagatcgaacggccgcgccacgagccccctggagcacgcggccatcttctcatgccacggcgagggcttcaggagcggcggcggcggcggcggactggctcagtggcggcggtggtgggagcccggaggcgagggggagggttttaaaggggcggtggcgaagagggaaaccgcgggcatcatccgaaccagcgagagagcgattgattgcgaatcagctcgcggaaatgaggagacataaatgagcaagccttttttttcggggcttttatttggatttgtttaggggtgggagatctttgcaggtgggggagaggagtggcgatgaggaggaaggagaagaa

SEQ ID NO: 235 - DNA, 1501 bp, Oryza sativa
ccgggccaaggacatcatcatatcgggcggcgagaacatcagctcgatcgaggtggagtcggtgatcttcagccacccggcggtgctggaggcggcggtggtggcgaggccggacgattactggggggaaacgccgtgcgcgttcgtcaagctcaaggatggcgccaacgccacggaaggcgagatcataagcttttgccgggagaggctgccgcattacatggcgccgaagacggtggtgttcgatgatttgcccaagacgtcgacggggaagacgcagaagttcgtgctccgggagaaggcccgggccatgggcagtctcaccaagtctgccaatagtaaactgtaatatcatttctgttgttggacattggatgggatgccgtagtatgcagagttccaaagattattagctgattcgaggggttttgccgatttttgtcattaccactcgaaaacctgtgaattttgaacaaaatttaccgaacgtctgagtttaagtttggattttttttaaaaaaaatgattaatttatcgagtggtttttcaatttatactatgtcagctggcaggttgccaccaatccctgtggcaaaatttgatgttggccaaatgacttatttatcttagtggcttcaccaaaattgtgcccatcatgtggctcctattaattttactttcagtaaattgcatattggagctggtatttttacctaagattcaccatgaaccaccctatccttgatcttttcactttaaacgagatatatttaccaatactatgtattttgaactagtggcgccaggggcggagctagaacgaaatgaagaggggtgccactcacttgttttactctactttatacttatataagtgtctaagtttgaattgagaggggtgcacatatagtgaaaataaatgaactatagctaaaaagttttcttgaccgggttcctgggcacccccccctctcctacctagctccgcccctgagtggcgcactactccctccgtcccaaaataagtgcagtttttatcctgttcatatccaacgtttaaacgttcgtcttatttgaaaattttttatgacggacggccaaacgttggacacggatccacggctgcacttattttgggatggagttagtaccaattagtgagaatagaggcaataatgaaagcaaactccatggagagggtgtcggcaatctcttcctcttccacacctcgcaagcttttacttcgacgcctctcttagagcatcaccaatagttcccttacttcacccacaatcctatttttttagattttggtgaaaaaaaaagtctccaatagatgtcctatccggatccttttttttttggaaaccccctccccgcatctttcactctcttcattcgagggagagagatggcgcgtctgccgtccccaatctctcattcgcgccagatttttctcagtgaggagcgcgggcgcacgtgagtgggaggaaaacggaat

SEQ ID NO: 236 - DNA, 1501 bp, Oryza sativa
  unsure (1)..(1501): unsure at all n locations
ataaaattttgactatgactctaaacaaatatttatccgaattcatggctgatttgattttttataagacggatgaagtaagagcaaatttaatagtatagcccactactagctataattcatatataaccaatctaataactaattcatataatagttgtttactatactattaatatatggtatcacctatcatacatatactgcgtcttagaatccgtgctgcaactggttacagatttgtagctcgctgctcttatctctcactttttatcttattaaaatatgtttataaatgtctaatagtctgctattgtacctgctctaacggagaaaaataaatatgcaagctatgtgacagtgacacgtgggatcctcaaggtcgtccgtgggatccacgtgtcaacctcgtgacgagcgtctctgctgcactgacctggctgcccacactccacagagaggagtgagagtgacaaatactcagtactatcttgtacaccggcgattgccgcggtggagatcacgctggcgatgaaagcaacgatttttacacaaacacatcacacactacatcagcagagccaagaacccttacacacacagccacactccatccccaagctcgcgggaaaagccaaagcagcagccaaagaaatccaccttttctagacaaaaattttagacgaaccgcgagactgatggccggctttcaaatacggcagccgggcgctttccctctcgattccccgctgcagatgagatgagatgagaggagaggaaatctccagggaaatttggcaggcataaatgggtagtaattgattgattggggtggttaatgccttccaagattgctcctctgctgctgtgctgctagggttgtgcgattcggcatggggaccaaaccagagaggggaggggggggggggggggcatgacgacgacgacgcccccgttgctataattccttgcnccgtttcgccaaatccctcgggctgttgcctcctaccccgcaatccctcctcgccggttggtgatcaatccggctcctgatttgaagtttctcttggggacccagggtgcccgttccatgcccggtttgctcgtgcattaatactagccgcttcttggataggaggacaactagtagtagttcttctctcctctcgctcgctgttccttgccccattctcttggcttcttcttcttcttcttcttcttgttgtggttgtgtgttatgataagagttcttcgccgttgagatgggttgctttgggtgcttctcgccggaggtggacgacgacctcaagccatccaagcccaattaccactcttctgacgaatcatcaggttcttgatttttttttcctctcgtgtttcagactttcagttagttccggtttttttgctgggattgtgactgtttatctttgcaggcgccgacgcgaggagaaaggtcgcgccgttggcgacggatggggggaacggctacgcgcacagc

SEQ ID NO: 237 - DNA, 1501 bp, Oryza sativa
cgccaccgcctccctaggtgactccccaagtcacccaagcacgtgagagatgaggggccccgcggcgaggcggaagagggaggtgagggagaaggggcggccggggcgtcgcctcccgcgccgcccctgggggaggacgatgtgagaggaggagggcttccgtgtctgtgtctatggtgcgtcacaagtttttcagcaagtttaatagtagagctcactaatagctattagcatattttaaagccaacataaataatatattagctataagattggtttcaatttttccctcctctccctttttctcactcatatatttaatgtatttgtatttgagcacgtgttaaattagctcttacatgagagttaacacattttattttttgtcacatctttccttcacataagctcactattatccttgctccaaaataccgtgtgttctatactacgtacgcctaacaaccttgtgaggccacttcttttctctatggcggcatctgaatctatgtggatgctagggcagaggctagagccacgcaccctaaatgtcccaaggaaaaaaaataatatctccaaccacgtttggtgaatagcctcattgtatcttcgtcggtcgtggcaatgccgggagtctagccaccggtgcgtatgaatcaagatcctctgcaatcaattgcaccgtatctttatcactgatatatagcccgattatgtagcctgataatctctgggttcacatgtcagtaaaaaaatacacggtgcagttactggagaggatctcaatccggtgcgtatacactcagcattgtagccgcccccatcactccaccggtccgcccccaccctgcttttccgaaaacgattcggcagaccggaaagcgggaaaggcagaaacacacggcagacggcacccaccacccaaactcgttttggcagtgaagcatcggtcctcggagccgccgcgccactgttactaaccatttgtagttgatggcacatgtgtcgccgtcgtgtcggccccattctccgggcgagatgctgcgagcaaaatggtcatcccccttcctccgcagctgcacaaccctgtcaaaactcaaaacgctctagcgcttctcgaagccgccgagattcaggccgcatggtgaccgttcttctctcctacaggtggttcaagcgcacgggtgggcccacacgtcggtgaccgattcacacgttagtctgactgaccgcacagtctgcgttcgatttcgcacatgcccgcaccgcactatccccacgtgacgacgacgatacgggcgattccacctgccgcaggcacggctactagtactactctactagcctactaccccacagcagccaggaaccagccacacattccacagccgcgacgcgacaccggaaacaaacgcaggtagcaactgcaaggggcagttggctggagctcggtgatctgtgggtctgatcgcgatgggacgctcaccggagatggaggtgg

SEQ ID NO: 238 - DNA, 1501 bp, Oryza sativa
gattgattttcgcatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcactggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccaggcaaggcgagcgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaccactaattatctgagtataggagggatagtactttagtgaggtcaatccatcataattctttgcattatctttctttgaacacacacatgcactctctatgaatctttgatccactgttgaagcaagggatttggacaatatttaaagtgcctgtcagtccatgatggagacgggcatgcatgatagaaccgaattaatttggggttaaataaatgactaagcagagagaagatggttaatcatagaattgtttttgtttaggttcagggtccctctcctgtcctgcagctttgcttcaggaatgcgcggagatttcggacagctacctaattggtcactaactgctaatctttcatccactaacgctggctgccgctaatctacggtgcatgcataaaaaatcttttataatcttataatcccattgcttaatgacgcatgggtaagattaagcatcaacaaacagaatcgctattaagcttgctaatcatgatgcagtcacatattgtccatttaggccgaaggcccgttaatccgaaggcccaactaataagcacttaagcctatgtaagccgactaggcccataaagagcagtacttctccagtacaaaggggataagacagaactaccctcacgacactttgttggtaaccagaattttggacgtaattagcgcaaactgttaggcccaaatgcgtcatttcgtaaataaaaggaaataattagtgaggccgtgctctgaaaatggaattaatttagtgtatgaccgtactgtatagcagagcagcagcctccgggcagacgagagccaaaggctttgctcttggcggctagggttttgtgtgccaaaccctaatccccttccttgcatcaatctcatggcggcgatttcgtcggggatggtggcttgaaaggtctgtgtgttcttgtttgggattgaggaatagagaggagctaagtggtgtggcggcgcggagaaa

SEQ ID NO: 239 - DNA, 1501 bp, Oryza sativa
ggacaatatgtgactgcatcatgattagcaagcttaatagcgattctgtttgttgatgcttaatcttacccatgcgtcattaagcaatgggattataagattataaaagattttttatgcatgcaccgtagattagcggcagccagcgttagtggatgaaagattagcagttagtgaccaattaggtagctgtccgaaatctccgcgcattcctgaagcaaagctgcaggacaggagagggaccctgaacctaaacaaaaacaattctatgattaaccatcttctctctgcttagtcatttatttaaccccaaattaattcggttctatcatgcatgcccgtctccatcatggactgacaggcactttaaatattgtccaaatcccttgcttcaacagtggatcaaagattcatagagagtgcatgtgtgtgttcaaagaaagataatgcaaagaattatgatggattgacctcactaaagtactatccctcctatactcagataattagtggttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgccttgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccagtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatgcgaaaatcaatctagggtttgcctcctactctgtactgcgccgtcgctcgtaaactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatatcaacaatccaaaaaccttattataggcactgtgattttacta

SEQ ID NO: 240 - DNA, 1103 bp, Oryza sativa
aatgattaatctatgtacagcagttcatcatttgataaaaacatgattcggtggggtaactattagtagtggtattgatcaatttgattatagtagccaaaatatgatgtttatgttgttggaattaatgaatgggccttagcccactcgaagattaattctttggaaaatcataaaagcccacctcatgggatggcatgcatgtggagtttagtaccaccttgcttattctaggagagggggaccttattaaaagggaggatgccctcctagtcacttgaagcatgtgtggtggagagaagaggggaaacgcgcgcgctcgcctcgcctcgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctaaacaatccaaaaaccttattataggcactgtgattttacta

SEQ ID NO: 241 - DNA, 1501 bp, Oryza sativa
ttctgaggcatattggtaaagttgtccacctttcttggcaagcaaatctagggtaagataaagctagctcatcaaaggtaaaaaaaaaggctgtagttgtcctatttatttagtaacattcgcatagtcaacagtgtaaacaggataaatttcactagaattattgcatcaaggttgagacaatttccagtctaaaagaaaattaaaacttgtgttgcataaagtcaacaacagctaaatgttatggcaaactactgtctagtttgatatgaccctttaactaattgaatggctacagttaacagttgacgtaattgtagcaacaatatgtcatgtttctgttgcaagcatctgtaccttcatgaagattgcaccacgtttatgaggcaatctgcaagtgtaattgcacttgtgtctgatttggttcccatatccatgttgatttggtgtcgacacttgatagatatttctaccaatgtaatcatcctttctggactcttcactatatcttgatggtatgccaaaacaagttgtggcatacaattccttttgctttgctttctcctaaaattaatgcaaggcgcacagttcttttgcacattccaggaaaaaaaaattctttctgctttgtcatctgcataaaaaaacttgaaataccaaaatcagaatttgtactccgtctttttgaaattgtacttccagcaagaacatctgaagttccatctagcagtaactggtaagtatgatgtgaaaagaaagctcaatgactggacaatttgttccgttatgcttattccttgccattttatttaaagttttcccatatggagttgcaacaatttgtgggcagaatgcagtgggcattagtactccatcctacaagcggatatatgcttggcagacaaaaaataagggaaaaaagggacatgaaacagcatttatgtattatatggttcctccttggccttagtttgcttgcatgatatgtttaggcatcactttcatcgtcaccgtcactgtcactgtgtgtgtatctctgtgtgcaaggctgtaagcattgtacaggattcttcactctagagcaaagggcttcaatcttttttaccctaccatcccttgagtattccagactccagatgctcctcctatgacagctttgctgcggaaaaccgcactgtcctgagatgcagattcaaaggagtgtccaacacacacacacacacacatataatattccctcttcagataaccttcactataaatacatgccaactggggctgtgctcttcatacccttccatacgttcggacgttcagtgcacatcatacagaaatagtagtatagtactatagctgagtagcatcagtacagacttgctgcagaaaacatcatgagttactatggaagcagttcttctggtaatctgtctactccattatacatttttttctcgaaaacttatttgcccattataataatctatatagctgcaaaagaaca

SEQ ID NO: 242 - DNA, 1501 bp, Oryza sativa
cccgcaggagctcctccaggtcgaagctgtacgccgcccccttccccacgaacaccagccggctcctctccgccgtcgccgccgccgccgccagagcgatctccttcgacgtcgacgacgtcacctcgcccagctcccccgacgccgtcgacggcggcgtcaggcccctcgccgccgctgttttcccgacctcgccgttcgccgcgcggcgccgggaggccgcggtgcagaccacgagtagcaccagggccagcagtgccgccgccccgccgcccacggcaatggccgcgaccgccgcgccggacagcttcttcttcttcttctcggacactggcacggaaccgcctccgctgcctcgtccatccgtcggcgtcggcgcgccagcaggagacgggaagaagggctcgcatgggcggctcaggggcttgccgcagagctggaggttgccggcaaaggactcaggcgggaagcgcgcgagcgaggcggggatggagccgttgagctggttgtaggagacgttgaagtcctcgaggagcgggagagtcaagctcgggaggctgccggagaagcggttgccgtccaggcggagcgagcggaggttggcgaggccgttgagcgcgaaggggatggcgccggtgaggttgttgtgcgagagcgcgaggtgctggagcgccgtgagcttggcgacgtcgggcgggacggagccggagaagaggttgccctggaggaagagggagcggaggtcggggagggagaagaggtcgccggggacgtcgccgaagaggcggttggatcggagggagagcacccggaggccgcggagcgcgccgagagtgccctgcgggacgcggccgatgaggccgacgccggggaggcggagcgcgacgacggtggcgttggcggcatcgcaggtgacgcccacccaggcgcaggcgggcgtggaggcgttccaggcgagcgcccgctcgtgcggcgtgccggcgaggaaggcacgcagagccgagcgctcctgctgcggcggctcggcaacggcgcagcaggcgacggcgagcgcgagaagcaggaggcggagcgcggccatgggcatgggtcagtgtcggagtcggagtcatgggtgggaatatgaagagggagttttggttttatttatgcttgggattgggaatgggaatgggaatgggaattggaggattgtaccgtgccgtgccagatgggacacgtcctgcttccgtccgtatcgcctaaaataaacggcccagatcttctctttctggcctccactgctgtctacttctacgtagtaggaattttaaactctcaagattttttttaagaaataacaagatatatttacatttatacacttcccatgtaacttaaaattcactttcgtaagttgtaaaaggaaacatattaaactaagttagttaaacgtatatttataataaaatttgttttttttcactgtaacatatagaagttaaattatactccttccgtc

SEQ ID NO: 243 - DNA, 1501 bp, Oryza sativa
cgccatgcatagcatgtaatgatggaacgccgcgccgtccttgcagcgagatctcctttttctcaacatgaattcccagttgcatattggctggcatcgttcccaggccggaggggggcccatcacttaccaccccccctcccctcaacaggcccagccgcaggccagacgcctaggccgagccacgtgaccgggtcgcttcgcttcgtcgccgtcttgcccatgccctagtccgcgagacgccgctgcgagtgcctctaggcgccgactcaccgtacgtcggcccgtcgcccatcagccaagccaccaaggcggcatcgttgcgacgctgcctggtggctgctccctgccctgcccggccgtctcatcctgtgaggctgtgatcgtcatcggccatcgcccattcgctcctcttttcttcatgctgaaggtatatcatgatcacaaacctataagtcaatcaacgactcgctctattctgctatgcctctatcaatttactttgcaatttcactatttcgggtgttaagaaattcatactaatttgtttgtacggtgtttcttttagttgtaaattatactatcaatattatttattgagaataaattgctctattacaacttgcaaactgcttgatttattatttaccatgttaaaaatatttatttgtgttactctatgatatttgtgctgatatatgtgctttatagagtatatatattagaagtaaaaaaaaatcttaactccttagggcgcccataatgttaagttcgcctatgacttttcaaatgttaggaccggccctggatcgttggacttacgaggaagtctacttttggttttggtgaccacgacgagttgaggagcgccaagcggggatgccggtcagccacacgtacgtccggcaactatagctgccgtgaacagaccggccggtgacatgatgtgtatatgtgtagccgctgccgctgcctatgccgcatgcaagccccgccctgacgtacgtagcacaatcctatctctgttctgtacgtgtatatatgctactgatctttttcatcaaattgcaggctgcagcagtactagacgtgcttttccctccttgccacacgcattgagccatttacactacacacacagccccagattccatttcacactcgcgtatatattcttctttccttttgtctggaatgctgattcctgaatcgatgattaacgagtcactgttactactactttcccaccctgccctcactacctacccacccaactcctcactcaactctctgttccagccatcaagctcagctacttgatcgatctcctttaaaacggtagctgagagccttcctaacctgcttcccttcatcaattctgatagctcctctgccactcaagtacaattattcccattaattcgctccattgctgcacaattaaagttagcagaagctgctaggagaaatggagaggccgggtgatgaacatgatgactgc

SEQ ID NO: 244 - DNA, 1501 bp, Oryza sativa
cagtaatacagcatgagtaattgctgaattttctaattgaaggatgcactgtttgtttgatgattcttcatcgaaagggggtcgttgcatcggagctacagtagatgcttgttgtgtacagtaattgactgactgcacacagacacagtaggttgctctgaatgttggggacaggtgttgtggttgcatggctagtaggatgctttcctctgaatgaggaattgcatattttgcatggctgcagagctctgccatttggacacatggcactaatgtctttgatttttcagtgttacatgttacatgtgttgtttctttttcacgtcccgatgctattcgtctccttgtgtagctgctatgctatgcaccttcgtttgtttcttcagtctaaggaccctgacccagcggcgtccgtccgtccgtccatttttagtttaagttgctttgtcctctttctgtagaattaactcactgcaagtctgtcactgatctgaatcagaggtgaaagctcttgcagtaagacttacggttcaatatagacaaaaaaaaatcatctccagtaacgtttaatttgcagtcatttatgagcttgtttacttcctagtgtaccctgctatgtaaaaatgaagtgtagcttgggcaaatggcagttcaacatcgcaaatattgccagtgactcggtgtagtctccgtggaaattgtgtccttccagaaactatctcaggtttgtacctttcatactcattaataatataattaaaacagaggaaatctctcaaaaagaaacaaattaaaataagtgcagcaaaattgattgctaatcttcggtgtccagcagagccctgacgcgcaaaaatacaaaaaacaaggtgtcatcttgagttaatttgccagtgcgtcatctgccatgctatgtaaatttggtctgtatcttcgcaaatctcaagatattattatcggtgtacttcccatgtaaattatgtcaattcagaaacgacaatctccttgcctaatctttaaaggtgttcatagagatagcgtatgtatttatagaaggtgagtatacacgtgtgtatatgagcgtctgcacgtgtaccgaaatctgcaaaaataaagaaagaaaaagaaatctgaatacgaccactacttgtgcacaatgcaatgcacacttatatcaataataataatatattaaaaacagaggaaatctctgaaataaaataaaagaataatgaataagtgtatcaaaattgactcctattctcgtagagtcgtatggtggccagcttgaggccctgacgcacaaaaatacaaaaaaaacagaggtgtcatcttcagttaatgctgatgatggtgattagcaacccaaaaaacccatctctgcactgcacttactttcgttcccccctccgctataaattacaaaacctccggggctccacttcgttgcctctcctcctcctcgtcacctcacctgcacctgcaccaacgcgagagatca

SEQ ID NO: 245 - DNA, 1501 bp, Oryza sativa
attagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcgcattatcttcagtaataattcagattacacaagtcgcaattgtctagtggtaagttggcaaacttactgggaaattgagcactgtctcaggaccccagtacttaagagctgcaaggtcatatgcacgagcagctgcctcttcactatcataagcccctaaacatcattaaacattgcactaatgttcagaaacagaccaaacaccaaaacattaagtagttatgtaacaactagttgctatatgcctatattcttagggataaactgttttcatattgagacaaaccaaggatgtgacagatcaaacaaaggaaatctaagattatacaagaacaggaagcaacatgcagcatgaatctgacaaaacaggtgtgtatagacaactagcttgtgggacttacccaaatagactaatgagaggagcatcaagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttccctttttctttcattatagtacattatactgtaaaaatactcgtatttaactttctttagtattttcagagaaaattcaggttaaaaatccttaaaaaaaatcaggcaactaatgcatgttgcgatcaatgtaccttgcctccctttcttcttgttctgaagtgaagtggagcaattcttgtcccacagatgggcctcaaatctgccagtccaccgatgcctgtttatacatacagatacatgcatgcaacaaatgattccaccgtatattgaatttattgatgattgataaataagcagcattaagcattagtgtttgctttacaggaggaagaaaaactgaaggagttgaccaccccagcagtaaatgtagaccaaccaactccctacttcccagctaataataattgactcactccaaggggaggagcagcaagaaaaaaagattaaaaatgggaattatgagatcaagaaatggatccgatcgatcatgctcgccaacctccaaaagatgaggcatgaaaaggggagcagactcaccacccagaaaacgataaaaataattcatgatctctgacatgcaagtgaaatgttcagaaacagattggaaagaagcggctgataatttcgggagcctgaaatgatggaaacgatgcggaattttgggctgaaaatcagccattgattagctagcggcaa

SEQ ID NO: 246 - DNA, 1501 bp, Oryza sativa
ttctctttgttctttaccagctcgattctgtgaatgagttgggcatattgaagttcattcccttccataatatcacaagttatacatgtatctagctataactaatcaaatagtgctcacatgatgcttatcttctgtctacgatcaatcctcatatgctagattctacatgtataatttcctttacagtaccactgatattgagctagtattagtatatatcaaagttagattgcaccttcaatacagatcacaaaaatccctgaacttcagcaccaaagtttgtacaatgtagaaaagtcattcaagtatggccataatataactagagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaagtatttggctacattggaagagtagtataagcattattacttttagtcacacatatccagttagccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttac

SEQ ID NO: 247 - DNA, 1501 bp, Oryza sativa
cgcaagaagggctaagtttgccattttcaatgtggtcaccacttctttctcgataggatttatgttgtttgtgctcttccttatctttcgtggaaggcttgcatacatatttactgaaagtaaggtagtagcagatgcagttgcggagctttctcccttgctagccttctccattttgttgaatagtattcaaccagtgctctcaggtatggtattccatttaaaagaatagtatatatatcaatataatttgaaattgcacattggaattataatattttataatcatctgtaggtgtcgctgttggatcaggttggcaaagtgtagttgcctatgttaatgttacatcatattacttgttcggtatccctattggtgtaatactaggctatgtgctaggatttcaagtaaaggtgaggagccaattgataaaatttcattagtcaatttgggacttaaattgtgtttctcaattccatttgttgtttctatagggcatttggattggtatgcttcttggtacgctagtccagactattgtgcttctatttatcactcttagaactgattgggaaaaacaggtatgttaattgctcacaattttccttatctttttttttattaaatctcttaacccacatagcatgtgggtctctctagattttttttctcatttaatgatgtgtttcatgttcttttttctaggtagagattgctcgacagagattaaaccgctggtctatggatgagaatgggagacaacagaatccgggtgaaaatccatgatctaaaacttctgcacacttgtaatgaattatggtgatctatgaatcagcttgttctaatgggattgccctcagagtttaagatccttcaaggtgacatcatccttcaatgaacctataaatggcttggaatgatgtttttccccatgtgtcacaccatggaaaaaccgtgatgttattgaaggaaccttatatatatatggtcgtaaattatccatttttaccgggttatcgaaactattgtagcaaatgcttgaccattatgagttttacatattttttttgcatttgttggaagagcatgcatatgcttgcatgtgaattgattgtaccctttggctttgtatctacatttgactaaatttattgactaaactagtatcaaataagggaaaattgtccacactaaagagtggtggaacacctctttatttttttactagatgatagtttttgccagattatgttttcggacaaaaggtttcctggagatagtaatgattgcttgctggtatctttgaaagaagtgtaattctcatatctttcagcatagatcaccaaatatagacagatggttagcaagctttaaaaataaaattctcttgcatatttgcattctgaataatactaccaaagagatagttttagagactttggtggtgtttgaatctcctgaagatgaagattaagtgttttacgcaaagatgaagatgaa

SEQ ID NO: 248 - DNA, 1501 bp, Oryza sativa
gacacgtacgtccggcaactatagctgccgtgaacagaccgggccggcgacatgacgtacgtagccgctgcctgccctgggcctaggccggttgtgcaaccgcctgggcccaggccggaagggggcccaggcggcagcccacatcatagcgcagcgcccaggccggggagcgccgagcgcgcgtcgcttcgtcgtctactcgtctcgtcgccgaaccccaagtcgcgaatgccctagttccttacgcgccgagcgacggagcgagacgccatcagccaagctgccggtgcctgcagccctgcctgtgcggctgtgtttcctggatcctgaaggtacgtaggtcacagtctcacagaagtgcctctatcgatttcaattcattgttgaattatagtttcaattatttataaggtatttataccactttatttctactatggcctttttagttgtaattatattatcgtttattatttatagagaataaattattatattgcaacctacaaattgctttatttattatctatcatactataaatgtttaatttgtgtcactatatgggtatatgtgcttaatatatatatatatatatatatatatatatatatatatatatatatatatatatatatatattacaagtaaaaaatagctttaacttcttaaggctttatagtgtaagttaattactggctctgtacgccgcttgcaagctccgccgtttgtgtgtaatggggtttcccaaatcgccggggccagagttaccgcgccccggcagtaagcacggttaccgcgcggtaaccgcggtaaccgtgaaaaaccgtacaaaaccgtgcaaaatttatcaaaaattcaaattattttttaaatttatttaaatttaaggaggttaccgcggtatttatattaccgtacccccgcggtaagcccggtaaccacggtaaccgcgcggttaccggcggtaagtcgaaccctggtgtgtatacgtacataacacaatccacttgcattgagccatttaacactacacacaaccccagattcctggatggatgatagttctgtagtatatatgacgacagtcactgttaattaatttcatactcgctatattattggtccttccttttgtctggaatgctgattcctaaatcgatgattaacgagtcagtgttactactactttcccaccttgccctcactacctacccaccttatgtagcagccacagggacaatcaggtacttgctcactcaactctctggtccaagtccagccatcaacccagctacctgatcaatctcctttaaaacggtagctgagagccttcctaacctgcttcccttcatcaattctgatagctcctcttcccctcaagtgcaattattcccattaattaattcgctccattcctgcacaattaaagttagcagcagctagctaagccaagctgtgctaggagaaatggagaggccgggtgatgaacatgatgactgc

SEQ ID NO: 249 - DNA, 1501 bp, Oryza sativa
aaaaaagaaaatttttttatgtgcctctgaatattttggatcccttccgtgacattaaatgttgcctcatctctctgacatgtctgatatttttttccccatcaatacactttccattactttgaccgttagatttttttttctaacatgactatatgcccacactatccatttctcatagactcgcacttatgtacactttaaaatataaatctcaacttgaaaaaaatacagtaaaaatcaaatcgagcaaagtttgagagttatttgatggaaaatttggaaaacaaagtttaaattagtttaaacacaaaatgtaattaaatagtattaagtgtagtgggtagagaggatagttacgaggatgccgccgctgaagcgcatgaggacggtggagacgagagcgtatccggcgagctcggtggcgccgatgtggccgatgaaggcttggctgatgacggtgacgccgaaggtggagaagcgcgcgcagatggaaggacccgccaccacccacagcttcttgctctccaccaacacccgcggccccaacgacccaacctcctcttcatcttcttcttgcttgtcgttgttgctgccttcgccatgagcgtgcttaggctccagcagaggagccgtcctgcagtcatcatgttcatcacccggcctctccatttctcctagcacagcttggcttagctagctgctgctaactttaattgtgcaggaatggagcgaattaattaatgggaataattgcacttgaggggaagaggagctatcagaattgatgaagggaagcaggttaggaaggctctcagctaccgttttaaaggagattgatcaggtagctgggttgatggctggacttggaccagagagttgagtgagcaagtacctgattgtccctgtggctgctacataaggtgggtaggtagtgagggcaaggtgggaaagtagtagtaacactgactcgttaatcatcgatttaggaatcagcattccagacaaaaggaaggaccaataatatagcgagtatgaaattaattaacagtgactgtcgtcatatatactacagaactatcatccatccaggaatctggggttgtgtgtagtgttaaatggctcaatgcaagtggattgtgttatgtacgtatacacaccagggttcgacttaccgccggtaaccgcgcggttaccgtggttaccgggcttaccgcgggggtacggtaatataaataccgcggtaacctccttaaatttaaataaatttaaaaaataatttgaatttttgataaattttgcacggttttgtacggtttttcacggttaccgcggttaccgcgcggtaaccgtgcttactgccggggcgcggtaactctggccccggcgatttgggaaaccccattacacacaaacggcggagcttgcaagcggcgtacagagccagtaattaacttacactataaagccttaagaagttaaagctattttttacttgtaa

SEQ ID NO: 250 - DNA, 1501 bp, Oryza sativa
gtagccaaggtcaaggttggtatgcttcttttcccccctctattcctcgcgttaatatactgcctaggtctgggaataccatgtggatgtttcagatttgcatttccatcttgcatgcctattcttgagctacctcccttttggttttggtttttttttttttttacattcgtcagtgtttgctgttctcttcttatggtgggacctgggagttgggagagccgtccctcagctaattttgcagccaaacagatgaacagggggagtagctggggcatctagaagttgtaaaaaaaaacttgcttgcagaagttagatccttcagttttttttaaaaaaatggattaataatacagctttatgttgcttttagttttatggcaaatttaggaagctgcagttcacccacattagtaaaatggcaaaaagttcaattaacaagttttaatcatcactgcatgcaatggaaaaacagcaggtcaaccacttataaagtattgtgtaggatgcagaccacagaaaatcacaactgttgtcaagattacctatgtaaagtacgaacaactaaccacttgaatcgtgaacgcaacatcatgccaaaatatctaggctgcaaggcaaacctaatccaacatacctaatacacactttctgataagctcaaagtgttggttgtcttctaaataaaaccgttgtactttactacttacagcagaattgtctcagtccttttactattacttcctctatttcatattatacgtcgttgacttttttcttagtcaaatttctttaagtttgactatatttatagaaaaatatactaacattttcaatacaaaacaaatatattatcaaaatatattcaatgctaaatttaatgaaactagtttggtgctataaatgttgctaatttttcctataaagttggtcaaacctaaagaaattgtactacgaaaaagtcaaactacttataatatgaaccggaggaagcaaatcttttttttttttgggaagggccttgctgaaggtcttgacatgaactttattcagttcatcttttactatgcataaaatctccactagttgtaaattcgaggttttacagtgttgagcactataattatgttgttttacgcttgtacgaacaaaacttcattttttttgtctctgaagatatatttatttctaaaaataagttgtcataaacaaaaagtcaagcatgtatctcaaaatagtgacctcaccatattgtcatcctttctttttcataagtagacaaccagacatgcccttctctatcttccttggccatctctgccttttccttcctacttttctcaaggaatctgcttccaaccacctttccctttgcttccccttcccctctcttaatcttcaatcctactggagaggctatatacattcatcattcacctctttattcccacacaggctatcgtcacccgagattgaagatcaagtgagtgttacaagaaga

SEQ ID NO: 251 - DNA, 1501 bp, Oryza sativa
cccccaaaacaatgtcagcaaggattaagcactacaaaattgcaaaataaactaaattggacagaatggttaactggagcatgaacagaataaaagctaaagctaagttgcacattagtaactaccactgtgtggagatctgaaaattagtgatcagaatttttttttatttttcttttctcagaattgaccaaattgagcagctaaaagaagcaaaaggactaggtaattgcacctaagtaagatcaagtgatacttcagctctataaattccccctcaatactaacgtcccgaagcctgaattgggcgccaagcagaggcagtgagaaggcacagatccttccatccgagcttcagagcgccattctcctcaataagcgtgtatccatcggaagggaacatcccaagcagcagtgcagcctgagcagcagcgcttccagcaagcgacgacacacggaagcccgactgcgcaagcttttcgcgccagctcccaaacttaacatcgccggtgcgtgctggaccgcccacggctagcacattgcggatctcccgcgacaagagttgttgctccacgacatgccgattcgggctatcctcgctgtaactcgcatcaagcgagtcgaacagtgccgaatagtagtggatggcctccacaaaacgtgccaggaaggagcctgagtggctcagatcctgctccaccattgttacaacctttggcgccaacctgatttgtgtggtccacagagtcaagatcagtacacaaattaattatgattctgttcgacaagaatgactcaactagcaacatttagaactataaatgataacaataagttctcaaggacacctaaattggttgccttgccttcatggtttttgcaagtacagtgggacatatctattgcagtccactactatgtgatctctagtatgaactgtgtatagattgcagccatttcaatttaataatcaacattggtggcacttagaactagaaagctgagaccttttggcatgaaaagttggtcatgatgataagaacttttagctcgttcatagtgatccacaaaccaaatggaggagaaatctttcccacttctcggatcaccaaagaccatggagaagcttgataccacagaaccactagaaagttgcaacctttctaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 252 - DNA, 1501 bp, Oryza sativa
aaaaaattataattcatatatagttctcctacagctaacatacgatgtattagtacctaactagtttgataagcggatgttaatttgctgggcaatcgtgaggtttggagaagtgaaagagcgaagtcgtttgtttatctgatttggaattgtgttgtactagtcggttagttaagacttgagggggagagagagagagagaggggggggggggggggggcgggaagccggtctgctattagaacgttaaccttttgggtttgctggattgcgctgcgcggtgtgctgcagttaggcaactcggcatgcatgcgtgccttttttttagtaatactactggagtcgtagtagcagcaggttgattctctgaatgttctagtatactctttcttatcgtgtcgtgctgctttccaaagctacccgtgctcgcaaaagtatcagtaggaatgaatgaaaataagcaagtttgggagattgatgcaaatgaaaacatgacatcgtctgatcatgccttccatgcgtgatctatctatcttatcttgaagtatacatatgtatagagaagaaagagataaaatttgatccaatcatgcatgcgtttggtggaacggaagggaagggaatggaatggaagaaaaggaggactagtaaaccttttactattccatgaccattactccatggtctagaaccaagggagggagcgtgcgctgtggaaaaggggcctctttggttcgaaaaaacccccccgacccgatcgattctgccgacgaaaagatgaaaagtagaagtagagtttgttaccggtgtgtgtgtggcgtcactccatcgttttcccctgggcggggtggcctgttgttattagcgtatagtagtaataaataaacgattttgctatatctcactcgaaagattttttcttatctctcactcgattttctcactcaaatttacagtgcattttcttgtaagttacagtgtaatttatgaaacttacactgtaacttttgtaagttacactgtaatttttaaatcttcacatgtaaattttaaattttgtattggatttggtctttttcttgaggatatggtaatttaatgtttattatggtgtttcttaattgctttttgctttttattatatctatcggattttaatacaaagattaaaaatctgtgtgatacgattataaaaatctttcgaaagatgtataggtactcccataaataaataagaaaaggagtacaagtacagtaatggctagcaatcaattagatagaggcccttagcttcctccttgattatgttttggagtattattggggatggatggagatcatgtccaccgccaaacagagtgttggaaggtgccgctctgccctgttgatatgctctcccacgccgcccatccctctccaattcctcctgctattagaccacaacattccagcagaagcagatgagggaatagcactagagtagagagcaagcagagaggca

SEQ ID NO: 253 - DNA, 1501 bp, Oryza sativa
tcgtttaattggaccgcatgaaaaaaacacatgaatcggataagagagatatagtcaaaggaaattttccaagaggtttgagatctcgctaagtttcctttgaaatcgacatataacgagtcattccatatgatttggaaagcttcagttccttagatcaaatggcaaaataggaaaattttctagaatttaaatcatatgaaattcctatgtaaatcctttaggccccctttgattcgtaggaaaagtgtagggaatttgaaggatttcaatcctatggaaaaaattcctatgaaagcttttgaaacaaaggattgaatcctatactatcctttaaaattcctatggaatggctaatcctatagagattttggaggaaagttagcaagaggtccaacctcttggaaaaattcctttgaatctatctctctcatccgatttctgcatttttcctgtggtccaatcaaacagtcattcctttatttttcctgtattttccaatcctctgttttacaactacattcttatcagaatcctatgttttttctattcctccaacacgcagaaccccctacctggcgcgccagatgacggagcgtggggctcctcacggggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctaccaaagagctggagaaccagagagctcttactctctccctctctgatcgttctcgatccccaaaatcccctttctaagtggacaaggtcctccttttatacctcaaggggataccacatgcaccatctctctctttttttgtggggacttatcctatcttttcataaatagacggagacttgcatggttgccgtccgaatgaccttctgatgggacggcccatacctacctccacttccgccggaagcaggcgcgacgtgggaacatggttgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggcatatatctgaccgggtccaacgtgccacccccaggagctaacacgccggctccggctagggacgagtgtttggaggctctcatcctgacgggatggggcgaggcgtgcgtcagaccgcccgtcgccacctaacccgcaatctgattggtctgtgactggtcacagaccagataaacgagtgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 254 - DNA, 1501 bp, Oryza sativa
gactcattgctttttaggactgatatatctatttccatgtaacaaatctgcaacttagtcaagtgcatccattcatttctcatagcttccaagggaaccaagaggcatgattatcaagctgacagttacctctgttactgacaagctccgcccatatcccaccagctccggcatggttaatttcctgtgatgttcaccgatccagttatcatgactgtcgaggataatctagaatattcaaattgcagcgaacatgtaatgaatataacaagggccaacaaaagaaatcttcacacaccccaccccaatccctcctcttcccaagtaatgcataaaaatttcaacaccgccatccacagaagaaaatggaactataatacaccggcgcaggagaaaacatgtacagaataggagttattttctgaaaccaagcagaagatgggcatgaagatttattaaatctcatcatagctagtacaacgtgctgcagtgtgaagtgtgaacaacggtaaattcgactgaaaatactagatgcatttatgcatcccccaggtaaggttcattaagttattgagccgatcctgatatcagttctagtgcccgtgggagtgatgcgagaaggatgtactgaaccagaagctaaataagcaaagcctgacctcgaaaaacaatccaaatagcgtgtcagggatctttcgagaaaggttccatgaagcatcaacttcgagtactgctgtctgagccatgtccagttctgcagcttggcatttccagctgacagagaaaagaagcaagtaacagaaggcagaaaaatatgtttcttcgaaacccattctctgtcctgcgtcctgcctgccgataaacactaattcagcccatagatcatagagtaagcgcagtaacaataaagggatgagaacaatatagattgaatcgtttaacagcaagaaactgaagagaaaacaataggtatcattggatcagacctacatgaaaatcgaaactgccagttacagaaacataaatccacaaccaagcacttacaaagggaactccaaaaaagcgtcagtagtcaccagtaaaccatccaaatttcagtgaaaccccacaaaattttccttagaaaagaagaaacagagacgaatctatcatgcagagaaccaacagcagaagggaaagcagagtggttctctcaggcatttcgtcgaacatttcaaccgcacaacaagatcagggtcagaagagtggaggagagagagatttgaacctatggatcgaaggattcctttgcctccaacacttggagacgagagagaacagctacaattcgtcaactgaatttgtgaagcttcgatagtgttagagctcaggagggaatcgaagctatagcatctttaaataggcgtgcgatgctcatgctatgaacaagacaagtgtgagctgagctacatcataacgtgacatctgtagcctgagccacggacgcaataatgcaagcgcc

SEQ ID NO: 255 - DNA, 1501 bp, Oryza sativa
aatttacagagagttggtttttcatatgtagcactatcagattacatcctcgttagggtagaaattcatggtagcaagtggttatttttttggttttggcaatgtaatcaatggaaattttgttttagggtgttgttaatttcttggtactgcacaaagatcgtcttatacagaacaaataacataacctcttgttcctgccgagtgggactcgattgatttcaccatgagattctctaggaaacatgcatgtatagagaaaaggtgcctaaatcaaatcaaggtgaattaggaggtggggatttgcaacaaatcttcttatgagggaacatctcaaacccagagtgatatgtgagggtggtttttgcaattttcccttaaaaataaaacacagtgttgcccatatgacaggcagcaagctagcagtaaccaaatgatatatatgtgtggcataagactgttaagtatgtgcaaaatttagctacttcaatataatgcttctgcaatcactatgctcagtaaatatatgttgacagaaaacacgaggcctgggagatctgcttaactccagtgcaggtccaaagctcgtcttcggatgtatgagcgtgccagttgatttgatcctgcaatcaacaagaaatagaacaaagaaaccacaattaatcctataaatgatagccgatcggctaggtgccgatgacatatcatttatttcaagccgttgtcatgtgtacatcgaccgacaaatatcaataagcaaaccagaactaaatctactcgatcggctgtagatgttaatgatatataatccttatatcaatatatacttaaatcaaatgattgtgatagatcggtcgccttgctgagacagtataaatcacttagatcgaaatatatattaatagtaggattatatacattcatagcatagccgatcaggtagatctagcatgtatcggctaatactccgatactactctatactaagattttaaagcaagtagaatatactaaacataagcttaatatacttagatgcgacaatatcttaacataaagggcagatttaacatgtcaatcaagcatatagaataaaagtagttaaatcagataagatcggttgaaactccgatactaccctaatcagcaatcagaaagcaggctagagattgcaattctaagcacgacttaatagatcaaactcaactgatgcagcattaagtatgaaaagaaaaacaatatctagacaatcaagccgctggaagtttcatagagtggtagatatatcacatagtctaagttaacatcattatctaacctaatcggctgccttccattaacagatgttagccgattataggttagatgaagatattatcaaagattatgtgaaatatatgataactcgacgaattatatagacaagattagagtgtcataaagatggaagcactaatcttgagaacataagtcgtcatgacaagttttacctcttgttgaa

SEQ ID NO: 256 - DNA, 1501 bp, Oryza sativa
tctaaagtactaccataattacacataatttcatacaataccaaaagggtacctacttcgaggtactttgttaggccaccattcataagtccaaacaggcacacaatcaacacataattgaagcattcatctaaattttttactatgaaaacactctagaaatttttttaccgatttttccagtgcgtcttggtcttgtaggagttcttctaggccgctatcatcgtatggatcttgcgcatatcccccaatgaccatatcaacatcatcatcgcttgacttgtcctcgtcgatgctaacatctttagcttttcccctcttctccttcatgtcagtttgcgtgacgcttgccttcttctcgaacatggccatgtggtcgctatcatctcccaacatagtcctgtaacggataaaacacagtgacagttaatacaagatgggatgtaaagatgaatctatcatggaatcaaactgaaatgtacttcgattacattatatattcgatacatttttttaaaaagatagtgctgacccatgtaaataagcaatgtctaaattgaagtatagaccaaatggactactgaacgcaatgaaagccaaaagtagagtacatcagtttatatatgcgtggcctagttaaaggatcaaatccagtgaataatagaagtataacaatcgaaaaagatttgcagaaatcaaagtatagcatccacggtaattctcgtagaacaacatcaaggttacctagttaatttaattagctatgaatgacagcctaactatctgtgggtgcagttgtactattggagcaagttgaagcttctcaacgataggtttcagtgttaaaatgaacaagtcaagcaagcaacatacgctggctaggtagctgcagccaacaaagcgagtacgacgagctgcattcaggagtaagtttctttactgatattgaaacaagtcagaacaaaataattaaccatatatacttagtttttttaaacaagatgatcaatcaagcatcatgtcctacacgtcaataatgttttatatttaaaaacagaggtattaatattcatgcattacagtgtcaccacaattttggatttttcatcagcctcttgattgagcaataaagcagtcaaaaaaaactttgagaaataaaattcgcatgttcagtatcaaatttcttacagtttataattgtttcctatactcaataaaaatttctaatttcagaatatacctatgggcaacaaaacagaaaggaatgctttggttaggtttaaaactgcttggatttttgttaacactaatttattttatttgaaacatgtcatcataacccccttctcactccatgccaaattttgcacaaaacaaaatgtaaaacccagctaacccgcattacttcaacattggtaacactgaccgacatataacagctggatgattataaagatacaaaacaccgaataacattaacctaggatattctatgcagtac

SEQ ID NO: 257 - DNA, 1501 bp, Oryza sativa
tctctttgttctttaccagctcgattctgtgaatgagttgggcatattgaagttcattcccttccataatatcacaagttatacatgtatctagctataactaatcaaatagtgctcacatgatgcttatcttctgtctacgatcaatcctcatatgctagattctacatgtataatttcctttacagtaccactgatattgagctagtattagtatatatcaaagttagattgcaccttcaatacagatcacaaaaatccctgaacttcagcaccaaagtttgtacaatgtagaaaagtcattcaagtatggccataatataactagagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaagtatttggctacattggaagagtagtataagcattattacttttagtcacacatatccagttaggccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttac

SEQ ID NO: 258 - DNA, 1501 bp, Oryza sativa
atggatagatcttctggaaaagttcatgaacaattattttttgttctttcaatttcggggcaattgcaaatttaccactgctttgaattgttattgcaaaactgccactagaaaattacaaaaatgccactggaactgtcattcgagtggcatccttgcaaaattgaaaaaaccggtggcaaatttgcaaatgccccatcaatttctcataggtcatggttatatctctccttgttgcaaatttaatggtttcgacaatggaaagtggggtcaagcatttaggtggtgttacttagtggagtagtttttactaaccatccccacggaatggaaaattagtacaatggtaccattttacacttttctggcaaaatgtatctacttattttttaaactaaaccggaataagaattaccaattgtgtttcaataagtagaagtaaaaactcagacgggttacaaggaaaagaaaaacaactacctgcggtcagctgaacaaccacacagcacacacaacaacttacaataccatgctctttaaattggcaatataatctatttagtcttgaatcaagtcctggtgcaatgtttgctctgtacagaccccccccctctcaattagacactgaattaaaactgtcttcctacgtacaaaaatctgtggctgatttttttttactcagagttattttgactagtaaagtagtggaactattagcagagtgaatattttcttgagtaattaagaaggtgattctaatgtcttgagtaactattataaactagccgactatttcatccacagctacacatcttgatttggttttacattgtaacgtggtaagtttttgtgccattgtgtggttataaaaaaaatgctaggagtttgctagtcaccatttacttgattttctagcaaggtttggagatgtaaagataagttaacccatgctcacttttgtgttgtcaggtttagcatagattttaccttgtcatataaatccattttttacaaaatctggattggaagccattcctgagttacctgagattctttcttgattaaaatattgatgcatgaaaatatttgggtccttgatcttttttacaacacctgcctattaaagatgaattaaatacctgataacaacactattcttacacattgtatgagtccctttcatatgctgtgtatacatactcatcaggatacctatagctggggtcaaatcggtgtcaacagaattctacttcaagtatgtgccattattctgacagaaatacgatggcaacttatgcctgctaattgacgaagtagttacagaatgtgcacttggacttgtcaagaactagttctctacacattaagactccttttgctgttagtgtcgatgaactactttgaggtatagttttgcagttagactgccatgctattggctgttgactaccactgatctttatctttttggaatggattttgttcatacaccagtagcact

SEQ ID NO: 259 - DNA, 1501 bp, Oryza sativa
ctcctccgacacctcctccggcaccggccgccggtgatcgccgtggatttgattcggcctcgtcgtgcgagtagatcagcatcatcagtaggtaaggtggtattggcgatttggcattcaaaggattcggtggatgaatgaatctgattgtgtatgaaccgattaaaaagttctcttcctttttttctttcatattttgatttttggtgaatcgatggtgtgtaatgtaacataatatatgttaaaaagcatacgcataagaagcgttcatgtaactgctgtgtccatgtacagattatattcagatgaacatcttaattatattctctaaaataactgtgcttttctgtttgactattagtagttgtatatctgaattaattgtcacttaactttcatatgctgggaacagatttttgcagcagttggtactttcttggtggttatcatctgcttagtacactgttgttctcttcttctgacttctgagctgccgtagcacaaatttacttgatggctttcattttactaaaagaaaaaattaaggtgtgggtgcggttattatagtatgttattttgtcactagcatgtgtgagggttcatcatttggatcttcatgcctgaaaagtattagagctatatatatactctaagtctgcaggtcaactgttagccgtttaaacatcaactcctttttgttgtttctgtcgttaaagtgattacctagcatagcttgagtgttaaaataaagctaggctaatggcaataacactacaacagagactaggttcctgcatcatgggtaaataaaatcgtttgtcttcatgaaaagaaatattgtgtactaaaaaacaaggaatcaaaaaatcaacatgcagaaaggaagctggcctctagtttggtgtataggctctagaagattgagaggtactgtttactagtcaattcttcagagtttaggtatacaatttagctgcttcagattaaatctattcagtgtactgtctattctggagcatgcaagagatttagttgtcaaatgtcaatttttgcatcattttcagagctgtcatctctgtatctgactgtcactgccgaaaccataatgtttgttgatacttttcagaggattttctcttatatatgcttttcagatcgagtggattaaggataatttttttgactttgattaaggataaatttaattatacccatgagtagtgatcaactggattacatggtcatgcaactatatttaattttctttaacttactgtacttattacaaagttggtgtatttctcatttttcttcttctcagctaactaattaacaaagtatatatatacacatgcccatatattcttcacctactatacttgaccctccaaaaaggtcaggtccatttttaggtgagtgagcaagcacgggcgaagtccatgtgacttgttctttggccaacatccatctatcaaaacaaaactttaatttatgcatgcca

SEQ ID NO: 260 - DNA, 1501 bp, Oryza sativa
tggaaatacaccattgcagccttgatcgtttgttctcttccttcaacaatggctttaatgtgtttgagtgacgtcttatcagcccttctttcaacatcctatgaagcgtgctttttggtatacccgcagctgatgcaaatgaccgtaatgtgccccttagttgcaggggggcattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacaccgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacagtccataatttgcaactaatgcatccaatgttatgtttagattattctaggtagttcgcatgatgtcatattagtatcttctaattaaaaacatggtttcagttaattaatcttattcttcagtggtgctttatgtacaaccacattttattaattttactaagtttgttatccatgtcagctaaaagtgctttacctgcttgcatttgtagatgttcctcataggcatcagagttaacatcaaaaggaaagccatgttggttgtgacctccataaatttgcagaatttcatccatggcatcggcaccgtctacaataacaattaccatgtgagtaccaagtctaatatcaatattttgttaggtacaatactattgcagctattttattacattctacaataaaataattatgggccattatactcagatagctcacacattgcattattacaaccaatcattagtgctgatacttgctatttgacatgccatgcatattggcctaactggatatgtgtgactaaaagtaataatgcttatactactcttccaatgtagccaaatacttctatgaataactgatctgttatgctatatatataatggaaccaatgattaatataggttactttgtgcagtacaacatcagcaaaggagattatcatatctgaaaaccacaatcaaggtaccaattttatatccatctcaaatttagttttgttgtctacctattttgttattgtactcttcaccttgtttttcaatagaggtccatgtcagctgtaaataaactcatggaagtgctcatgtttctttt

SEQ ID NO: 261 - DNA, 1501 bp, Oryza sativa
tgaaagattccatgacatctgctttatcaagttgagatctctcctcaggaaatggaaaatgatgggctgtagaaacgataaaagtagatcactgatcgccgcgacaaagatacagaaaggtcgtattcagcaaccaaacttgtcttctgtagtggaactggtcatcaaataatttatgtctgatctatcaaaaataaggaaagaattaggtgccctagtgacaaaaacagcacacattctttgctttgcttaacttttaattattcaggtgaaaaagaggagcatgttctgaccagggaataccattctgagccttgtcaagttaatttgtcaaagactagtaaattaggtgtccttacaaagaaaagaaaaaagaggacatgttagcatgaaccgtgaagtagacttgttagattattaccacctaaaagtctaagaaatcaatcaagtaactcgatcgaattctgctcctgatcttgctggcattatcgatggaccagttattttttttctctcaggattctagaaaacatcactgcaaaaatgaaaggaatatctcaaactagtaccacacctgaagtccttttcattaaaacataatctcttaagaccctatgattagtacaacgatgtttttaatatctccatcaactttaaataacttataatatatcgttgtacatgtgccattgtctcttcagtttaaaaattaaaatatgcacttgatgaaaagtactattagttttctctacagggggttatgcactaaagttctaaacagtccatgctcatatttacttacacccaaacaatgaacttgagtaaaatgcaagaactaacttatcatcataagttgaaagaataaacataatgatacagttagttataccccacgggatgcatctcatcagtcagtcagtcatgacaaccaaatctttgaaaagttaaccaagtacaccggattaaatggatttgcaaagtactgaagtactcttgaatctccatgcttgagtaaggaaatatggggctcaattttgaccttatgaagtactagtagcaacaacattagggcctactggctggtggataacgtggaatttggctccaccaatcaaatcattacagaaatattaggacaaagctggggcacacctcactttaaggttcatcaactctggtgtcttctaatgctatcctctggcgattagaatgtttgttattatcaaagccattgcccatgaagagcaatcaaggatcagatgtacacgaatggtttgagtcgccatcactggaataataattcagctcatcatactaatttattttttcagcaaatgacatgtacagtagtgttggatagaagctgagaaggatgtgaaggtgcagggtcccccacgagagctgtttatgctttgatgtggcgatccaacaacatacagtggttgttgcaaattggctggcgtccattgcaatattgcattgcattgcaatgcgacgtatg

SEQ ID NO: 262 - DNA, 1501 bp, Oryza sativa
aaaattcagagatatagaagggattagctaaaattgtaggggtatataagggattttctctagagattatggtgagacctatacattacagctccatgcatgcatattcaagatttaattaaatcaccaagtcctacaacaaaaagaatgcagatttgataaccaaaattcaaagggcggtgtgacgcgcacgcaccaccgcgcatgtaaaaaggaaaaaaagaaaaaaagaatcaattgttatttgatcccccggccggccttccccttattttgttcttttcttttctagtgttactttcaaacccaattcttgtgtgggtattacctgaactgcagggcataaacaacctaacctgatcatacatgtaatgatgtaacgccgtccttgcagcgagatctcctttttgtcaagatgcatttcccagttcttagatgcatattgggtggtatcgttggatttacgaggaactctacagtttgttcactttgatgttattttcaactttactaaattttggtaaagttatcaaaaaaaaaatagctacatttagtttactgctaaattttggtaactagagcatataagaaatcctgccaaaattttgacaagttgcttaaattttagtaagtttttttttttgacatcaaatgaacgaagtcctacatttggttttggtggccacgacgagttgaggatgcaagcgccaagcggggatgccggtcagccacacgtgacacgtacgtccggcaactatagctgccgtgaacagaccgggccggcgacatgacgtacgtagccgctgcctgccctgggcctaggccggttgtgcaaccgcctgggcccaggccggaagggggcccaggcggcagcccacatcatagcgcagcgcccaggccggggagcgccgagcgcgcgtcgcttcgtcgtctactcgtctcgtcgccgaaccccaagtcgcgaatgccctagttccttacgcgccgagcgacggagcgagacgccatcagccaagctgccggtgcctgcagccctgcctgtgcggctgtgtttcctggatcctgaaggtacgtaggtcacagtctcacagaagtgcctctatcgatttcaattcattgttgaattatagtttcaattatttataaggtatttataccactttatttctactatggcctttttagttgtaattatattatcgtttattatttatagagaataaattattatattgcaacctacaaattgctttatttattatctatcatactataaatgtttaatttgtgtcactatatggtatatgtgcttaatatatatatatatatatatatatatatatatatatataacttcttaaggctttatagtgtaagttaattactggctctgtacgccgcttgcaagctccgccgtttgtgtgtaatggggtttcccaaatcgccggggccagagttaccgcgccccggcagtaagcacggttaccgcgcggtaaccgcg

SEQ ID NO: 263 - DNA, 1501 bp, Oryza sativa
taagtgcaacgaaattgattgctaatcttcggtgtccagcagagccctgacgcgcaaaaatacaaaaaacaaggtgttatcttgagttaatttgccagtgcgtcatctgctatgctatgtaaaattgtcctgtatcttcgcaaatctcaaagatattattaccggtgtgcttcctttgaaaattatgtctattcagaaacgccaatatccttgcctaatcttcaaaggtgttcatagagatagcatatgcatttatagaaggtgagtatacacgtatgtatatgagcgtctgcacgtataccgaaatctgcaaaaataaagaaagagaaagaaatctgaatacgaccactacttgtgcacaaacggaatgcgcacttacatcaataataatgtataaaaacagaggaaatatctgaaatgaaaaaaaataatgaataagtgtatcaaaattgactcgtatggtggccagcttgaggccctgacgcacaaaaatacaaaaaaaacagaggtgtcatcttcagttaatgctgatgatggtgattagcaacccaaaaaacccatctctgcgctgcacttcctttcgttccccccctccgctataaattacaaaacttcaggggctccacttcgctgcctctcctcctcctcctcacctgcacctgcaccaacgcgagagatcatggcgaagagatcgtctcctgatcctgcatcatcttctccatctgcatcatcctcgccgtcgtctccttcctcctcttcctccgaggattcctcttcgcccatgtcgatgccctgcaagaggagggcgaggccgaggacggagaagagcaccggcaaggccaagaggcccaagaaggagagcaaggaggtggctgatccttcttccaatggcggcggcggcggcaagaggagttctatctacaggggagtcaccaggtatgcgtccctgcatgttcagttgcttccatccctctgatcccaattctgctgttctttctgatcccctctcgatttcagtcgcgaattcatcctgcattgccgctagttaatcaatggctgatttccagcccaaaattccgcatcatttccatcctttcaggctcccaaaattaccagccgcttctttccaatctgttcctgaatattttcacttgcatgtcagagatcatcagttattttatcgttttgtgggtggcgagtctgctccccttttcatgcctcatcttttggaggttggcgagcatgatcgatcggatccatttcttgatctcataattcccatttttaatcttttttcttgctgctcctccccttggagtgagtcaattattattagctgggaagtagggagttggttgatctacatttactgctggggtggtcaactccttcagtttttcttcctcctgtaaagcaaacactaatgcttgaatgctgcttatttatcaatcattaataaattcaatatacggtggaatcatttgctgcatgcatgtgtcta

SEQ ID NO: 264 - DNA, 1501 bp, Oryza sativa
tctcataaatgaataaacggagaaatagaaaaaaagtctggattctaatagtaatgcaagtgcaaagcaagtgatcgaaaacacaggaaaagcatagaaataaccgttgattggacagctagaaaaatacaggaattggatgagagagatagactcaaagaaaaatttccaagagattatccatttcataggaatttaaaaggatatgataggatatgatttaatattttgtttcaaaagcattcataggaaatttttctatatggttgaaatcctccaaagttcttatgtttttcctccaaattaaaaggaccctaagcatttttagtatttaaaatttgtaccacaatatactttctttattttagaatataagtatttctactatttaaatttcatatacaatataagcatttccaggtactacttcagaattcagatacacggaaagctaagtatttttagtcacttaggtaattaggaaggggggctaagcaattcacaaaatcaaccaatgagacaactgagagggaatatttatcctttagcttactctttactaaataaactaaaaatatgtgtcctttgcagtaagtttaataatataatcaactattagcttcaaaaattgaaacatcatctaccaactcatatactacataattgtaatatatattacatcaataatacataatccatccatctccgtcacatagtttattgaagccagtcgtgtagttggctacaaatctagtccgcttttcttttttcttctgtcctcccttcttcacgtaagtacaaatctgatgtggcaacttttacatcccgcttacgtcactatgtaccaatgcataaaaattcatgcattttcaaccaatcaaatgcttgggaggagaatctaaataatttaatattttaccactactttaatggaaaggaaatctttttacttaacctttataagattttctaaacaacctaaaaatactcatattttaggacgtagggagtactattctctctctttttttaatgtctgatgtcgttgatttttgacatgacgtttgaccattcttattattaaaaaaattatgtaaatatttgttatgatttgttttgtcaccaaagaaatcttaacttctaattttacatatttacactaaaacttttaatatagtcaaacgttatacgaaaaagcaacggtggcatacataaaaaaagagtactaactatcaatagaaaaaaagatagtgaaattatttaatagtaccagagtatgaacaggatatcgtgagatttatctttataaaagaaaaaaaataaaaagaataccgtcagatgaccgtttcccgcgtgtttgtctgtttgttctcttctcacgcgttctacgctacgcgggcagcatatatatccggcaagcaagcgaccactcccactcgcacgccacgccactcggtcactcttcatttcgtcgaacaccttgcctcacaaccacccccca

SEQ ID NO: 265 - DNA, 1501 bp, Oryza sativa
atatcactatgctcctctatgacccgtttgccgcctactctttattgtcattgtgattctaaaaatcgaacataactatcgttgaaattcattttttattttctagaagacccgtcaaccatcggcggctctgcaactatactctatacaccccgctcgctccttcttctttttattgtcgttgattatcaatggttttttttaactttatagaagtcccggcaactgcctgcttgtttgtttgacggcctgcctgtcgtccctccttttaattgtcattaggattctatttggtgttttattaacagtttttatatatcgtatcaaccgccaccactctactcctttataagcatgttacttaatttatttggtcatgtgttttagatggtcttttctctcaatagtcgttatttttatcccaaatgagttatttataaattatattcctaattgaaatcttatttttctttttataatttcagaatttttttccaaattttaattaataccgtatcgtgttcttttaatatttttattttttatttttaatttcagttgtttcaaaattttattcctacttgaactctcttttaattttctctaattttgaatattattttattttttattctgaattttaattaatctcgtattggattcttatatgaattcttctttcaatattgcttattttcaattccgaattgtagctaattttaaattgtattcctacttgaactcttcttttttttttctaatttcggactttatttttatttttactccgaattttgattacgtattggattcttatatggactcttcttttaatattttttatttttaattccgaatttcagctatcttaaaattgtattcctacttggactatcattttatttttctaattttagatttattttatttttattttgaattttgattaatctcgtattgggttcttgtatggaaacttctttcaatattgcttatttttaatttcgaatttcagctatttttaaattgtatttctacttgaactctcattttcttttctaattttagattttactttatttttattctgaattttgattaatctcgtattgtgttcttatatagactcttcttttaatatttcttatttttaattccgaatttcagctattttaaaattatattcctacctggattatccttttcttttctaattttggattttattttatttttatttcgaattttgattattctcgtattgggtacttatatggaaacttctttcaatattaattatttttaattccgaatttcatctatttttatattgtatttctacttggactctccttttcttttttttcctttttctccgattaatgtgagaatttttatcccccacagcaaacgtggtgcctcttttaaagctgttttaataatataatataatagatagatagataaatgtaggtgggccaagagcccaacaaggaagccg

SEQ ID NO: 266 - DNA, 1501 bp, Oryza sativa
tttcaatttttgaagctaatagttgattatattattaaacttactgcaaaggacacatatttttagtttatttagtaaagagtaagctaaaggataaatattccctctcagttgtctcattggttgattttgtgaattgcttagccccccttcctaattacctaagtgactaaaaatacttagctttccgtgtatctgaattctgaagtagtacctggaaatgcttatattgtatatgaaatttaaatagtagaaatacttatattctaaaataaagaaagtatattgtggtacaaattttaaatactaaaaatgcttagggtccttttaatttggaggaaaaacataagaactttggaggatttcaaccatatagaaaaatttcctatgaatgcttttgaaacaaaatattaaatcatatcctatcatatccttttaaattcctatgaaatggataatctcttggaaatttttctttgagtctatctctctcatccaattcctgtatttttctagctgtccaatcaacggttatttctatgcttttcctgtgttttcgatcacttgctttgcacttgcattactattagaatccagactttttttctatttctccgtttattcatttatgagattcaaaggtggagtagtattattttaagacaaggtgctactttatttacttatgtcctgcaggagttggtgtgataatttgatcaaggaaatgaatagcgtgggttcgatgatgaatgtgaatgaaagagtcaaatattatgggggtttactacggaattaggtacaagctactccgtagattgtaatcatctgaaagagaacgttccgttctagcactgatttttctcaaggtgcctcatactgtacctaatttttatatgatcctgtctgaatgtgcttgttatcttgcacttctctgcgtaagatgagatgtttatctattctagtattctactatatccaacttaagatatccgcatattcgaggaagtaattatttttcttatatgcattgctagtctaaacaatcatgtgttgtacatgtgtgaaaactgaagctttttgtgtctgtgaagaatacttccatagtaatcaattatttcctactatgtaatatactagtagttcaaaactatccacatgtgtttgcacaaaactacattaaaaaaaactcgatcttggggaaagaaaaaatagtcccttgggggacggagattaaaactcccaaccccttggcatcctttgaattgaagcttaaaaaaaatggtccatgggttggagattaaaactcattgtaacatatgaatagtgcatactttctcaagtagtttaatgtttagcacaaacttcagccacactttaaaaattttggcaatctattttacaccagaataagtttatataatccaataagtttataatattatgagacaaatctacgtatatcattttgaaaactaagcatttgacaaattattgatgtcta

SEQ ID NO: 267 - DNA, 1501 bp, Oryza sativa
aaacaataatcaaggcatggcataatcacaagtgggatgttcatcattgcatgcaattctatttgtaaacaaaacaatttcgcaattgggatcaacatgttcaaggaatagtgatgacttgccttgctcaaagtcttgcgggtcttggccttcgcttggatccgcaactccctcgggctctatagttacgtgcaaaaattgatttgaattcggttagaattcaaataaaaatccaaataaatccaaatgaaagtcgaatgcgaaagtcgattcctttttattaactttactatctgcaaactacggcaaacccaatttcgatttaaactactttgcgggtataattatttcgttgtcaataatttactttccccgagcattgtatataataggttagaaatttctattacgagttaaatattggacgaaatcctagaaatattatacaatttaatttagtctatgactaaacgattaatataatatacgtctaaaattcctagcgattacatccgaatttctaccatgaatcgattacttatagggattacccaaaataatctataataattaccgcgaattgatctaaattattaccgcgaattgatctcctatagacattactaaaaataatctataataatctattaagattcatctaattgttttaattcgtaaataattaattctataatcaaatcttagtacttttggtattttaaatagtaggagttcatctaacgatattcttattaatcctataattaatttctaatatgttaaatattctaaatctcttaaattttcttttcctttttctcttttctctcttttccttttcttttctttcctcctcctttttcttttcttttctcttttctctttttctctttttcctttctttcctccctcccggcttcctccttccttcctctccttttcctccctcggcctctctctttctctctcggctcggcgacaaaagaaagagggggggggggcagcggctcaccgacggcggcgacggcgacggcggcggcggcgacgacggcgcacggtgcggcacactggggcggcggcacgggggcatgaacgcggcggcacgacagcacgagggcggcggcgcggcggcacgatggcggcggtgcgataacggcggtgcggtggcgcggcggcgtggaggcggcggcgcggtagtgtgggtagaggagaggggtggagatggaggggaagagggggaaatagtgaggcttatataggggaggggaagagctaagggggggggggggaagggagaagagagacgcgacggcgatacggggcgcgaggtgggggcacgcggcgcgaggcgacgcgacggttgcggcgacgcgacggcgggcggcacgaggcgcgagacgacggcgacctgcggcggtggcgacggcgacattggtgcggcgcggcagaggcgaggggacggcgatgggaacggctcggcagcggcggcgcgcggctcgga

SEQ ID NO: 268 - DNA, 1501 bp, Oryza sativa
taatagaacactgataccaagaagctacaactactcttctggaagccgatcttaggatgggtgaccgattaagcgtactgggcctggagcaattttaggatgggtgaccgatcgggaagtgaacttcgtgcacatgagcaaggacaaaaaaaaaaaaggattagcatgagtggggcgggatggcatggcaaggctagctagaaataaaatttatattttttaggattatactcatcagtgacgggcattaacttaggcccgattgggatgactcatctgttaacttaggcccgattgagatttatactcatcagtgacgggcattaacttaggcccgattgggatgactcatctgttaaacttaggcccgattgggatgactcatctgttaacttaggcccgattgagatttatactcatcagtgacgggcattaacttaggcccgattgggatgactcatctgttaacttaggcccgattgagatgactcatctgtgacagggctatagttaatgctcgtcacagataagggtcatctgtgatgggctatagtttaggcccgattgagataggtcatccatgacgggctatagtttgacatgttgtctgggtcaaagctatcagtaatgggctttaattagggcccgattaagataggttcatccgtgacggccgtttgcccgattgagataacttttcacatcagtgacttttagcctgtgacggacaccgtgcccgattgagataggggttgccgcccgattgagatgatggtatccgttctagtgagaatttagtgatctgatggggcgaggctggggctgaagaggtgcttgaacgcggaggaggaggcggccaagaagatgaagaagaggacggtgatggtgaaggtgaaggagaggatgacgacgaaaaaggtggagcagctgctgtcgttcgtgccgaggacgtttcctcgagatcgaaagccacgatccgatgaccccgagatcaaccagttcgaggacatatatactcgccaacaccgtgctgctcctcaactccaacacccaaatcatcctccaggaccaggccagggcccgcgaggagctccgcaccaagggctccgtcgactgctgggtcaccaaatacgccgccgccgacgacgacatgctggcctcaacagcctagctaggccctgctctgcgtgcctcaattcaagcatcagcatctctcctaactgtattaatataatgtagatgagcatgacattacgatgatatttgcttcttaattcggtggtgtggaaacagattttattactgattagtagcatctgtattatatctgtaaacagattttattacgacgacgacgaccaaaaatacgtactagtattacacttgccatagcccatatattgcggtgcgtccgatccgattaagagaccgaacgccgatccggccgggtgatgcaattggactcgatcgaatcctacttgttttgcctcgcccaggtaaa

SEQ ID NO: 269 - DNA, 1501 bp, Oryza sativa
cctctacgtgttcttgtcctccaaagtcgcagccgaccatccaatctccggcgaggtcgccatcttggttcggccattgatgaggtcatcatcatgacgtcatcatcgtttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggtaacaaattgattagcttgaaccttatatattggtttggttcagctaaatgctatgtatatataattgcttagccatgcttagaaacattatcacataattgggataactaatgttacactatcacttatgattatatttaatggtagctcacgatgtttaatcgtgttatgataattaattgataactaaaacttgacaatggtgggttgtgagcacatggttttgaaggtcgtgctcatgacaattaaggaccggttcacgagctactgttgtgaaatattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaa

SEQ ID NO: 270 - DNA, 1501 bp, Oryza sativa
ctttgtctggttcaagatgttgacaacatgatcagcttggttgagtgcgtcttccttgaggagggtgttgaggagagtgattgctgcaaccgtgttctgctggggggtgcgaaagaccgctgtcccatcgacgtcttgttgcccaatgagctctctcgctcgccgcccagattctaaggcgcgttgtcgtcgatcttcagcctcctttgcaatccgttcgcgatcttgttgctcacgctgtagtcgttctcgctcctgtcgctgtcgctcttcctctagtcggcgacgttcagcttcttgccgtgcacgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgaggggttggagtatgtcacatcctgaatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattgtaatttttttaagtactttgagtgtccaagtattttgaggatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgagccgcctcctctcctctcagcctagccggaaaagtctactttccctccctgagctactgttcatcttccaactcaggcagagcccgagccagccgtgccgtgcacagtgccgccgcctcttccttccaaatctcgcctccccgttgctctttttccaatttagttgaggggaaatattcctcttatcctcctctatctttaccccaaaaatcggagctaatcgttgagtatcttatccgaatcgagctcgttttcgagtttatctccaaaaccgagtttttgatttcccggatcgatttcttgcgggaggagtccgatctcttcaatccaaggctataaataggaccccctagtcctcctctttcgtttgccccctcccccgtggtctcccgtgcctcgtagcgccgccgccacgtgctccaccccgccgtcgtcgccggccgagctccatccgcgtcgcg

SEQ ID NO: 271 - DNA, 1501 bp, Oryza sativa
ctttctaccagattgatgtgtaggattttgatgatatggataaggctgaaatatggggcatcataggcctatcatgtgacttcaactaggatagagttcaacgactttactgttgtgtctaagggtgtaagtgggtcagccgtgaatctatttataggtcaagataaacggactcgtggtttattttagtcgataagtgagtttcgcgggtttgtcacttacacttctaattgtgtcacgtagataaattgttgatagtggcgaaacaaaaaacacaaactttatttgatggagaggatccacgatacttatctttttaaatcttacaaaaactacaacaaatgtagtgtagttttaggggcttaggggaggcgatcgagacccctgctcaccccctccctatcttctccacggatagttgatgtatcacttgagttaatatgaagagaatacatgcgaaatatgcaaagatttaactcggatgctacagataagacataagacatgatataagagagttactacctccatcccaaaataataacatttgaccgtccgtcttatttgaaaagtttataaaaaaataaaaaaaatagtgacacataaaatattttttttcatgttttatcatctactaataacaataaaaatactaatcataaaaaaatttcaaataaaacaaacggtcaaacgttggacataaataatataaaattacatttattttagtaaaattatatttattttaggacgaaaggaatagcagttagtgttgccgtgtgcactctagtttttaagatgccgtggatgatatagacactactgatagtatgtttcgatggagaaattattatatgcttttcattatcctttttgtctttttttttgcggggattatcctttttgtctttaatgtctagctagtagcattggtatctttctttacacgcacttatttttttggaagcgtatttatttccagtaaaacactatgataagattaagcacatcttggcccgtttctttacaacacatatgttcctcttgcttatgggtcccacatgtaagtgagagggagtaggtgcgagtaagggaaatgttccaaaccaaggttggtggttggtggtgggtggtggcgtgcgtgctttcaggacaggaagacgggcttggtcagaagactagggacagagagcatgcacgccgcacacgtttgttttttgcttatacattaacaatgcacaaacttgatcatgttcttgagacgacgacgacgaaatttcgtttatgcagcatcattcaccagcttgttgatgaaaaataaatagaagatgggcataggcacagggaataataagaagagccatgtgatctaagagagataaaacaaaggaaaaccatgcagtaatatctgattacttgtcatataacaaaatgacagggtgagtacctatcaggatagcatatatagattgatagaaaggtccaaaaggaaggcagcagg

SEQ ID NO: 272 - DNA, 1501 bp, Oryza sativa
acccaccccacccatccttccatccatcggatctaggaggccaggaccagatgccgcggaacgcgcgtacacgtacctcgcggtcgctgcgggagagggctaagcctctcctcctccctcgtcgtcggtggcggcggcagcggcggcggcgcgggagcctcggcacccagttctgcggcggggggaaaccctaaaccggccgcgcccctgagggctgaggctgaggtctccgcgagaggaatctggggcggcggcggcggcggcgggggatggtggggtggaggtaagcaggggaaaggccctggataaagtagagagcggggataggggaagcgacgccacacgaggagggaggaggaaggagggagccttctatgtggagcggttttgcgccccgatccgggtaacaaacggtcatagacttaccttcaacttcaatatcaaaaatcaaaagagagacgctacaaaacggaatgctgttcgaacgggacaacattaatatggtagttacgattcggtccctgcgatttacggtgatatgtcctaaatatcccagatccaaaaatcaaggtgcaaaaccaggttcctcctcggcatcgcgcgcgatacctcgtcggcgtcggcgacaccagatcctcgtcggcgacggctggcaacctcattggcgacacccagatcctcgtcggcatcgcgcgcggagcgcgtgatacctcgtcggtgtcggtgacacccagatcttcgtcggccacggcccgcaacatcgtcggcgacacccagatcttcctcggcatcgcgtgcacgatacctcgtcggcgacacccagatcctcctcggtatcgcgcgccaccgcacgcgatacctcgtcggcgacggccggcaacctcgtcgacgacaccaaaaacatcctcggcatcgcgcactaccacgcgcgatacctcgtcggcgacgccaactatatcctcggcttgcacgggcaatacctcatcggcgctgaccacaaccagaacactcctcggcgttgataggtattttcatctaaacttgatacctaatactagatgttttgaaacttgatacctagtactagatgttttgaaacttgatacttgatactagatgttttaaaactggataccttatactagatagatgttttaaaacttgatacctgatacttctgtaagtagaaatgctaaatttgtatcaaaattggtgaaaaaagaaaactggtaatattgtccatggtaatcttacacttatgttttgtgctcatttatcaatgtttgtgctcttgcaaaaaggctgataattattttttagtaatctggtacttctgattgtagaactgaaaaaagtttgatgaaaattggtactaacctgataatggtatgtttgtctaatttgagccgtacagaatttaatgtttttttttgttttgcactatcaaaatgtgaagggggagtggaaaaaagtatgagttcgtcagttagttctattgaaa

SEQ ID NO: 273 - DNA, 1501 bp, Oryza sativa
cggccggggcggcggcgcggcggcgacggtaaagcacatcctcaaggcgcagaagtcgaccaaccagctcaagatgatggtggccaacctgctgccgccggcgccggcaccggtgatggtgaaaggcggcggagcggggagctctgcaggcgtcatggaggtggaggtggaggtgatcctgtcggacatcgccgactcgctgccgctagaggcacctggaccgctacttatataggggaaggggtccgtattacaaaatactgtccatatccctaacagaatatatagttacagataaaatacaatcgtaactgactaggatctcaaatatttccttgatacacaagtttagaatttaacccgagtcttcctaaagatattctatctatacatggcaccccatacccagtcggactatacatgccgtgtagatatggggtatccataatctccacagtagcccctgagacctttgcagtcgacgaaataaccttttctcttagcgtaaaatgataatccgagtgcttcaatttcttctgcatcgatctcccgagtaccaaaatcaaagactgcgaagggctgaaaaatataaataaccaggtgcatcggctagatgcacctaattaggtgtagcccccgaatatgtgattagttaaaaactaaacatatagttaaggaacaaatatcatccaatccgagtagttatgtagctcagcagatatgacgttcagcaaaacatccaaccgactgctttagctttaatataccaagaaagaagatataaagaaacctgagtgaaaaacacttcaaaaggtctacaaatgaccatatttgataagaatccgagtaaaaactcttaagatgatccaccaaatatgatagaaatcatggcaattaatgagtctaaatagcctaggctatgacccacgccataataaaaaataagcatataacatgccgagagaatgaccattaaaaaaccagtcatctcaaccaaacccaaacagcttttgcagcttaaaaaagcttacaaaagtagtataatacctttctgtagggtacctttttatttgcatcgtagtaattccaaggaattatctaactacatcaaaaaggaatttaacagcatcgggccatattgtggtgagcaaaaattgccgaaacaaaaaatgcctaagtccctacggatcaccacttagccacgccgattagcaaaattgggctgaagtactattttaggcccaggcccattagtacttccgataccctaataacaccaaagagaaacagaatgtctcttcgtcttcctcaccgagactctcgccactttccccatttcccgctacagtgcaaaggctgctccggcgaaactagggttaaccgattcgctcaaatccaccttccaaaattccacagaaatcatccgtgcacccaccgcatcaatctccccttcattctcaaccgcatttcagaccaaatctcgccatctagttcgcatcca

SEQ ID NO: 274 - DNA, 1501 bp, Oryza sativa
tgtattctcttgttaccttgtggattagaaatggtcttcacaaaagtggcccaagaagggtatatgccaacagcaagatagtaacccatggtgtatttatttccattcaccataaactccaactctggagctgtccctaatgtaagcctttgaaagagtggtgatctctgtagtacaatgatatcattaagagaacctggtagtccaaagaaggaatgccaaatccacaaatctttagatgcaacagcttcaagaatcatggttggcccatccacatgccctgagtattgtcctttccagcctgttggtcaattcttccacctccaatgcatacagtcaatacaacctagcatccctgggaacccccttggagtgtttatagccatcaaccttgtagtgtcctcagcagttggtgctctcaagtattgatcagcaaacacatccaccacagccttgacaaagtgcttgaaagcttctatcatggtgctctctgaaatcctcacgacttcatcaagactatcggctggaatatcatatgcaagcatgcgaattgcaccatacaccttctgcaatgcagtggcaccgagaagacccactgcatttggtctctgcctgaagtagtcatcatgagcctccacactagccacgatgcgcaagaagagctcccttgacattctgaacctcctcctaaataattttgcactatatacaggaggatctgcaaaataatcagccactatgcgtaaattgccagcaaacctgtccctattaattatctcacgacctgggactgaaccacgatgctttcttttggtcctcttatgctctatgtctgtaagaagagcagctgcaatgtagtagtcatcatcgtcagacaactcctcctgatcccaccaatcggtaatgagatcatcgtcgtcgtagaagtccatgtaaaaaacactgccatcacaagatcataaaattaataagaaaatttagagcatatgcacacatccaactacacatacacggtacagagtataccccatatacagtatgcaacattcaatctatgaaaagcagtggaatcgtactagtacagtaccacttactcctgtatatatatatatggttctaatcgatccattgcaacaattgtacagtgctactaagtataaatacagtgatatattcaccgtgtttagatccagtttttcttcaaacttccaacttttctatcacatcaaaactttcttacacatataaacttctaactttttcatcacatcgtttcaatttcaactaaacttctaattttagtgtgaactaaacacaaccattactagctgagaatttagatttttcttgccgacaaagtccactacaattctccaaaaaaaatattaaaaacaagtcagtctccaccagaaccatctaccaccacatgtccacaggtgtcaagaacagagttattcagaaaattgattagtactctaccactgaacccccgcaccacatg

SEQ ID NO: 275 - DNA, 1452 bp, Oryza sativa
tgaaactgtttggctacgctctagctccaggagaggtggagctggagctgtgtcaaatagacccttaactcctgaagctaaatttaggagttagaactttaccaaatgggtcctaattaagatcgagtggttatgtacttgacttgctattcgacattatttataaaatatatgctatacaatacttcctctgtctcataatataaggcactttaggtggatttagtatatcctagtagaataaatctagataaacaattcatttatattagaacgtatattattggacgaagagaataacataccaggcttcggagtgtcagaacttagacgcgcgcttatcctcttgcgttttttgaccgtagaaaacatttgacgcgtgtgctcatgaaaattgatacaaatggtctgccgttgtacacgtcgactcagctgaaatttgataaacacgtaagaattaaattactagtaaaaaattgccacgtagctttcagctggtgcataagatggtccgcgcggcggatccaccttccgggcaaggtcaggcggccgccgcctggcttcaccgttcctgtcacctctatgatcaatagctatcgacatccataaaaattaatcgatcattcaaaaataatactccctcctgttttttatatgacactggttagtttaaacattaactagtcagcgtcctacaaattaaaaaatagaggtagcattagtcctctgagcttgatggtgataccagcttcatcacagaagaccgtaattctaacattaataacattcaaagcaaataaacaaaccatataagaattagacaatacattaatggcacacatttttttacacatagatttataggtatgactgactaaagaacaggtcccatgtactcaacagctaaggatttttagccgctaatagaccaatgagtacaaaaattagataatatgtgactagtaatagagtaaaatctgtcgggtatcagttcatatcgcccattaccatctctatatgttacggtatatcttcactgatttaaaagggtatcactcggattagtactatatatgttttaaatttttttctctaattaattagttcaagattaattaagtttatataaaaatttaaccacacgcttataacaccaaattagttttaaaggatcttgttttgtattgaatacgtctactatttttttttataaacttgattaaattaaatttaagaagttagctaggaaaagtcaatgtataatagggagtaattaacaaagacaaaagtgagtctgacagtatcgaaaaggaataaagtgcaagatacattgattatcctaatagttaccctctgtactagcgcacactcgccaccatcgatcgaccagcatcaaaaaccattggcacgagaaggagagaaacacttgactttattcccctcattttgaca

SEQ ID NO: 276 - DNA, 1501 bp, Oryza sativa
ggcttttttctggttcatttctaatatgttaattgaatcttgaacaatttagattttgggggcaacagaatcctaagagcatctccagcagggacctcaaatccagcccctattcaatttttgagtgttaagataaaaaaactagatccagcagggaccctactacagcccccaaagtgaggaggccctcaaatcctccccccaaggccccagtcctgggggactccggagcacgcccccatcgtcattttttttggcgcggatataattttgcttcgcgcattttcttgttattcccgcacggctgcgatgacagatcttctccggcgagtactgacgaattcccagcacctccatcaagactgccctagaaaggtaagacttttccatacctttcttgcccaccgttctcaaggccttcggcggcagtccatgcgcatgcccggccgccgatctcccgccatctgcctggccacacgccggccgtcgcgtgccctccgaggctgcccgcacacacgtcgtccacctgcacgccgtctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatattttttttggagaattgtagtggactttgtcggcaagaaaaatctaaattctcagctagtaatggttgtgtttagttcacactaaaattagaagtttagttgaaattgaaacgatgtgatgaaaaagttagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgatcttgtgatggcagtgttttttacatggacttctacgacgacgatgatctcattaccgattggtgggatcaggaggagttgtctgacgatgatgactactacattgcagctgctcttcttacagacatagagcataagaggaccaaaagaaagcatcgtggttcagtcccaggtcgtgagataattaatagggacaggtttgctggcaatttacgcatagtggctgattattttgcagatcctcctgtatatagtgcaaaattatttaggaggaggttcagaatgtcaagggagctcttcttgcgcatcgtggctagtgtggaggctcatgatgactacttcaggcagagaccaaatgcag

SEQ ID NO: 277 - DNA, 1501 bp, Oryza sativa
catcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctaatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaa

SEQ ID NO: 278 - DNA, 1501 bp, Oryza sativa
ataaatttatgtcatgataactgcacataaggtgtagtttagacatgcaaaactttagtatacaaatagattgccatttttgtttgctttattattttaacaccctgattttatctaaatgtatttatagttacatggatcatatttttgtgtgctcagtgttttttttattactttagtgtaattgattgagttcaataaaagctttctaggtttctgaactgttacaatatatttttctggtctctgaacttatcatgagtgttatataggaccaaacgggctccaagccattctatacgctaacgcacacagacagtaatatctatcaaatgtgaacttctattttttttcccattagaggggatgccgtcatatatatttttagctctaaaatacaatacaaatagtattgaaaatctgtaaaaatttatagatagtattaacatctaccactcgaaaaaaataaagtctaagaagggccaatctacaacatcagaacctaaaagataagcgaacttttaccattcttgagaaggtaccaccactccacccggtgctagataccaagaagtaccttttagggcattggcaccgaatgcggtgatgagctggcataaggccagatttgaggcgtctcaattcattcttgatttgcagccgcggcgaggtacacttgaggctgtggtggataaaccgatagaagcaagggtatatgcgaaagttcaattttaccctctcacccacaacacctcctctctcgggagagcagtaccacccggtacaaagcaattctagctcttagattgtacgagatggatggtctagattagtaccatctccactcaaggatgataaaaactctcaaaagataaatacattacatgtacttggtcgtatcattttcatttctcaatgtgcgcattgatttaatttaggcttccatttttagatagtagatacgtactccctccgttttttaatagatgacgccgttgacttttgaacatatatttgaccattcgttttattaaaaaattatatacaaatgtataagatataaattatgcttaaagtactttgagtgataaaacaactcacaacaaaataaattataattatgggtttttttaataaaacgaatggtcaaacgtgtgaaaaaaaagtatattgtatcgatgatcaattttgaaaaaaagaagattgtaactatatatttagatctacttttagaaaatgaaagaacgaattaaccacgtagtgtggtccattaatctgcaccatctaggcatctattggtcctctccagtctccaggactcagctaggaaggaaagaacagagccagatacccagcaaacaggaggcaacaaaacaatttgctggagtacgagtcattcggccacaagcccacaacatgacgctagggccactaattcaccccgtgaccgtcctagagcaatgccatgtctcgccatctccggcgccggcggccggccagc

SEQ ID NO: 279 - DNA, 1501 bp, Oryza sativa
taaacaatttcataaaaaaaatccttattcaatcttggagatttcgtaataaaatttttatacaagcacaaaaaaatatattggcaaataaaaattgcatttgtcatcttttgttaaacaaataagtattattgattatagttaagatttatttagttcctaaatactctaatagtaaactaagaattgtgctataatttgttgaactaatttcataattgtaaaaatctaaaatagttttggagcccttgtgtatatatgatttttaaattttgaaaggcttataattgtccaagatattcaaatcctagataaaatttttccaatttgaaataaaatataattttatgattaagtacagttttatttaattccgaataatattatgtttggtcctatattgttattatcattattatatttttttatatttgtactaaatacttttcctaggtaaccagtgaaaattataattattatttttaagccatttacaatctatacaaaataaaaatatttttatgaacagaacaaaatctggtccaatgaaaataaataataattttggcggccgacgatggcaggcaggcggccagcggcggcggggccgtgcccggcggggtgagcggcggcaggcgctcatggctgtggctggcggcagcgtgccggccatggctagcggcggcggagggaggcggcggcctgcgcgcgggagcgggcggcggccccgcgcggcggtggaggtggcgcggatgggaggcggccgcaggcggcgtacacagaggagaggtggcaagcggcgggcaatccggaggcgatgactttgtgatgattctgggatgattttggagataattctgtgatgtaaatttgtgagtgatttttagatgtttttgtgaatttgtggttgattttgtgatgtaaatttatggatgatttttagatgtttctatgaagttgcaaatgaatctgtgatgttgaatgattttgtctgtggatgaatttgttgttgagttcggtgcgaaatcaatatgaaagaagcaaaaaaaaataaaaaaagaaaagagaaagagaaagctccatgtggtgcttttatttttactcccggttggtgactccaacagggactaaggattcatctttagtactaggtattttaaccgggactaaagatgacgatctttattcccagattctttctcacagttcgttacctagaaataaagggggttacaaaccgggagagatgtgcatctctccagtagtactcgtttgaccgttcgtcatatttgaattttttaaacaaattagtcgcgcgtaaaatattatttatgacaattaaagtactaatcatagaaattttttaaataagacgaagattcatttcgaaaactgaaaaatgaaatcttcatcagatggaaggagtagtattttattatcgggactataatatgcttgtttgactgccgtgttgtacgtactggtgtaggcctagccgcct

SEQ ID NO: 280 - DNA, 1501 bp, Oryza sativa
catcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaa

SEQ ID NO: 281 - DNA, 1501 bp, Oryza sativa
  unsure (1)..(1501): unsure at all n locations
gccgaactgaccggccactcaacgtcggtctgaccggccaggccgatggggccctctgacagggctacaacggctagttttctagccgttgcagagtagcacggtctgaccggccacatacctccggtcagaccggcagagcacagagctgggggatttcgcccccaacggctagttttggttggtgggagtataaatactccccttccagcagcaagagggctctcttggcacccaattcaattgcatacaccccttgcacctctctcacacacctttgagcttagtgttcatccattgtagtggttgagattgttctagacaagagtcaagtacatttgcttctatttgtagagctagtgtggcacttgatttatcatctccatgccgggtcattgcttgttactcttggaggttgccgcctcctagacggcttgtggaggagttgcccggtgacctctctaagaagattgtggaggaggcccggcgccggtttgtgagtggttttgagttcactaccttcggagtgaaggaagaactaccctagtggccgaggcttgggtagtcctctccgtgggcctgctcccgtcttgcccaccccttgacgaagggggcgtgcggtggcttcgtggttgagcggtggagttgggctcgcctcaacggggagtaggaaactggcgagtttccgaacctcggtgaaaaatctcttgtctccttgtctcatttacttgttgtatttatatttgtgcaatttacatttctagagacatactagagatcatttcaccctaggattgctaaacattgacataggagtgtgatttactttcctagagatataattgagccactatcaccctaggtttgcaaaacataacttagttgcttagttagagttgaccctcactaagcctagcaacttaagttagttttgattaggtgtcatttagttttaaatcccctattcacccccctctagtcgacatcttgatcctacagtagtgcatgcagcctacaagagattgtaatataagtatcgttgtgactgatatgtttaaaattaagctagtgtgctcaggtctgcacaagtacaaacaactgctagcgtggatatgtctcactatgattatttagtactacacattagatcaattttgcatgtgtgttgttttgtactaggttcgtataaactagacaagctattgtattaaaacgagcaatttacaagttgttatacctatttacactcgccgagcaagtttatgtaccttatttttatcgatgaaacatttttttgcacgacgcatgaaacatcgttcgaaacaacacacagccaaacgtcctccgtcggatgagccggacggtggatatgggctaaagtcacaccgcaactagacagcggacccgccggatcctaaaaccctacgcctcccgccgctggccacccacggtcacagncgncacacccaaccttccgccgccgtngccagccagacagcca

SEQ ID NO: 282 - DNA, 1501 bp, Oryza sativa
gccggaacagcccccgcacctcgccgacgagcccctgctccaccatgcggtccacgcggtggcgcacgtacctgtgcagcgccggcgcgcgggagtccacccacaggaagcacagctcgtgccgctcgcggaacgacccaccctcgccgtcgagcagcgcttcgaggtacctgttcgacccgcccgcgatgacggggacgcggcccctggcgaggacggacgccacggcgcgcgcggcgtcgcggcggaagtcgtcgacgccgtagtcggcgtcggggggcaccccgccgatgaggtggtgcggcacgccggcgcgctcctcgtcggtgaccttgttggtgacgacgtcgaggccgtcgtgcacctggatcttgtcggagttgatcacctcgccgccgaaccgcaatgcgaggtcgatggccagcttggacttgccggtggccgtggcgcccatcaccaccactaccttgcccttgtcaccgcggctgccttccatcagtgccacgtatccttagtttactactcctattctattacgagttcaactaggaaacacgcactttttttttcttttgaaaactacacgcacgcactctcagactgtcaccgcactttaaccgccaaactcactcacgtgtgcatatactatcttctgatcagattaagttaaatcctaatgagaagataggagcacgactgcacgaagtctcaattaaacagctcactcgtgtctacgtgcacaatgccttgagatgtgtgtctgcatctcatttggaggtggggctttctatttatagttattgctgcccaaatatactcgatcgccgtgtgttaatttctacgtcgtgtttgagatttttcttcaagatatatatggttgtcgtcaccagctacgtactaaatcttctgtttatatgacatagtaagttcatcactatgctaggcaacgaaacacctgtcctagagttgactgttacgatcgaccactggcggcagtcgacttgtcacgattcaaccacaaagaagatcacctggtctttattagattacctggaacgcaagaaatttgcctttgacgaatatgagttcatctacctcagctgaattatgaagtttcgactgagctacatgggactagctaggattaattgatcactcgataagagacagccagggtgaagacctggtactgcttgttgactggtaggtgcaaaggggccgggaccgtgtgttgaaatttgtgttcctgatctagaatgatcaaagtatattatcagtaatacacgaatttggtcatatatatacttatctacatatgggaacgcgaaaagttaactgggatctactagagtcgatcgagttgaagaaaaatgggacgccgttttcagatttgctagcattcgtcacatgcatgttttttaaaacaataggaagtgtatatttatatatacacacactaggtgattctccgcgctttgctgcgggaatttctaagcgattc

SEQ ID NO: 283 - DNA, 1501 bp, Oryza sativa
atcatctagtactagcatgagacagagggagtatataattataagagcttgtcccagctcatatcgttgtaattgaagcctgggagagttcgcgtctatcctaattcattttttaattgtaattaattggctatgtgcaccgtgaacttagtgcaaaggtcggaaatatatgctttctataaagtttattaagtctaaaactcaacatgcaaccataccacatcacccactagcaataattacatatttaatcacatgtaagtatacaacatgatctatattttatttaattctacaaaccaaaatgcaagcatatccaatcatcacccctcatatcatcatttacacaatattttaacaaacatatctatcacttttataatatttaacatatagttatcaatatgtttcacactaaagcacaggtatcatttgactgataaaccctgatgtttctcttttatttctttttactcctagcttgattgtaatatatatatatatatatatgtatatatatatatatatgtatatatatatatatatatatatacatatatatatatatatattgaatcgcttagaaattcccgcagcaaagcgcggagaatcacctagtgtgtgtatatataaatatacacttcctattgttttaaaaaacatgcatgtgacgaatgctagcaaatctgaaaacggcgtcccatttttcttcaactcgatcgactctagtagatcccagttaacttttcgcgttcccatatgtagataagtatatatatgaccaaattcgtgtattactgataatatactttgatcattctagatcaggaacacaaatttcaacacacggtcccggcccctttgcacctaccagtcaacaagcagtaccaggtcttcaccctggctgtctcttatcgagtgatcaattaatcctagctagtcccatgtagctcagtcgaaacttcataattcagctgaggtagatgaactcatattcgtcaaaggcaaatttcttgcgttccaggtaatctaataaagaccaggtgatcttctttgtggttgaatcgtgacaagtcgactgccgccagtggtcgatcgtaacagtcaactctaggacaggtgtttcgttgcctagcatagtgatgaacttactatgtcatataaacagaagatttagtacgtagctggtgacgacaaccatatatatcttgaagaaaaatctcaaacacgacgtagaaattaacacacggcgatcgagtatatttgggcagcaataactataaatagaaagccccacctccaaatgagatgcagacacacatctcaaggcattgtgcacgtagacacgagtgagctgtttaattgagacttcgtgcagtcgtgctcctatcttctcattaggatttaacttaatctgatcagaagatagtatatgcacacgtgagtgagtttggcggttaaagtgcggtgacagtctgagagtgcgtgcgtgtagttttca

SEQ ID NO: 284 - DNA, 1501 bp, Oryza sativa
tccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacagggatggtttgtggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacatcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataagcacgaccataaaacatggccaaaagtctcgagcacgcggctcaacaagatactagaatgtctaaaactgcaattatcccatcgactgatctagtggtaattaagcatggctaagcataaagttctagctaggtcacataagtaacacaagctagtcgatttattacccagggttgacaaaggatagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcctcactttgatcttctaaactcttttcctcgcgaccgcgatcttccgaaacgacggattctacacgctggcacgcaaaacgaggaaaaaccctaataaaaaccaaggaaacagtacataaaaagtaaacaaacatgtagagcttaattttagatgaattttgaaatttgaatggctcaattcggagttcgaatgaattagatatgaattttagaagttttgagccattttaatgaatttctagaattaaactcgatttattgcgcaattattatttatttttacaaaggaaacggacctcgctgacgtcagc

SEQ ID NO: 285 - DNA, 1501 bp, Oryza sativa
aggtgggagtggaggatgcgcagcgatgggcatctaatctggtggaggctggcctttagtgagcccgttccggttttggccagccttgagcttcttggatccggtggctgtgggttgcggctcagaaaggcaggaccacgatgtagtcagatggatctagcccgccgtactcttcatcttctgcgggagaccttgatcgtctgggagaccaccgagcggtgtcgagccttggggcatgccggatctggcggttgtgggttgggtggatgtagaaggtagagggagaggaaaaagagataagacgagaaacaaaagagcaaaagattattattttaagggtttgagagaaacgaggttacgagagctggggtgttttttaatctcattggagcatgatttgatcactaacgctaaacaaatttagccatattccattttagcaatgtgattttggaatttattttagtcatcttatactgcttctagattttgatataatcattagatttgagcttagttttttttttagattacgtagtgaactctagtttatacctatgatgcagttctatggttagtttttaatctatctagattttactgaactcctggttcagactaaaatttttttagatcccattcatctgttgtttttcgtatttattgattaaaattaaatatgtatataacttatgttgaaagttatacatcaagcggatttgaataggtgatgttctaatgattttcagttgtagtggtttgctgatttcactgttcacgcattgtagcatcgcgtgattgtcgacggtgttgtgaatttaagtattgtgtttggtcttcttttttttattagggtggttaatttagggctgtcatagcattataacagattaacagtactagaatgattatttgttttatttctgccgcttgtttgtttttgttgtatacattgaaattaaaattaagcgataaccattcacccccttctgatcaaggcaacctcgctacaagtgccatgcgtacatcaagccgctcctccaaagagtagtccaaagagtagagtatatatagaattttgaatccaggatgctataatcgatttttaattgtcaacaaaaagtatttagattttgggtagacatggcagtaataaatataagtttctaataagatagagtagatcctataaggagtggagaaattgttttcacttggaaaatcacttcctaagaacaaatctatcaagtattgcttgctacatacctcgggtattccattgcctccctctccttgcagggtacctttcacacgtttgccattgtcgtcgtattcaaacaacattgagctgacacaccaggaagaccctatactcattcggcgtacaccggtgtaaccgccagcactggcaccatggcctccctcatcccaagcatggcctccagttccaccccacggccctatcttcacacgctgaagtgtcaagaccattaatacacct

SEQ ID NO: 286 - DNA, 1501 bp, Oryza sativa
cgagatcgttggcgagcggaaaaaacaattcaattaatggtgaaggaattaatgtgacactgacacacgtcatgtaggatatgttagttctcatcttctagacatgtggaggaatttacgtaatatggtcatatttagtccgttaaaaaaaattaacctcgacgtagaagtattctcttctaatacaataaatatatatatgatcctatcttaaaccgctttcacaaaatgaaatatgtattattatataattaattaagtatcaactatttttttagaaatagcttcgtatgattttataaaataactttcatatagaatatttttaaaaaaacacaccacgcgtgaaaaataagagagatgatgagttggaaaaatagagggaagaatatatacagccatatgtagtcatatcttttttaggttaagtttttctgagactcagagattacctcggtagcaccatcatcgaaaccaccaccgctatttggttgcttttgttggaattaatagatgggctaaaaccattcgaagattaattctttggaaaatcacaaaagcccacctcatgagatggcatgcatgtggagtttagtactaccttgtttattccaggagagggggacctccttaaaagggaggatgccctcctagccacttgaaacatgtgtggtggagagaagaggggaaacacgcgcactcgctggcctggcctggccaggcagggcaggcggcgcgcgtgcacgacgtacgcgtcgaatggtccgcaaaattggctcctcacccttgcgcagatgcagcctccttttgcagttttgttttgctgcggaaaattcggatttgttttgttttggaaacattccgaaaaatccggtgcgtgaaaacggcgtggagtcccgataagttacgcgcgacttatccggttcggttacgcggagtggagatcgtgcgggcgccctgatcaagcgacctatctctatataaaccgagtcgccgccctcacgcaacatacgcgaaatcaatctagggtttacctcctactatgtgctgcgccgtcgctcgtagactactccatcccactcgccagcgtgcaccggcgatcgggagagcaggtcttcggaacctctgccttcgacgtcctgcaccgggagaaggcggcaataaggtttttgggaagcgcttagcgcgactgctccctgttcgtccgcgacggctcgccttcctctccgctcgcgtgctgcgcgccttcatcgacgcccgcaaccgtgagtagttcctgccgagcaaccggtctttccgccacctcggtacatgttcgatatgttacgcatatttgatctgttcatgttttacttcttagtttacatgtgtagatctaatgatgcgttcatgctagtttacatctgcaatgtcatgatttatttgtggaataaattaaatcattatgtgcttataatttcaacaatccaaaaaccttattataggcgctgtgattttaccg

SEQ ID NO: 287 - DNA, 641 bp, Oryza sativa
ttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtgctatatatatatatatatatatatatatatatatatatatatatatatatatatatatataaaagcacgagtacatttagatccactatcttgtttaagtgactcattgagctctaaaggacctctgaccaggtctgaccgccaacgtgacacgccacgcaagcaccaatttacaaacaagcccctccgcaatagtagcatcgtcgtcccgcccctgcagcagcaactgcgcctgcgcgccgctctggctccgaa

SEQ ID NO: 288 - DNA, 1019 bp, Oryza sativa
ccttaggccctatttagtttccacacacaagtttttacactgtcacatcgaacatttaaacacttgcatgaagtattaaatataggctaaaaaaagaacaaattgtatagattgcgactaatttgcgagatgaatcttttaagtctaattcctccatgatttcacaatgtggtgctacagtaaacatttgctaatgacggattaattaggtttaataaattcgtctcgtggtttactgacggattctataattagttttttattagtgcccgaacaccccatgcgacgccctatataatacccaatttgacacgccaaaactttacacccccagatacgagatatgatccatagtacaacgaatctccgtctcaaaaatacttcaactaggggcctgttcggcaggcaaattgctgcggctgtggctgcgcacagtgtgtgaagcactgtttgtgccggcgcagccgcagcgcgggcagccgaacaggccctaggaggggatgtgaccgacccctcctaatacaacaaagacaaataaaagttatttagaattattgtattagaagggatcacatgcatcgtcatagattaatttttttccagactgagggagtactacagtaaaattggataatctaaaaaaattttagattaatatagtaatctaaaattggataatcctacgaatctggataaacttctattcagctttgtttctataaatctagataaaattctattcaaatttataatattacgaatgtgtctcgtttaatactgattactatattttcaggatgaataaaaatattagtagaaatcttctatactatccggcatggcagaatggttgattgtctcctataaataggagcccagctgcatgccacatagccactcgctcatcggaagcaaatcatcttcctagtgcatacaagttagctcatcatcagcactagtacagtactactagacagttgtacgtacaagtagaagtagctacccaaccttgggagaga

SEQ ID NO: 289 - DNA, 1501 bp, Oryza sativa
atacagtgtagtgctcccatccgtcttagaaatcactacacagctagagcctagccagagcatgcagatttcactcatgcatacggcgccacgtatctgcccagacgccccatgctgaattcaccggcggcgagatggaaaacctaagcacagcagcatcagcgtgtgtgcacttacctgctcgatcgatctgcacctctatctctccatgtgctatatataatcgatcgatttgcattctgatatatatgatgcgtagacagtgatctcagtttcaactcctaattagctcctagctagctagctttatataccaaatcgaagaagaagaagataatgtccggctacgggcagcagccgacgggcgatcgtcttgagtcggcgacgttggtgcagtccatggagtcgaccaaggatacgatcgtccggcgcatcaccgagtcggcggccaccgtcgacagcgccgacgtgcaggcggccgcggccaagctgacggcggctgtggagtacaggttcgacgttgccaaagctgacgttgatcggatcatggccgggagaggtatagctgaatttactcctctatatatactccctccattctaaaatataaacatttttatatatacttccttcattctaaaatataaacatttttaagtatagtggcagattaacatttaattttgactattaatagtaataaaataaataaaaatcaattatgtaaaattgatgttactatatttattattaaacaaactattatattatgcaactttttttatttaaaacatcttatacttttatagatatagatattgttggtcgtaagtagcatatcggagaccgtgtcagactaaaaaaaatgtttatattttaggacatttaaattcttaatgcccagcagcttatagtgtgctctcggatttaaacggagttatatatatagtacgtttttaattttaatttgaatgcgactttattttgtgtgcatgcaggcaactagacaagtgatcgtggaagacgacgaacaccgctggcacacatgtccgatgcagtacaagatcgaaatttttatctgccccgatagaatttaattagcctttttctttgtttttctcttgtaactttctttaaacaagttgctggcagatcaggctttagttctgatagatagagcaacaccaacatggatcggcgctgttatgaaaaagcaataaaattaattgcatcgtggactcaatacatattaagtaggttaatttttttgcgagtactgggttacattaactaagcctatagaatatagatatacacttgctcccttcgatttcatagttctttcatgttttggatagtattgaggttaaaattttataatttaattatcaataactttaaaaatatatattaagtttatagaggcactagaacaatatatatctctactattataaaaattcaaggtgtttttgcctgaaaatttggtacgtcgtcattc

SEQ ID NO: 290 - DNA, 1501 bp, Oryza sativa; identical to SEQ ID NO: 279

SEQ ID NO: 291 - DNA, 1501 bp, Oryza sativa
tcgcgatgaattcaattcaattcggtcggtggagcggccaatttcgtaacctgcatctgtgccgacctatttgtccatcaagtaacttgaattcgataaatagcacgctatcaaggaacttgaactcgatagatatcgatcgtgctaggctagttaactactcgcagatgttctgaacatgtcaacaacattttaataacccctaaaatacatatatatagtagcatttcgaaatatgttttttatatcttttatctaaagttagcgtttagtgtgcgacctgtgctaactcatacctcttagccttttagcatgtgtgatttaaaaaagataggatgtgtttggatgaggcgaacctattttataagatgtttacttaaaaatagatgggttgagattaccttcgaagggaattattttttttaagatttgggttagctttacgtgaaaaaagtggcgaaccaatcaaaaccactttcccgctctcgctgacatacgagtcacgccatcccttttctaaaaaaaaagtgatcatttataatctcttaaataacaaaacaaatagctagaaccatcctatctaaaactagagataaacctaacccatcccaccttatataaaacctaaaacacgcttagctataacctattagccgtatacaccaagtgcagatgccagaaatatagtccagggactaaactttagtacctatcatatcggaagtttggacactaatttagagtattaaacatagactatttacaaaactaattacataaatgagagctaatctgcgagacaaattttctaagtttaattaattcataattagataatgtttactgtagcattacataggctaatcatggattaattaggctcaatagatatatcttgcgaattagtccaggattatggaatgggttttatcattagtctacgtttaatacttctaaatagtgtccgaacatccgatgtgacaggggctagccccatccaaacagggccacttgttactattttttttgctacatcaacagaacatacataaagccaagaacatctcttgatttttgtctagttaacaaatttttcatgttaacagaatcttcttctgtgctctttcagacgcagtgaaccagccagcagctagaaaagaaagcttgattctttcgatctctatttttcgtatataggaaaaaatggttgcgtttcttttgttccttttgttcctttgggcaagtcaagtcatccactttcctaactcaccaacccaacaatcttagcttaaagattcaactacgcacaaacagagccccaaaaggaggaagaattacttctccaaacatacttcacaagttacgctattttctcccctcatagttgcttcatgtcaaaagaaatcgaacagtgtacaatcttctagagcaatttcttcttcaactttgctaatcgatccagctgaagcaatcaaattacacagaaaaaaaagtaggataa

SEQ ID NO: 292 - DNA, 1501 bp, Oryza sativa
taattgtcataaataatattttacgcgcgactaatttgtttaaaaaattcaaatatgacgaacggtcaaacgagtactactggagagatgcacatctctcccggtttgtaaccccctttatttctaggtaacgaactgtgagaaagaatctgggaataaagatcgtcatctttagtcccggttaaaatacctagtactaaagatgaatccttagtccctgttggagtcaccaaccgggagtaaaaataaaagcaccacatggagctttctctttctcttttctttttttatttttttttgcttctttcatattgatttcgcaccgaactcaacaacaaattcatccacagacaaaatcattcaacatcacagattcatttgcaacttcatagaaacatctaaaaatcatccataaatttacatcacaaaatcaaccacaaattcacaaaaacatctaaaaatcactcacaaatttacatcacagaattatctccaaaatcatcccagaatcatcacaaagtcatcgcctccggattgcccgccgcttgccacctctcctctgtgtacgccgcctgcggccgcctcccatccgcgccacctccaccgccgcgcggggccgccgcccgctcccgcgcgcaggccgccgcctccctccgccgccgctagccatggccggcacgctgccgccagccacagccatgagcgcctgccgccgctcaccccgccgggcacggccccgccgccgctggccgcctgcctgccatcgtcggccgccaaaattattatttattttcattggaccagattttgttctgttcataaaaatatttttattttgtatagattgtaaatggcttaaaaataataattataattttcactggttacctaggaaaagtatttagtacaaatataaaaaaatataataatgataataacaatataggaccaaacataatattattcggaattaaataaaactgtacttaatcataaaattatattttatttcaaattggaaaaattttatctaggatttgaatatcttggacaattataagcctttcaaaatttaaaaatcatatatacacaagggctccaaaactattttagatttttacaattatgaaattagttcaacaaattatagcacaattcttagtttactattagagtatttaggaactaaataaatcttaactataatcaataatacttatttgtttaacaaaagatgacaaatgcaatttttatttgccaatatatttttttgtgcttgtataaaaattttattacgaaatctccaagattgaataaggattttttttatgaaattgtttaaaatagtttaataaggtgccgcctacgaagatgaattttgcagccggacgatataacgcgccgcctgtaaaattgcatcttcgcaggcggatgacctagtccgcgcgggaaggccgatttcggccgtttgcaaaaatatttctagtagtataaaattgag

SEQ ID NO: 293 - DNA, 1501 bp, Oryza sativa
acatctgattgccgccacctgcgatttttgcatgtttgtgaccagtcctgtcgcatgtccaaaacgcacgagaatgtcggtgaaagcctagacatcctctctaacagggtttatgaaaaccactgcgtcatcagcgtacatggagattctgaggcgagccgctctgcctcttagcttggttatggcgtttagttccgttgctttggagaggatccattgtagggggtcaattgccaatatgaagagaagcggtgatagcgggtccccttgtctgagtcctctgccatgcgctatcttttctcctagtatcccgttgagcagtacttgtgaggtggaggtagtaagtatggccgtcacccagtctctccatttctgcgggaacccatgatgttgcatcatggctaaaaggtaatcccaacgcaccgaatcgaaggctttggtgatgtcaagcttgaagagaagctttggccgccttgttctatggcaacttcttgccaaatttctaacatagaggaagttgtcgtggatgctcctgcctttgatgaaggcgctttgattgactgtgacgagggttcacatgtgtaatcgtagtcgcaaagccaaggttttggagagggtctttgctatactgtggattaggctaatgggcctgtagtccgtcacctcatccgcgccttccttttttggaatcaggacgatgttagctgagttcagaaggttcatgtttgcacatctcagattattaagcgattcgaagaccgccataaagatctgaaacatgtgtagaaaaatttgtgtgtttgtgtggttttttatgagactgattgatatagtttgggatgcctagaaaaaaaaagttgttttgcaaactgatgatgatgagaagtagcagtacccatgtgtagaaaatgttgcttctttatgggtagtttatgggagtgtgattcatgtacatgtggttgcctacataacattgcgcaaattttgacaatttgatcctttccaaaaactaattttacaaataaaccacggccaaaacttatttcagaaaggcaaaatttgctacaggctatccaaaaaagtgtaattagctggaggacaccgtaaaaacgtgtatttgctatagggcatcgcaaaaaactggtaattggctgctggacccccgcagcattattttattatttttggaggaaaaggagagagaaacaataattaaagacaagtttacccttggctcaaatgactccaactcgggcttcacatggaagtcccctctccctctccctctcctccttcccagagaggccgggtagcagagcggcgatccacggccgcggccgcagtgccagccacgttcgccgtcaagaggggagggggaggggtttacgtgcagccacgccgacgtgcgctgccggccgctaacgctcatctgcgtgctcggctcggcgatgagtggccgggacgtcggttgtgtcggagtaggcgctcaagtgcggcggtg

SEQ ID NO: 294 - DNA, 1334 bp, Oryza sativa
tgtcaaacattttgaaacggagggagtataaagttttgagatatcattgaacacctccaaaaaaattcttacagtgatgcatgctgcgccgatgaagaaacaaatcacaatggtagctgtagatgttactttctccgtttcacaatgtaagtcattctagcatttcccacattcatattgatgttaatgaatcttacatcaatatgaaggtgggaaatactagaatgacttacattgtgaaatggatggagtaattattctctctatctttattctcttttcgctttaccaaaagagaattggcaacatgatgacagaggctcgagagaatgaagacagagttagggtgaattcttttgtgtttgtgtgtgcgcgcgtttttgaaatcgaatgcttttccctgttcattgatctaaaatttgcaatatgctgatgataatcgttcgggatcggatgcctcttccgaatgtacttttttccatccaacatcgaatgtactaattcttataataaacgactacaatcatgttagttgcagtgacctaagtagcactctaaagtcctgagtttaaatcttcatatgagcgaatttcatattggattgtttgaggggctaaattctcaatttaaaaggttgcatattttatttgggcatcatttgattttggcatacagatggctttgcccagtagtttaaattttataaataacaaaaagggtctagaaatacaaatacaaattacatgggaaaaaaagaaaaactcaaagctttatgaagattataacctatctaaaactctctcttttagatcattatattcatcctccaagatacaagagaatctcattcttgaaactagctaaccatctgtcgacattaggtgctaggtgctcaaaaaaaattaagcattccgctgcttccatatatgtcagcatgaagattattactatcttcaagaaatctttcattcaaaagcacaatcttgcaaaaactttcatcttggtagaaagacaatgacgtcttccaggaaattctaaacttcctccagtagggcttactaaaagtgcaatcaaatacattcttgtttcccctatcaccactcactcactcaggcaaaatatgcacatgataaatccgtgtcctgtggagcacaatgttgatcatgtcattgaacaacagccaaagaaacacttttatctttatgacacattttgatttccatttgcatgataacggccttgcatggctgcttaaaaaaaacaggctatacattcccgaatttttttaaaatagtaattaataacctgaaaattaaattaatagtaaatgaaag

SEQ ID NO: 295 - DNA, 1501 bp, Oryza sativa
gccgaactgaccggccactcaacgtcggtctgaccggccaggccgatggggccctctgacagggctacaacggctagttttctagccgttgcagagtagcacggtctgaccggccacatacctccggtcagaccggcagagcacagagctgggggatttcgcccccaacggctagttttggttggtgggagtataaatactccccttccagcagcaagagggctctcttggcacccaattcaattgcatacaccccttgcacctctctcacacacctttgagcttagtgttcatccattgtagtggttgagattgctctagacaagagtcaagtacatttgcttccatttgtagagctagtgtggcacttgattgatcatctccacgccgggtcattgcttgttactcttggaggttgccgcctcctagacggcttgtggaggagttgcccggtgatctctctaagaagattgtggaggaggcccggcgccggtttgtgagtggttttgagttcaccaccttcggagtgaaggaagaactaccctagtgaccgaggcttgggtagtcctctccgtgggccggctcccgccttgcccatcccttgacgaagggggcgtgcggtggcttcgtggttgagcggtggagttgggctcgcctcaacggggagtaggaaactggcgagtttccgaacctcggtgaaaaatctcttgtctccttgtctcatttacttgttgtatttatatttgtgcaatttacatttctagagacatactagagatcatttcaccctaggattgctaaacattgacataggagtgtgatttactttcctagagatataattgagccactatcaccctaggtttgcaaaacataacttagttgcttagttagagttgaccctcactaagcctagcaacttaagttagttttgattaggtgtcatttagttttaaatcccctattcacccccctctagtcgacatcttgatcctacagtagtgcatgcagcctacaagagattgtaatatagtatcgttgttgactgatatgtttaaaattaagctagtgtgctcaggtctgcacaagtacaaacaactgctagcgtggatatgtctcactatgattatttagtactacacattagatcaattttgcatgtgtgttgttttgtactaggttcgtataaactagacaagctattgtattaaaacgagcaatttacaagttgttatacctatttacactcgccgagcaagtttatgtaccttatttttatcgatgaaacatttttttgcacgacgcatgaaacatcgttcgaaacaacacacagccaaacgtcctccgtcggatgagccggacggtggatatgggctaaagtcacaccgcaactagacagcggacccgccggatcctaaaaccctacgcctcccgccgctggccacccacggccacaggcggcacacccaacctcccgccgccgtcgccagccagccagcca

SEQ ID NO: 296 - DNA, 1501 bp, Oryza sativa
gttgttgacttatgacttggaaaagggatactaactgaaaataaatacaagctttgttttttccatgaacaaattactactacttctccatctccagatcagacacattgtatttcacatggatgaagagtgactaggtttttggggatgaagaagcatagcaagcatcggaggaggaggaagaagaagaagaagaagaatcaccgtggtgcgcatagaggtaggcagttctccaagagtagatgtgatccccggcggcgaggtccagccgatctacccggttggacagcacgcccaccatatcgttgggtgtcgtgctcctcctcctcctccgccaaatcagaaccgaagaagaaatcgatcccccttcctcccttccctcaaaccgaagaaatctaagagtcacctgggcatggacatcctcattgccaccttcccctaccctttccctggatggatggctgggtgggctggatgcttgcttagcggcgaaggaaggacgcctcctccccttcccggatgaattggggtggatgccgccgaaggagacgggaaaattactccacttcttttttttttttttgagagagagagagagagacgagacggctgggaagggatgggccgcaccttgggcccaagcccaacgtacttcatctatcttctcttctaggaataagttcatctgaggtcccttagcttgtcaacgaatccgattttcgtccttcaaccgaaaaactagatacggcgggtccctcaactgtcaaaaccggtgcaatataggtcctatggcggtttgaacggcagttttcgcttacgtgacgcttacgtggctaatttgactcggacttcatatgatgtggcagtgacgtggcgcttacgtggcaatttgatttgaaaaataataaaattgtgggcccgcatgtcaattacaccaaaaaaaataatttcaaaatggtgggggccacgtgggtcccacatgtcattctcacccctcctctctcctcaactcccctctattcatctctctcccctctctgtcctctctccaggtgtgagtgatgaggggtagcgcgtggcggccgagcaaggagggaagcggcataaatctaaggccagttacattaggtgctaacaaaatgtaccatatgcacatttcctttatacgatatttttggctcgctcaatcctagccagacactagagaacttgcacgcgtagcggccacttgcggatggctgagtgtacatgcaaaccacgacgacgcaaagctgcgccaccgatgccactatggccagtactccctccgtcccctccgccccctccaaaaaaaaatcaatcatgggtttgaacctaaattggacacagacacacatgtatccaggttcaaacctaagattgtttttttttcggacagagggggtaagtgttaacatgcctaggcactgcttcccacctccttcacatccaccaaagaccaaaccaccacccgaaaatgcgt

SEQ ID NO: 297 - DNA, 542 bp, Oryza sativa
tccccttttcctcttttctagcgttggcaggaagtatgcggcggcagcagcaagcggggaggagacggcggtagtgggcgcggcggggagcttgcgtcgcgcggaggccggcgggcgcggcgaccggaggcggcgggcgcggcgagtagcggccggcgggccgtggcgagcagaggcggtgggcgggggccggcggccgcggcgagcggaggaggaggacgacagccgcgtgggggccggcgggctgcgccgcgcggaggccggtggtggcggcgagcggaggcggtgggcggtgctgcgcgggggccggcggcggcggtgagcggaggatggcagtcgcggcgagcggaggccggtggctgccgtgctcgagttcctcgtcgtgctccttctgtgcttggttgccgtgtggggatggaggagatgggctctgtggggcccaccattggccagccaaatagagtggccaaatttggctaatggagagagggttttggccagccggttggagaggttgttggagcacttttttttggctagaa

SEQ ID NO: 298 - DNA, 1501 bp, Oryza sativa
gcttccgatgggtttggccggctgagccactggggaactttcagatttttttttcagaattttgacgaaaactaccgtacaaatacagttaccgacaaaccggtcgggaaaacctccatcctatttccactaccattttcggaagatattatcgtttccatttccaccaccgtcggttaccgataccgactgaaacagtcgatgcaaactgaaaacggcagccgaaaatctcggaaatttccagatcgttttcacccctacgaggaggcgggttgtgtcgtggcgcaactgggcagaacgcattttcgggtggtggtttggtctttggtggatgtgaaggaggtgggaagcagtgcctaggcatgttaacacttaccccctctgtccgaaaaaaaaacaatcttaggtttgaacctggatacatgtgtgtctgtgtccaatttaggttcaaacccatgattgatttttttttggagggggcggaggggacggagggagtactggccatagtggcatcggtggcgcagctttgcgtcgtcgtggtttgcatgtacactcagccatccgcaagtggccgctacgcgtgcaagttctctagtgtctggctaggattgagcgagccaaaaatatcgtataaaggaaatgtgcatatggtacattttgttagcacctaatgtaactggccttagatttatgccgcttccctccttgctcggccgccacgcgctacccctcatcactcacacctggagagaggacagagaggggagagagatgaatagaggggagttgaggagagaggaggggtgagaatgacatgtgggacccacgtggcccccaccattttgaaattattttttttggtgtaattgacatgcgggcccacaattttattatttttcaaatcaaattgccacgtaagcgccacgtcactgccacatcatatgaagtccgagtcaaattagccacgtaagcgtcacgtaagcgaaaactgccgttcaaaccgccataggacctatattgcaccggttttgacagttgagggacccgccgtatctagtttttcggttgaaggacgaaaatcggattcgttgacaagctaagggacctcagatgaacttattcctagaagagaagatagatgaagtacgttgggcttgggcccaaggtgcggcccatcccttcccagccgtctcgtctctctctctctctctcaaaaaaaaaaaaaagaagtggagtaattttcccgtctccttcggcggcatccaccccaattcatccgggaaggggaggaggcgtccttccttcgccgctaagcaagcatccagcccacccagccatccatccagggaaagggtaggggaaggtggcaatgaggatgtccatgcccaggtgactcttagatttcttcggtttgagggaagggaggaagggggatcgatttcttcttcggttctgatttggcggaggaggaggaggagcacgacacccaacgatatgg

SEQ ID NO: 299 - DNA, 1501 bp, Oryza sativa
agctaatataatagtcaattcatataatagttgcttactatactattaatacctgattctacctatcatacacatattatatcttgaagtctgtattgcagctggctaaagatttatagcccgctactttttttcttactttctttatctcttttaaaatatgttaacgaggtgaggccgtgaggcgaggcacacgagacagagaccgctgattttttttccctatccttttccttgggagcactcgccgtctcgcccattcctccaccaactgatttccttgcgtgccgtgctcgccgttggctgttcttattgcgaccacgaccaactgaggcccccttcatttctccaactaattagacgaagataaaaattttcgtggcatgttttttaaattgcttaacagtatgtttcgtgcgaaaactttctatatgaaagttactcttaaatatcatattaatctatttttcaagtttataataattaaaacttaatcaatcatacgttaataccacattgttttgcataaaaaacataatcttcatcttcaggagaaaagaacaccacttgagatatattgagtatattataattaaggtaaatctaaaccgagagcgttctcagtttagttttaacgagtgacgcactcatacgcatacgtgagtgatccacacacttgttagtgccttagcggtcggttacaaaccattcattctatctgtcatatcatcttcattaaaaataccagagatagatacctaatgcttgtttccccacattgttgactctcgcgtcgccttccccatgggttgcaccggaggcgaaaacctcgccgctcccctcctcccccccccccactcctccttcgcctcgccaccgcgcgagtggccgccggcaacgccacgcggccgcaaggacggcggcggcggggcttcgcccacctcgtgcttgggcggctaggggagccactcggggtggcggcggtccggccaaatccgcgccgcaccgtctggatctagcgagagggcggcggcagttccgatcgacggaaggtggtgggacggaggaggcggctggcggcagcagtggaggtggccaatggcggtggggttagcgacgacgtatgatggcgatggccacgtctccgtggcgcgtggcgtcaagtggctgcgagcagtagggatgagacggtagcggggacggtgatggcatttggtggcgatggtggatgctacggatccggaacggccacgcccggatctagccgtcccgtgggtggatccggcaactccgcgctggatctggctggccacggcgcggcagtgtggcttcggcaggaggtcgacggctggacagcgagtggcagcgacggctgaacgacggtgtggtgtgggtgaacgatgatgacggcgaatgtgctcaagctgatgaaggtgccggcggctaccaaggttggcgcgggtggcaccggcacggaggccggtgccgggtgttcctggat

SEQ ID NO: 300 - DNA, 1501 bp, Oryza sativa
tttcgtttatcttttattgtgtttcactatttatttgtatgtggtatggtactctttgttaagctagcaagttccatgagtttatttatcaatgtacaatttggagtggtatatttgattagcccgttttccttaggcgtcgcttgtagctaactgctaacatacaaaagtaattaagtatgtataaaattgaaaagatggcgagtcatgagagagagcaatgtggcaaacaaactctatattagcattcaaaagtaaagtactaacatacaaagcttgttagctagtggttgctgaataacatacaaaagtaataaagtattaagtacatggagtataagttatgtagctaggaccacaaacaacacatgatctatgcatggtatgcatgcaaaccatgcacttactgcaagcaagtaggccagccaaagtccatcatgcatatatgtatggacatcatggtttattattaaataggtcattagacaattgcttgcgttacacaatgtacaaaagaaatgtaggatattaagctaaaatacaaaattctccagcaggaaaggcgccgaaagtacacttagtttgctagcaatggatcgagtacttatctactgatctagtcatcaatccatgcatccatccatcattaaaccacgtagcatgtattggctggaatcaagctatcacatatatgcgtgaatctaaagcaaaacaaactcctcgatatatcttgcacacatctagagctaaccgtccgttgatcagctagctaacttagagatagattagcatgtatgacacatcaatttgaaatcatgatgcatatgcatggtataggagaggacaaacaaatatatgttcaattaacaagcaagtcaattcgtgacatgactaatatgttacgcaaataaactgcactactttatcttggttgtctttagcataagaagtgtggaatgcatggtttagccttgtgagccccacatatattaaagctagctgtttcactggaaaagatacacgcaaggctaaaagatttcaccaaacccacaagaaactaataaacctttttttctttcttcaactctttttcgtctcccttctcaacaatacagatatcatagaaaccagaatcttttaggcctatataaaccaccccaccttgcatactatgttcatcctcgtgtcatattgtgttcatcttcatactaccaaccaattagtgctaataggtagcattttctgtagttgcagctcaagtaaggtaatgcacctactagcttattattcttgtgcctagtattaattagtttttgtactggtacttgtgaaaatttgtgatttgagcaatgctatttgatttgtaattaagctagctatctctttttgttagactgcaatgtaacatcgttttgctaatttttgaactagaaaagtaagaaaaagaagtaacaaaagtgtgtgcttgctatgtaggtctattattcagagcaacgaaggg

SEQ ID NO: 301 - DNA, 1501 bp, Oryza sativa
accacgcaacagcgagtagatattcatgctttcagatgcgccgcttacttacacacgaggcaacccatcgatcgatccatctgcattcgagctcacatttttcatcacaagaagggctgcaattaattaggcagctccatatcataagccaaagtttatacattaaaatttggatctgtttgaaaatataagtttttccgaaagttataatataaattataagatgaaaaataattgtgattggttgagatggaaaaaatagtgaaaaaatttaataacatgaggctgtttttagttgagataaaagaataaaagaaatatttaaactatgacataaaattttaattatattatattttagtacagtgggaacactttgttttgttaaggcagttgaacaaagaaagttggaacacatgtctcctccatgcggcgccagctagtctggttgacagtccacgtaagcaaagggcggccccacctgcagagcaggaaaaataaaacagacagaaaagggttggcatgtgggacccaccatccatcatcccaactcccagtctcccatccagattttccatttcattaattattaccgctccaaccactatcctaaagtagctaacatagggccggcaccggtcttccctgtgggccccaccagtcagcccccacccacacacactcttttctctctcctctctcctgattagcaacagtagcagcctcacttccactaatcacactctacagtctcactcctagaatctggtgcctccctctccctctctcatccacctccaacccaaacacaactttttaacagttaattaattagagattaaagcctttctctccccaatcccaagaagcaaacctagagagagagagagaaaatcatcagcaaaattaccaggagagggtgttcacctttgcccctgaagaagtggagattagtagggagagagagaaagcaattagccactaacagagagcaaagaggacaccagctgtgacttgacttacgagtccagtgacgcgtgaggcgccatggaaatggagatagaagcactactataaatatcatcaacgtattaaaatatagtaacctttgtatagataagatatatcttaatattaagaatttgatactcttcagattattggacacattctgatactatgtctagattcatagtattactatgaatttaaatactgcccaaatttataatattataatacgtcttatccgcttaaggttgctatattttttaatggagatagagagcaggagtagacaagaaaacctgggcgaggagagagaaagagagccaaggagagagagagagagtgtcctcatgtgccgtcagtgagagaggaagcctctcactctctccggtggagggaaaagcaccgaaaagcgcggcctttttttcttctttttttccctcccttgttcttccccacactccactccactcctcgcatcgcatcccatcca

SEQ ID NO: 302 - DNA, 1501 bp, Oryza sativa
accggtgttgcttttatatatcagtatcatacaagttcaatatttgggatgacctaatctaatctagtcattgtcggcttggaggcatggagctctcacatgtagtcgatagctagtataggtttcttccttgaatatgaactcggtgaaattggagatagctctagatctctcatgtcgacctctgaaactcctacattgggtttgtctatttctgtattggcttgtattccgttgaattgtcctctcttctcctaggggttcttgtatttatagcgaagatcattttcctctctaagttgaacttgaagaaatataacaggatatagactaaggagaccttatcttccccaactaggattctaacaccttttatttcaggaagataatttccttctttatccgccgtattttcttaatcaaagtatatcttctcatatactattagatatatagtatttttgtatatcacgaacccatgtataagaggtatgccttatccttgacactagccatgtgttcttaaagtcttatcaaagtttttaaagtttttaagagtgaacttttgaaatttgataaaatatcaatattaagaatgtgtttattttgttgccctaccaaatttgaaagtgaagttggtaacaaagtgaacaacctgcaaaggattaagcaattcttagttaaaaaaccagttaaattagtggttatgaagcctaagataattgataagagtgcttaaagtgtacaaccgaataaggccttagaaattaaacaactcctatttttttttattttaatatataccctcacattatattggctttgttcggatgatatagttgcagtagcgttgcggctgtgctgtagccagctagccagcagttacatgagttgcttccatccagtattgagcagttgcttcttgcagctgtgtgtctgtgtagctgaatggctagaatgtataacataggctagaacgctgcaacaatggtctaccgaacaagcctattatgtttaaagatttctagctccatttttgttttttttaaatcactcttacaattttcagaataggttttttttcatggctatcttaaaaaaattaaggctcacgacaatgatataaacatgtgaaagatttcatttttttttataagaaacaaatcactacctcatgatgtaattctttggcaacgtgtaagaatgaagccggcaagaagcgaagctcgatggtcagcaacgacaggacacggctgctattccgcttctttccgctcggaccagcccactaccggcccactactgaagtgaaaccaccctccgccgccgccgccgctcgccgtagtcacctccgccgccaccctctcttcccagtgctacctccccgccccgccgctttgccgcctccggctgaggcgaatttccagtatccaagccagtcggacataagtaagggcggggaggaagccgtgcctgcgagtttcgaccatggaaggaggcg

SEQ ID NO: 303 - DNA, 1501 bp, Oryza sativa
gtgcttcctatatcaatacatggtcacccctcccattgggtgtgaggtgttctccccattccattctacacatacaaggacacgaagcaaatgtaggcaaaagggtaaagatgatttccaaatgagaaacagtgtctacggaaagcaaagtttaatcccaacgcgagactttaggcactagccagcccgctgctcctagatgtcgctctactgtgtactcctagatgtcactctgctcctagatgtcgctagagtagtaattaattgcatagacacggtctctaggttgttaattaccagtgattgctgcgtatcccacagttcgttagaggctggtgtagaggtggtgatagcccccaagatcaccgtagtcctccctgtccgggtacgaagtagagcgtgttctggtagcagcaagcaagccagtgcctgaagtattgagataggattaaatttaagctttctgtagacactgtcctcacttaggaaattctctctaccctttgcccatctttgccttgtgtcattggatgaacttgaaaaggaactagacacacatgtttcctgtggaaaatcgatgccttggaatagtcccgggtgaagtgctacatcgtagcaccctgcgcctgtggattttatttatgaccataagaaataccaacacttaccagtattgactcttgcttattgattattttgctgcttaggttgagtgatgcgggaatcatggatctttaggatagttcttactaggtgtctatccctagtcggtttgcctgtgtggtaagggcaggcaggttttccgctgaacttctattgaccggtcaactgcatatagatgatttagaccaatgtttctagctattcttaagttactttaattcgtgccttcatgtttctgatatcttggctaagataacagtgtgaagctagcaacctcctgagactagccgatcacaagttagagttttgagcaattgagatggtcgtgaaatttagcgatatgagtcaagtcccctgatgtaatacatttggtcgtcaccttcgagtagtttgatgggcatattttaagttgaagttgactgtcgggctattccatcgaagatctcctgtgctcactactcggtgctttgggttttatgttgtgtttggtgtttcgcatgctagatcaacgatgaggttggatggttactactattattatttaggtttaatttaatatcccatccaactaaatatttcatgttgtcatacttagtagcctactcaatatctagcccaggtgtcctgacaagagttgaatccatggaagcctaatggcgatggtattttttagataaattaacttgtgatggcattttgtgggactaacattcgtcgatggcaaaacatggaataaggttaatggcaacacttagaatatctcatgtaacattgccccctgtaaagaagttacttgacactcgactggagaatgacacacacgaaatggacagtcatg

SEQ ID NO: 304 - DNA, 1501 bp, Oryza sativa
gctgagtcctggagactggagaggaccaatagatgcctagatggtgcagattaatggaccacactacgtggttaattcgttctttcattttctaaaagtagatctaaatatatagttacaatcttctttttttcaaaattgatcatcgatacaatatacttttttttcacacgtttgaccattcgttttattaaaaaaaaccataattataatttattttgttgtgagttgttttatcactcaaagtactttaagcataatttatatcttatacatttgtatataattttttaataaaacgaatggtcaaatatatgttcaaaagtcaacggcgtcatctattaaaaaacggagggagtacgtatctactatctaaaaatggaagcctaaattaaatcaatgcgcacattgagaaatgaaaatgatacgaccaagtacatgtaatgtatttatcttttgagagtttttatcatccttgagtggagatggtactaatctagaccatccatctcgtacaatctaagagctagaattgctttgtaccgggtggtactgctctcccgagagaggaggtgttgtgggtgagagggtaaaattgaactttcgcatatacccttgcttctatcggtttatccaccacagcctcaagtgtacctcgctgcggctgcaaatcaagaatgaattgagacgcctcaaatctggccttatgccagctcatcaccgcattcggtgccaatgccctaaaaggtacttcttggtatctagcaccgggtggagtggtggtaccttctcaagaatggtaaaagttcgcttatcttttaggttctgatgttgtagattggcccttcttagactttatttttttcgagtggtagatgttaatactatctataaatttttacagattttcaatactatttgtattgtattttagagctaaaaatatatatgacggcatccctctaatgggaaaaaaatagaagttcacatttgatagatattactgtctgtgtgcgttagcgtatagaatggcttggagcccgtttggtcctatataacactcatgataagttcagagaccagaaaaatatattgtaacagttcagaaacctagaaagcttttattgaactcaatcaattacactaaagtaataaaaaaaacactgagcacacaaaaatatgatccatgtaactataaatacatttagataaaatcagggtgttaaaataataaagcaaacaaaaatggcaatctatttgtatactaaagttttgcatgtctaaactacaccttatgtgcagttatcatgacataaatttatgaaaggactttgctgtacgtgatttatgattatatattcacatgaacgacatgaagttatatcgaaaacttcgatcgaccggatcctttccttttatatttccatgtgcctggatcgaaagctcatggttcaaaaaaaccgatcgattttcatgaattaattacgacgtagacatacgg

SEQ ID NO: 305 - DNA, 1501 bp, Oryza sativa; identical to SEQ ID NO: 280

SEQ ID NO: 306 - DNA, 1501 bp, Oryza sativa
ggcatcctactcagaacaaagaaaataaaagtatggggcccacatggaattgggttgcgtctcccctctccttatctctctcctctcccttcttgagctcatgctcgttggcccatgtcaccggtcagcctcatcgccgctcccaaaaaagacccgtattcagacccgatatccgtgaaaaatcttgggtacctgaattctttacccaaatttatcccaaaataatgtgttcgggtgggcgggcgggaaatatccgccccgttttcaccctagtcacagtcttctcgccccatgagccatacatagccttcccacctacctcatcatcgtcgagctcctgatttgcgtcgaggtgcacaggaagagccacacaacagcagtggccgaatgtcgaggggggctctcagggacctcaagccaccaggccgcaccgagcctttgccttctgcccctcgcggtctcgccgcccagccgatagaaaggatgggggagagagaaggggatgaggaagaatatgttgtttcacatgcggatcccacgtgggtttattattattattattgcttctatcgccatatcaacaccacaacaaccaaaaatgccccctcaatactgctgtaggacccatttgacctggttttgctagattagggacgcgttgtatctgataatgtgcttcaacgacgtttttcaaactcaccctcgacagaagggacctgaagtgaacttatttcttttaaatccaatatccagcccaagcagggccagcacggcccatctccccatcggcgtggaaagtcgtgcatctgatcgtgatgaacggctacgattagaacaacgcggcgggggagaagatttcaggctcagaagcagccgccgccgccgccgccgtctcagccgccgcgccgcccccccgtcgaccgcgatcttccagtccgcaccccgccgcgatggccgacgccggcaagcccgaccccgcgtcgccgccggaggcgccgtcggcgaagaagggggtcttcatgcgccgcatcttcccgttcctcctcgccgccaacatcttcatcggaggtgagagaccccctgtgcctggatcgatctccctccctcccatgtggtagacatgcctcttagggatgatgcggttctttcgttgtgtggatccgagcgagaaggatcgcaaaagcctagtggatggatgatgttaggcatggttaggacttaggacttaggagcggttgtgcgactgtagggttagctgtagtctcaagctaaatgcgcttagtaattgttcatctaggtcacctcagtttggtttcagtgttatgttgtagatatgatgtgcatttttactaacacatggagtggattttggaccatcagatagagattattattagagcatttgtgatactagtgttataggattgtgtaagtaggatgaactgacatagctcggttattcctgggcctcgaatttactatcagaagcaacaagcggaag

SEQ ID NO: 307 - DNA, 1501 bp, Oryza sativa
gctgttatatagaaagagctaaagaaacatccatgggacctatatgttagcgagtactccctccatcccataatatagcaacttaggaccggatatgacacttcatagtacaacgaatctggacaggcttactgtccagattcgttgtactatgaagtgtctcgtccggtactaggttactatattattggacggagggagtatttttttttactactcttaaaccgatttgtctccatcttgccgatgtcgtcaatggcaccgagccaccgagtgatgtgcaatggccaggggcacgggggtattgcgggagctaggagcactggcagaaaccattgtcacatcatgattttcgtttcaggatttataaattatttaataaattattcttagaatttatattaaatatttattaatttacaagtgaagttaaatgtgggaaataaaattttctaaatataaagtatggttggatttaatttttattaaactctccatgattaattatactctgtggaatttttttcagatttttcagagctcaattactaattttaataataaaagaacatttcaataatatttaaataataaattaatcattaaatgatctgattttaatttgttaaatactttaagtgtccaagtattttcaggatttttttcatgaaattatgtgagcattggaagtagttcatttcattggttaattggaaaagtaataaaaatcctctcctcagcttgggccctttttggcccagaaaaaaaggtctagtttgcttcacccgcgcctgttcatcttagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcatggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataacccgtgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 308 - DNA, 1501 bp, Oryza sativa
gtgttggtgccattctcagtaacattcttagggcagcgtttcaagcacctctgtgtctaggcactcaaatcaatacccataggtgtgcttttagattcgcaatgtctgttgtgtgtatagtcacaccaataaaaaaaagaatatgtcatgtatcaaactccaaaagatatattagactcatccaagtttaatggtttgaactagcttgaactctgaaaaattgtttgttaaaagcatgtgcgcatctgtaaagtgtggttgtctggctgagagctaccgtccagcaagctagtccatgtgtaagtcgttcatgatgcatacaatgggcatggctatatatgtgtcgctaagccaagatatatgtgctttattctggtggtttcacagatcattgtcctgccaatggcatcattcctgacaagagatgcatacaattttgcaaagcatctaccaaacaacatactggtgtcagcgagggtgcacactgcataccatgttgaagcattttctgtgcctagtggctattatagtattatgtccttgttagtcacgatacgaatcctacgcacttcaggatctttgtttctatctgaaaacctgtaatgtctcgtcgtttgttcctactgtaaacatgattagctgtccactgttcttttcttcccccaaaatgctatcgtttggaatggcatatatagattttttttaaagagagagagagagagagagagagagagagagacaacgcgttaaaattttgtagtgcttgcctcgtcttgtcgaccgatcttgatgaactggaaggcgacatcccgtagggaaataagcacatcctccagcctctgcgggcacgaacgaacaaattaaaaagggtggggggtttgagcttggaaaaggacgtggatgagaggatgagtactcaaaaccttgccaagatggtggggttgctcctgggattcacacggtgagggcggcgagggggcgaccgtgtccgaggcgcgcgcgtccccctggtcgaggtcgaggacgcccgccggccggggcggcgccgaggaggcggctcgtcgtagacggcgcacctccccaatcagctccttgagagtccagccctcgtacgggcgaccgcgggatcgggtggcagccacgggcggcaagctctgtggtgaagcgggccgagggggcgccatggcggcgcggcgaggaaggagtcgggagttagggctcgggtgatatcgacggggacggccggggagggcgaaatgggcagggactgggtttagcgcaaaactactacgagtattactagtacttactaatcaacctctagctctaaccctcatccatctttacaacgaaattaagtatgtgaatattttcatattaatgccaaaatgaatattttcaaaatttagcaatgctaaggctgtgtttagttcagcgcaaagtttggattttggttaaaattggagatgatgtgactaaaaagttgtgtgtgtatgacagg

SEQ ID NO: 309 - DNA, 1361 bp, Oryza sativa
ggagtaaagatccaggggtatatatattcccggtgtgccctcgtcttcttcaccaacacttaaacgttttcggccgatcgatctctctcggcctctctccttcgccgccactacctagggcaaatccccgcgccgacgccgccgtatctcgccgtcgtctcgagctcatcgtcctcgccgccgcctccgcctcctccgctgccgccgcatctatggggtgagagccgccgccgcctctcctttcaacgatctccgatctcgatctctctctccgtcggccgcccgccatgagacgccgtgccacgcagacgccgcgccacgccgccataggcacgcccccccgccgcattcgccgccgcgcgcgcaacgccgccgccgccacgccacgccgctgccttcgccgccgcgcaacgccgccgccgcatgcaacgccacgccgccgccgccgtcaccacgccgccgccgccacgccgccacgccaagcgccggcgtgatgccgccacaccgccgttaacgaacacgtgaacgagaacgaacacgtcaatgtacgttgccgtgagaacgtgaacgagaacgagaacgatcgaacaaacgagagcgagaacgaacacgtcaacgtacgttgccgcgagaacgtgaacgagaacgagcgaacgaacgtgaacgagctagggaacgtgaacgatcgaacgaacgtgaacgaacgtgaacgtgaaatgcaatatatatatgttacacggcatttatcctaatacatattttttgtatcttgtagaaaagacgtgttgtcggagtcgtccctcaagccggagtggaagagctagccctagaaggaattcgtgcaggcaagtgacgtaataatataaatgattgttatatttgtaatgcaattaagaatattagacttgtaattagacttagtatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttactatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatatttcttgtatcaacaga

SEQ ID NO: 310 - DNA, 1501 bp, Oryza sativa
accgtttggcaaggcgttttggttggccaactctagccagccagtgagcaagtttgaccaacgggatggcttggccatccggttggtcagtctgttggacctcctttttgtgcttgaatgacgaaaatttggcttggagaggttgatagagaggctgcattcagaagcctctgttcctatcccaggctgtgcgcacggaaaacgaagcggtccattaacgtgtgattaattaaatattttcttttttttttaaaaaaaaggacaaatataattttttaagcaacattcgtataaaaactttttttaaaaatgtacaatttagcagttttaaaagcgtgcgtgtggaaaaggagaggagagagttgggagaacctagatacgggacttgtttggatcctccgagctattaaatagccctccggaatcttgctatttagaagtattaaacgtagattaccgacaaaaccgattccataacccctaggctattttgcgagacgaatctaatgatgtatattaatccatgattagcggctgattactgtagcatcactgtggcaaatcatggattaacatacctcgttagattcgtctcgcaaaatagcctagaggctatggaataggttttatcagtaatctacctaaataataaaattccggagggcttaaaaacaggccacgaacgtagagcatctagtaactgagcggtttgctatcgacacagtacctaataactgagctagttccattttttttttcaagtaccgttgacatatggcccaccagtcatagtaaatttgagataaaaggagtcctcgactatcttctccttcctttcgcctaaaggaaaatctcgcgtctcgtctcccctccttgcgccatctcgcggctgacagggtaggggcgccgatctccatctggcgagcagagcagagcaggcgaggggaggggatcctggtgagcatccacatcctctttccgattcatctctctctctctccccccaccgggagtacttttgtctggaattttgcttgcgttgcgttaaccccagcttctcttgtagatctggaagaagctcttctcttaatttcagagccttaaccttagtagaactaacagtttgtttgttctcccaaaagtttgccggttcaactcaacccccatttcccaagttggatccgcccctgctagtagtaagatctggaagcaaaaaaaaaaaggggggggggggttggatctagttcgcaggagatctctgattatgttgcactgattgaataacctcttctttttttccacttctggcaggtgcataattcttgaatccattttaagtgcagcaattctgagtaccaaaaaatccattcaaaatggtatgcctaatggtttattattctttgtaatattaagaagggacattctgacatttgctcttttgctggtataagcaactagttgattcgtttaggagagcttattattgttttttgtgtaccgc

SEQ ID NO: 311 - DNA, 844 bp, Oryza sativa
tttagtgtttttgagcagaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcga

SEQ ID NO: 312 - DNA, 326 bp, Oryza sativa
attctacgactataattaatctataattaaattctaattattttaaattttctaatcctccttaatttctctctaattttctatttatttttcccttcctctttctctcttctttctttttctttcttttcctcctttccttttttttctccttctcctttctttttctctcttctctttctttcttttttttctttctttcttttcctctccctcttcttttctttttctctccctcccggctcctttctccctctctctctcggctccttgcccacccgggcggcaacggcagtgaacgcgagggggggggggggggcggcggc

SEQ ID NO: 313 - DNA, 1501 bp, Oryza sativa
ccctttggtttaagatcagaataatattaacatgcatatgagctaatctattatattattaaaacagctttgaaatgagtcaccacgttcgctgtgggggctagaaattcccacattaatcggagaaaaagaaaaaaaaaagaaaaggagagtccaagtagaaatacaatctaaaaatagctgaaattcggaattaaaaataagcaatattgaaagaagttcccatataagaacctaatacgagattaatcaaaattagaaataaaaataaaataaaatccaaaattagaaaaggaaaggagagtccaagttgaaatacaatttaaaaatagctgaaattcggaattaaaaataagaaatattggaagaagtttccatataagaacccaatgcgagattaatcaaaaattgaaataaaaataaaataaaatccaaattagaaaaggaaacgagagtccaagtagaaatacaatctaaaaatagctgaaattcggaattaaaaataagcaatattgaaagaagttcccatataagaacctattacgagattaattaaaattcggaataaaaataaaaataaatctgagattagcgaaagaaaataaagaagtgttcaagtaggaaatcgatttaaaattagcttaaattcggaattagaaatagcaatattgaaagaagaatccatataagaatccaatacgagattaattaaaatttagaataaaaatataataatatccaaaattagaaaaactaaaacagagttcaagtaggaatacaattttgaaacaactgaaattcagaataaaaaataaaaacattaaaagaacacaatatggtattaactaatttttttagaaaaaaataaattctgaaattagaaaaaaggatttcaattaggaataaaatttataaataactaaaatttatgataaaaataaagactattgaaagaaaagaccatctaaaacacatgacgagataaattaagtaacatacctataaagtagtagagttggtggcagttaatacagcatataaaaattgttaataaaacaacaaatagaatcctaatgacgattaaaaggagggatatcaggcaggccgtaaagtaaacaagtaaagcggttgccgggacttctagaaagtataaagaaaaaaaaccacattgataatcattttcgatttttaaaatctcaatgacaataaaaggagaagcagcgagcggggtgtataagagtatagttgcagagcctccgacggttgacgggacttctagaaaataaaaaatgaattgcaacgatagttatgttcgatttttagaatcacaatgacaataaagagtaggcagcggacgggctgcagaggggcatagtggcatcgtttgatgagacttctaaaaattataaaaaataaaactacaagtccaatttttaaagattcagaacttctaaaagtaaaaaaaaaaccaatgataatcatgttctattttaaatctcaa

SEQ ID NO: 314 - DNA, 1501 bp, Oryza sativa
taaatttaagacaataataatgttgtaaagtgcttttaagattagctactccctatttaatttatttggctaaaattatttatttagtttttatctcatttgagtgaaaaagaaaaagaaaaaataaaaagaaaggaaggaaggggaaggacgtacactaacgaagtatgtacatacgtgaacgtacacgtacgtgagtgatcgacatggatgtgtggctttctgaattttaaagatgaattaaatatatttggtattttagatctaacggttaaaaatatgagttcaccggattaaatgaaaatcaatggttagatgttttaaatgccacttggcagcctagaagcgtttgtagagatgccatgtggcagtttaggagcgattgtaggaagtttaatggacttttagtatataatagatagatagatagatagatagatagatagatagatagatagatagatagatagatttattctgaaattcaaaattgttattctgaaatccatagtagtcactaacatttattcgaaacaatgtttccatacagaaatagttatgtagtgtgcggtcatgttcaattaataatagcccatgcgaatacactgactaattaattaacgacttggctcgtactcaaaaattatatatcatcatccatagtccatacgaagatcttgctctgtgttgaggattacctgacttcaaagcccatttagaaatatacaaagaaaaattttcgattcctgctcaataaattaagatactccagaagtcaacgaccctccccaaaactctggaattgtgttgacagctgccatgatttcttaaccagcttacccgcccttgaacgtgcattgcattaaggtcaacacttatgaacaatctggtttacatcgtagtatagtataagtgaagtatatagattttccaatgcacacccagacgatcactggtattagtttctattattattatattatcgaggaccaccgcatattatgatttcttgatgcattaatggtacgtgtgggtgggtgcagtaaacaagatcaacacttacgaactaatctaaaatgcaccgctagtaactcaactcgtgaggtgggtgtaatttagtcacccatcttgtaaaatgctcgaataagttactcatcttatcttgtttttagggtgcaaatcacataaaacatatgttgtgtagggtgttcgcaatgaagttacgtgttgtgttgatttgttttgtaaacatgatcacacgatctataaataagccaacgtgcaatactaccggtattaaaatccaattaaagatgaattttgttattgattattaagcataatatggtggcgttcattaaaaacatgagtattaggatatacataaaaaatatgtgtattaatttgtaattgtaatgcttgccctgctcacatagctaaaaaatgcacgatgttaggtcaatacgacctccaatttgaaaacaaacaatccatgtgacaa

SEQ ID NO: 315 - DNA, 272 bp, Oryza sativa
gccacagcccggcccctactgcatttcccctctccgcctccggaacaccaccgtcacgcgcaccacctctcttcgccgccgccgccgactccagccgcgcgccaccaacactcccaccgccgccgtgctgcgccgtcgcgcgccgcacatcgtcccccatctcctttccccaaatcccccaccaaaactccctcctcactgccaacctgagaccgccgccgctttcgccgcctcggccgccgtttaccgccgctcccagccatcccgagcca

SEQ ID NO: 316 - DNA, 1501 bp, Oryza sativa
agctcatcatccagcaatgtatacttcaatgccttatatcgtaattttctagaagccgattgggaaggattgctcaaatactgatgcacatcatacctccaatcattggctgatattgctgcaatctcaaccttcacatccttgatcatcggcttataccccgatgccccttgagtcaaatcgttagcgtcaagattttgatctcgagatacatgcttcaaagtaaccagccgaaactctttcattaactctaagcacttctcattataaaccagcaatgtatcattcttgcattcatattcgcccaccaactggctgattactagcaaagaatcccccatgatttcaatagtatcggcttcaacttccttgagtaactgcaacctcttgagcactgcctcatattcagcttgattattagttgcatatggtttaatagtataagcaaactcaaaacatgccccctaggggaaattataaccaagccgatgccacaaccatgggtgcagaccgatccatcaaagaataaagtctatggcactatttcaaccgagccgatcgaattatcacgatgttcaacaatgaaatcggctatagcttgtcccttaattgccttcggtgattcgtaccgaagatcaaactcggttaaagaaaatatccattttccaactcgcccctttaatatcggagccgatagcatgtatttgattacatcggctttgcatataacagtgcactcattagataatagataatgcctcaaccttgtacacgaaaaataaaggcacaagcataactctctacaggagaataccgagtctcagcatccaagagccgtcgactaagataaaacacaactcgctccttcccttcaagctcttgaaccagaaccgagccgattgacttctcaccagccgataaatacaatcggaacggtattcccctctgtggaggaatcaaaacaggaggagagctaagataatccttgatattatccaaagctttttgctgctctaccccccaagtaaattgctgatcggctctcaacctcaataaaggcatgaaaggttccaactttccggataaattggaaataaaccttctaacaaaatttatgttgccaatcatctcctttaactcggttttattttccgggggtttaatcctctggattgcgttaatgctccgctgagttacctcgatccctctttcgtgaacaagaaatcccaaaaactggccagccgatacaccaaaagcacattttgtcggattcatcttcaaaccatatttcctggttctctcgaagacttatattaaatcggctatatgatcagcaatttccttagatttaactaccacatcgtcaatataaacttcaaccaacgagccgatcaaatcgtgatatatatagttcatggccctttgatatgttgccccagcactctttaggcccaaagtcataacaacccattcaaataagccgattgcaccaggacatcga

SEQ ID NO: 317 - DNA, 1501 bp, Oryza sativa
tcaattaaactttttcaaattaaacgctctcagaccgtcacgtggtgctctgataaattaagggaataatagaaattatgagaagaaaagtaaaacatccgtccaatgatttttatttaaattgataggtctaatattataaaccgttaatttagattaatcttcaaacggaccgcacaaaacaactacggtctcacctctcctccttccgcgtaggtacgtacatgagcgtacgtacaagaccgaacaagacatccgtttcttctgcttccctcctctcaggaatactcaaatacaaataagtatatagtagtgtgtcttatttctggctaactactttgtaaaggtgaggaaagttaatgcaaaatataaatacactgtgatcatgtgataggtaattatgtatacattcatgtagattatatcgtcatatagctcattccaaatatacgtaactaaattagctatgtaatacttaatatttaaaaataaagtttacaccattatatatttaaccattaactaaattaattatctagttgtgaattaacttacccacaagaggagtacacaggaataagcctctccccattccatttcttaactcgactctcttgagttctacctagtttctaccatactgtatgttatcattttgaatcaagtaaagttgcgttttgttttaatttgggttagctttgttccttgtcgtcgcagtgaccggccaaccttatatcgagcaccttgctcgtgctttctccaggccaggccgtgagagatgggaaccacatcaaaaaatactaaaattacttaagctatctcatttaaaaatgtacccaaaatttatatacgggtcagtgactagggtagattagtctgggaataaaaacaaaacaaaccaaggcccagtctgatttaaattgttgagtggattatagttatagattttctagtgataaattaaatatctattatatactaaaagtcaattaaactttctacgaacgttctcaaaccgccaggtggcatcctaccaacgttcctaactcgctacatcgcattctaataaataacaaaaattcctaagaaattctaaaaaaaaaccaaaacatctgtccatccgttttcattaaaatagttggtcccattatttcaagccaacagatttatctaaaaaatctttccacctccacctccctcctcccacacgtaacatctcttccctttgtacgtagtcacgtaccatgtacaaagaaggttatatatgtacgtgcagcccatatatgtgtcctccttttctctctacaccctattttatagctagaaatttaactaagcatggcgagttaaatggtaatttaatttagaattaaactgataacttaagatcaataaaatccaaaatatttcaagggttaattggatccataccattgcaaatttgcctattccgaaaaatgtcattacaattcgtctattcttaatcgtgccattgaaattt

SEQ ID NO: 318 - DNA, 827 bp, Oryza sativa
gccacagcccggcccctactgcatttcccctctccgcctccggaacaccaccgtcacgcgcaccacctctcttcgccgccgccgccgactccagccgcgcgccaccaacactcccaccgccgccgtgctgcgccgtcgcgcgccgcacatcgtcccccatctcctttccccaaatcccccaccaaaactccctcctcactgccaacctgagaccgccgccgctttcgccgcctcggccgccgtttaccgccgctcccagccatcccgagccatgccgtggccacccccagcgtcgctgtgttgtgccgcacctcggccgctgcccctcgctgccggaatcccacgggagcccgcttttccccgttcaaggtgagcttcaccattccttgccgcctccggccgctgttttcctcggcaccacgccttccccgtgccacctaaactctctatccccttccccagggtcccggaggtccccggccatcactcgtcgcccatcggccgccgttggagcaccaccgctatctcgcctccgtccggtgccgtgccgcttggtgagcatctgtaacaccctgaaaattcgaccaataaaaacaaaactctaaaaatacggaccttcgaaaactttttaaattaattgcatcatgccaattttattcgcctattttatttggatttgatttcgaagttcattaatcgcaaataaagaatagttaattaggaataaaccctaaaaataaattggcaaaataaatataatttaaaataaatattaggtaaggatagaaataaataaaatattattgcgaccatatttgtatgaatta

SEQ ID NO: 319 - DNA, 1501 bp, Oryza sativa
atccatcgcctctgagtttgtggatgttgaggggacacacagccaagctccgctgcgtggtcacctgggaggtggagggattggaggtgttgcctggcgaccgcgcatgaggatggagtggaggagcaacggcagatggggtaggtaggaggaggaggaggaggaggtggtggtggcatggaggaggagctgacggcagcgaagagtgcacgttttcacgatttgggagtggagacaacgaggagaaacaatttatttttttggttagggacgtgggaggacctctttacaaaagaagtttcttgaaggggaacgaagatatttcgccaatctaaggatctaatggctagcaatgtctggaggaaaaatcaaatggtccgtattttaaagatgacatggacatgtaatcttgcaagaaagtttccacctttcacttatttagatttgcagtagtttgcataaacaaaacattgttcttggaagcacgttgttcatgagaatctaattaacaagataacctatctataactatagtcgtatatccgtacggcgattcaatatgacccagcagctatatttagaatatcactagagaccatgaactgttaatagagatcaggtctgagcttacatttctagtcaaggaggttaaatgcctcatggctggaaatagggaggtggtggtgtcgaaaatctatcgtgatcagaatcgcattagccatatcttagctaatagagggaggtgtgagtccttaacggccttttggcctgatgattcttgtaatttcatctcacaccttgtcggtgctgactctatagcttcgtaatatatctccctttccccgaaaaaaaatagatatggtgtgacataattaagttctgttttaaggatacaaccactctaatacgactcctgccattacctaagatgcacacaacctccactcacaaaaaaagaagaagaagaagaagaagaagaagaaccacacagcctagcattatttaagaaaaaacaaatatcatgccacaacaagctacagccacaaacaaacttcattctcatgctccaccaaagcgagcgacgcctcaactatgataaagactcgtaaaataacgcctccaaaaggtgaacaatgcatatgtacaccccgttgttatcaacttgccatgatccaatcagcaaagactagaccataagtcacttttagacacttttaagttttcatcctagagagattcttcgaactctagacaatgcattaaacaaggaagacaattttagacacttttctctaatacaccttttgttctttatgcaatcaattaaaaaatacttagttaaaatcaaatgcctacacgtgtctccaaaactgaaataagcacacaaatgaaaaaaaaaacagaaacaaataatataacgttattgtctttttaaactttatcacatgttatttatttaaataaatttcacaaaacgacatgtactttgaccaacttattg

SEQ ID NO: 320 - DNA, 1501 bp, Oryza sativa
caaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcggccccccacagtagaaaatcgccctagcggagggcggcaaggggtccgcctgcaaaattccatgccccccctcgccgcccatttgcaggcggccccccgcacagtataaaatcgccctagcggagggcggcaagggggccacctgcaaatttcgttgacggccgtcgcccgagagcgaacggccggctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattctctaaacgaatggctcagatcgatcccgcgttaggccgaatcactattgggtcgcgtgcgcttcatgggccgcagcaggtcgaccggtcgaacaaaaaaatttaacttagactttcggttagggcccacgcggcagtgagagatgaagtagggggagttcattagacttatttttgggccggacaagtgtgcggttgaggcggaggagaggagaagggaggaaagcgggccagcttggctgcgggctgtataaaaatgggctgaaaatgccccaacgagagagtggaagatttctattcaaataaatattgcaaggatgttagtattatgaaaattagcaattaagctacgcaaattccaataaaattccaactagcataattaatcacggagaatttaataaaattaattttaactataccattttatttctcgcacttactttacttgtaaactaatttaattatacacctacctacttaaaaaatatcgaaatttgtatttcaatgaattacataatgtaaatatttctcaacttttcctcaattttttagtctttacaattcccgttgcaacgcacgggcacttttgctagtaatctataaaacatatagtagtcggacagtttttttcccttttgggggctttcatgggatggcgttttttccctttttgcgtttttagctgtcttttctttctcacggtgttttggctttttttttttggtttttcgccctatttgtgggctttttaatagacgcgtttttttagccattttctttgaacggagttttgcctcttttttttttccggcgtcttttttgtttttttttggccgttttctcagggactatagatggcca

SEQ ID NO: 321 - DNA, 1501 bp, Oryza sativa
ggtcatatagcaaaggattaaaacgacgaggtagctatttataaggcctaaaacccggtttaattagaaaccgatgtataacaagttcacggctaagatctggcatctcatgatactctcatgcgaagcaatcaacatactccttaagtagctcgattattttaaccttataatcggctctcatttttttgtttacaaaagtcggccttggtttagttccatcacctatgtctacttcctccaacggatcggccgatgtaaacccttgaccaagcttttctactttatcaaaatcttcaatagtttcaccaatatcgttttttgtagaccgatatttttgcaccctcttttgcaaccactctaaattagcttatttactcattgcacaaagtgatatggcctagccgtgtgtaacaacccaaaaattagccgtctgctaattttgcatcatgctgattcttatgttcttaataaccttctaaacctaggaaaatataattagcgggacctcctaaaaatgacttgtacgaaagcctctatggtatttaatctcttttgtgtttttcatttaaaaatatgttttggttaaattgaggtatttcttgatttcgttcaaaaccttcttttgactaaaattccttttagtcaattttgcttgaaaacccctttttattatttttatgaattgtggtccaagaaaccttcccaattttgcccttgaacctaaaccaaaataattccaatctcattagaattatttgttaatccatcctttgattttaaacctatcctttgattctcaatccaaatatccaaattcctcctttttgatctagccactaatttaatttctgtggtttgatttccttctcggcacaagaataaaattattacgaatattgtgaataattgctcttgtgctaagaaaatagattatatctttgtcatccaaatttactattagcctcaaacaattctctgaaacccatgccatatattttgaggctaaaaccctatttatccttctccaattatctttttcccaccttcctatttacatattaaattttattcatatatctctcaccctttcatttgagtgcaccaaataaattccattatatactacttctaaaatattgcactcaaataattaggaaatctctctttgaaattatctccaaaataaattcatctcaaaggttagccacttaaatttcttccaaatattaatttggattcaaactccatccgtcaattccctacacaaattagaaagcctttctattcatttgggccgaattctccctctcttccttcggcccagaccggcccaattcagccgagccgccttcctccaggtgcgcgtgccgtgcacggcgcacgccgccgccaaccgtcgtcgctaagaaatcggcgacgtgcttgtcttctccacgtcgccgcagccgtgtcttcgtcgaccttctcctccgaaccgcctctctccaccgccttcgat

SEQ ID NO: 322 - DNA, 1501 bp, Oryza sativa
aatacccattctacatctcttctctcccacctcactgacatttgggccccacacatcatcccctacctctttctttctctcgttacctctctcgtggtctctccttttccatatgcctgaggaaacatggcatcgtggaggactaggtggctagagggggaggggtctcaccgccttgaagataccaacattgggttgtgtgcatctgaacaggttgtcatgggggaccttttctcgtcggaagtggaggacgggcttggagtgtgcaaagtggaactaggctggtggagggcagcgacagtgggtttaggttttaggttcagcgttggacaatgatgacgccatggaagcagaagagggtggaggagatgttgtccaagaacctggtggcggagctatgcctctccaggctctactccatcgtgccaaagattagcaaagtttccttttccttcttcacttgcaagattgcctctgatgaaagtgattgtgttgcaagtagatggacagatgaagataagggctaggggcatttgggtagggggcgggggaagaggaagataaggtttacttttggcagaactatgcctctttaagctatatagtatgcaaaaagatactagtccaagaacatcctagccgtatataatggccagtctaaattttacaaaatacaagtggcactgagctagtttgatgaacattcgcgttctcgcaacgagtacgcacggcttatagcacaaactgatgaagatgaacaaactagctaaaaactagacaaaaagtagatgcgaaatcaaaagagcgattcaattggttaattgtgttgaagtctattgttgcctcaattgaaccagtcatgaatcttataaagaggttgatcttgtcttctataaaaccctttcatggattactcggatagaaatcaattagaattcgaaaaacttaacccaaataagaaaacctgagactggttaaaattagatttagagttggagtcagtcggtttgaccagccacatgctgctgattagaccagccctatggcgacggtcagatcggtctcgtgttggcaattcagatcttttttaaaatcgatcatagttttctatttcgtgtgtagatgttaaatttagggagaactttactccaccagtagattggttgggttggggttgggtttgcaactttgcatagcgtcgcataaagaaaaaaaagatcgatcgggattaaaaagggaaaatagaggaagaaatgactcatctgaatctgagagtcgtgtcagagtggagaggaaagagcaggagttgaccatgaactagtcaacggcaagcactgtggatgctgtggaatatccatgtgtttatgccatttgcgtgccttgccggcgcgcaagtctttgacatgctgcaattaattgaggaggaaagctcccattagcaattgcaatccccaccgagaaaattgacccaaattgcccagccaatcgatccatccatcca

SEQ ID NO: 323 - DNA, 1501 bp, Oryza sativa
tagatgaaagagagcatgcgacgtgaatgaggatgagcgatgcgctacttgagctgagcaacgatctgtacattatgggtgggcattgtttgtggggtggggggggggcggatctggggcgcggggttggcatgagattagcaagagaggcgcgcaacaccgagtccggaccaaaattgttgtgcgctggcggaattgatttgatggcgggacgaggcggacgaaacctagatccgacgaacagaaaattacagattttttaagtaggttagatttgtaacaagtgcagagtttaaaagaggcgtcatagtggaacagtcgtactctgcggtttttcctttctcttcgggggcgcaggtcccggctagcgtccctctcgacagtataatgtcgatcgtgtaaaagttgtaataccctctttcttcttaataaaatttggcgactcatccttcggccgtcctggcaaaaataaaggaattaatgcaagtgctaccaggaagaggcatcgatgataaacagattgaaggctgcagcctacttctccctactccgacctcttcctccttcctgctgatttcttctctccaactatgttctttgatttcccgttctctacttctcttcctaatctacttgcttgttccccttaattgtattcaatacttgagcagtactctctggatcggttattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttagatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgatttgattgtgcaagtagaagggaaggcccaaagatagttggctttgtgatatatgaagtgacgacgctaagattgggatggttgttgttgtgatgtgcatgggatggaatctgctagcgtggctgtggatgcgtgcgatatgatgcagcagggagggaaggagggagcgagcattggtggaggcagctgagccaagcgcagcccatccatattcctgctttttcccctatcgatgacacacatacatgtccatctaacaagtagacgtactagctagtagtaggaacgtgaggaacgtagccgtcgtcccagtcacacgaacacgcacacgcacactttcattcgtgtgtgtgtgtggctctgcttgcttctcgttagtattgtccatcggatcggtatatatatataagttgctgaggaagaagctagctagtaattaagaagaggcggagctggatcgatctatcgttgagttgttattgccacacaaacacaaacactgacgcccatggcct

SEQ ID NO: 324 - DNA, 1501 bp, Oryza sativa
taaactactatgttgcatggtggcagtactggccggcagatatatatgtatatataattatataaaggccaagtcttacatatatacttaattaaccttttgctgttcgcagataagcttgttagatatatatagttggatatatatatattagtagttcttttattacactgaagacatgcatgccaccataggtacacacacctgagaaattaacagtctcctgattaatacgtacgtatttagagagagaaacgaagactaacggccaatacttagtctcactaaaatgaatatcctagctagttgatatgtatgaaatattcgttgatagtatatattgggattgaatcctagtgcaagggtggaattaattaattatatgtacggcgcttcaccaccatgcatataccgggcggggtgctttaatcaatgatgctttgcatagttaatcgtacgtgtgacaagctagctagctagagtagattgatgaaaactcctatatcagtggttaatttattgggcgatcgaaaatgaatgaagaaataattaagatagagctgggtaccaatctcgaagaggaggccggagagggcggagcagccggggccgccggtgatccagaggatgagggggtcatcggcggggctgcgctccgactggatgaagtagtagaagagctcaacggtattggtgttgtccacctccacataccccgtctccaggtggaacggcagcctcccttggaaccccttcacgtgtgttatcacgttcctcgcccgactcgtcgtcggcgccgatgccgcccatgttgccgaaaccagcagcagcagcagcagcagcgtcgatgtggccctggtagtcgccattggtatcgacgatgagctagctagcaaatgcatgagccagggcagcaggggcccccttttctttcttaaataaaggtcctccgtccgtccgtccgtccgtctttgtctggctaccatgctcttgtccatttcttaatttaatttatttactgtgcatgccgcccggccctgtgggacaataattaaattaattgatttcttcacgaattttattaacgagatcgatggacttgtttacaagcactccccccacacacaaaaaaaaaagcagtcaaaaaagctttacactggagatgaagagaagagatcgaaaaaggtaaaggtagctagtgacccggggtgcatatatgcggtcagcgattgcgtgagctactccgtccgtttcctttccctactgcgcaagagtaccaggccagctctccagctgatcgatatcatatgagaggctgcgacgcattgccgtcatctaacttcaccctagctagctgcaccacacgtacacgaatctacctacctactgtaagctattagctactgtacaactatatctcctctcgatcgggacacatgcccagcatgcttctcaactctttccaaaatataacaacatttaatattaaaaatttatctca

SEQ ID NO: 325 - DNA, 1501 bp, Oryza sativa
cttctatctctcaaacgatagccaaccaatcacgggtagtgaacgaataaatatgtgcatacaacacagggaaaaggaaagaggacacgcaaagaaactgtgcggctaataacgaagcacagaaatcatcaatgaatcggacggtaaaaaataccgagtgatttttagccaaaaaaaaatctgtaaataaatatttagcaaaatcgcaaaatttttggttttctaactaatactccctacatttcaacttataagatgttttgactttagtcaaagtcaaactgctttaagtttaatcaaatttatagaaaagaatagtaatattttcgaaccaagataaagttattataaaatatatttaattattaatttaagaaaactaatttggtaatgtaaatattactatatttgtctataaactttgtcaaatttgaagcagtttaattttgaccaaagtcaaaacatcttataacctgaaacggagagagtaaggcataaaaataagagaatgattagataaaaaaaagggacgtgactatgacaaaaccatcgctagttaggcataatattctgcgacctcactttagttgctactactagactcaatagtgcatgcttttctttttcttcttatagaattttctctcaaattacttatccgatccataattcgattataccgttgtgttgttataattaaatctttacaataagattttacatgattatattctgaaaaaaatatctatattgtaaattaattttaatatatatgtaggttacgtttatcatatatataaattacttttagatttaacctctttaataacttatatattttaaatcacatattgttttcaagatctatttgcatcattgtactctatataaaacatgtgagaaaacaagatgcacgttgaatatattcaaacaatttattaatttaaaagcaattcattgaaattgtagaaataacttagctatctaacaggagtaactttttgtagtagaagtaattacatttgtgactgagttgaaatgaaacagtaagtagagtaaattcacaagtaaagcgtagagaatatttttaagtaaatgcatttatgaaagtaaatttaataaagtctaaaaataaatttaataaagtctaaaagtaatttacatcaatcataaaaataacttagcacaaaatgaaaataagttgttacaacattagaagtaaatttgctgtagagagaaaaatatggtctatgtaaaaattaaatttaaagtccataaattattaaattaacttaaaacaataataaaaataatcaatttagagtattatgaatgtataagaagtaatttagtcaaatctaaaagtaatttatatatatgataaaagtaacttacgtatataataaaattaatttacaaacataaatattttttcatcgtaatataatcgtgtaagatctttgatgtaaagatttaattgcaacgaatacgatggtgtaat

SEQ ID NO: 326 - DNA, 452 bp, Oryza sativa
taaaagcttagttgggcataaatgacgaaggaaatataaacgtataaataacaacatgaaactataaataactttgccgggaatgataattcaatatcaggaaaattatataacttaatcatattttcaaatttagctataaataatttaatatagagaaaactatatgttacaataatttttagtggatcaaatagtgctaaatctaataatataaatgaaaaaaacaacttaaattagttagaaattgaaaaaaaacttattttagcccacgtatgaaaatctgattcattaattctgaacgggtgcttctttcattgatataaaatagaatttttcatgttctattcatactccatttgtcttaatatgatgtgagtggtccaggagcatggttgggtagactaagaaggaataatgcccaacagacgttgttcattgttttccctagc

SEQ ID NO: 327 - DNA, 1501 bp, Oryza sativa
atcagtagagtcaatttcgcttatgtatatttttggacttttccgagaacatccagaacgatgttgttggtactggaaattttccgacttgtccgaaaagttttcggaatgtccgaaaaatccttcgttgactttgctgttggtgctgagctagaattttcggacatgtccgaaaatctttcggaatatccgaaaatctcaattattgtgcataacgggcaaaatctgggctgtggctataaatagccccctcccctcacttgtgagggctgctggttccattccaatcatttgtgcccttggcttgctctctctcactagcacttttgagccttgctttcttgtttcccctctcaccgatgtttgatttggatttggtgtgtgtgtgagagttgtggattcgagtttgtgtgagtgcttgttgttgacttcgtgaagatttgtgagcacttgcatcatctccgggagttctttgcttcatttgttactcttggaggttgaggacacctaggcggctaggtgttgctcccgagccaccgatctacttgtggttggccgggagaagtttgtgaaggtctatctcacctccgaataggaagagatacccttagtggaaggaggagtgcttagtgcaatctcttgaggaaagggttagctaagacccggctcttagtgagctcctcaacggagagtagaatcccctcaaggattcgaacttcgggaacaacctcgtgagcttcatctttggtgactttacttcctccctctccactagctttgcttgttcaagccgctataggtctagttgctgtttgtgctagcatattcttgttgtaggcaactagatctaggatttactttgcaatttgtgctaactccgaaaattttcggatatatccgaaaatttcggaaatatccgaaaattactgcttccgcttttaattgatttttgaattagcctattcaccccccctctaggcctaattgacactttcaatctccctagtcttacttggacaagggggcatatatgagtataaatacaagcccccctaggaggagaggggacacgccacaacgccagaaagccacaagccaacacacgtcgccagatatcaacatcagagataagtctagacatacaccatccggctcctatggaggctggcaagagggatctagcaccatctctgatctcgccgagtacggattcgaggaggaagactactctgtcgtcgactacgggttggttatctagccgcctagtcgacgacgtctagatgagttatcccaattattgtacttgtgtgattcagatgaataaaggagcaacaccagctgcggccaacaggatgtagggctattacctgtcatataatgggcccgaacctatatagaaatccctgtctccatctcttttacctcaatctcgcatataccctggtaccaacgatccccataccatctaaataacgtagtcgcgatatcaaacgtcgacaga

SEQ ID NO: 328 - DNA, 1501 bp, Oryza sativa
cccgttctttatccttggtaacctttgcgagggctcttaatctagactaaaccaagtcctccctttcatcggccataaggttacaatactcatcagctgttaaattatcttgcagctcagttctgcttgagccgattctaacctcgcatggcaaaacagcttcatgtccataaacaagcttataaggagggacttggatcgatccatgacaagccatccgataagaccacaacgcttcagccaaccgagtatgccgttgccgaggataatcagaaatctttcttttaatcagtttgttcaaactcttgttagatgcctcagcttgcccattagcttgtgcataatatggcgaagaattcaacaatttgacacccatgctgtcggcaaactgaacaaactcatcggatacaaaaattgaaccctgatcggttgtaatggtttgagggataccaaatcgatagattatatgttcttgaataaaatgtatcgcatccccagaatcaaccttcttcaagggaatcgcctctacccatttggtgaaataatcggtcgccaccaatataaacttatctcctttactcgatggaggattaatcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatcggctgttattgctgcgacctcgaccttaacatctttgatcatcggcttataccccgatgccccctaggccaaatcattagcttcaatattttgttctcgagatacatgcttcaaagataaccaaccgaaattccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcatac

SEQ ID NO: 329 - DNA, 1501 bp, Oryza sativa
catgacaagccatccgataagaccacaacgcttcagccaaccgagtatgccgttgccgaggataatcagaaatctttcttttaatcagtttgttcaaactcttgttagatgcctcagcttgcccattagcttgtgcataatatggcgaagaattcaacaatttgacacccatgctgtcggcaaactgaacaaactcatcggatacaaaaattgaaccctgatcggttgtaatggtttgagggataccaaatcgatagattatatgttcttgaataaaatgtatcgcatccccagaatcaaccttcttcaagggaatcgcctctacccatttggtgaaataatcggtcgccaccaatataaacttatctcctttactcgatggaggattaatcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatcggctgttattgctgcgacctcgaccttaacatctttgatcatcggcttataccccgatgccccctaggccaaatcattagcttcaatattttgttctcgagatacatgcttcaaagataaccaaccgaaattccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaag

SEQ ID NO: 330 - DNA, 962 bp, Oryza sativa
cataataaactagtcctataaatataagttttttttaggcgcctcaaaagattagattgtaaatgccttttgaacaatgcttggagaaactatctgtatggtctcaatttcttaaaaaaacattttgaataaaaaatcagaagcatataactcaacttgtcaactgtctaattccctcaaattataaaatatagagtaaatttcacaaaactataggtactttaatcaatctatctgaaaactacagttttaaaaatgcatatcatgaaactacagatttaaggtatcgtatcagaaaactacgtatttaaaaccagttttatcataaaactaagacttttgtaatctcaattgtgatatggatataaactccaaaagatgtagttttctatgacttcttcactaaatatgtagttttgggatacgatatcctaaacatataattttgcgataaatttggggttaaatatgtagttttgtgatacatatttctatatatgtagttttgtgatagtttggtgaattcatttgtagttttataaaatttactctaaaatgtatgcttttatggccatcagcctgtccaatacgccgaattggctggtttggttcacctactcgtttgcacgtatcaattgccagagcttaatcacgtcgtctagctgcacgtgtctctgccttttttaaaaaaaatttctcgactgtttgatggcacgagatggtcgcgatttcagcagtaattcgttaccggtaggagacattggggcctcgtagtttactctgcaaccttatcaacctctgtctaaactttaatttgaagttaattttgagtattttcaacgtagtcttttttttttaaaaaaaaattagcttttaagctgctaagagcttatatatatatataagttttatacatcaattatttttttattactaataaaccattacaatttataattagt

SEQ ID NO: 331 - DNA, 1501 bp, Oryza sativa
  unsure (1)..(1501): unsure at all n locations
cgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatnncgctgtattgctgcgacctcgaccttaacatctttgatcatcggcttataccccgatgccccctagcccaaatcaataagctccaatattttgttctcgagatacatgcttcaaagataccacccgaaaatccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaagagccgacgacttagataaaacacaactctctctttcccttcaagctcctgaatcaaaaccgagccgattgacttctcaccggccgacagatataaccgaaaaggtacccccttctggggaggaatcaaaactggaggagagctaagatattccttaatatcgtccaacgctttttgttgctctaccccccaagtaaactgttgatcggcattcaatctcaacaatggtgtaaaaggctctaatcttccagacaaattagaaataaaccttctaacaaaatttatcttgccgatcatctcctgtagttctatcttgttcttcggaggctgaatcttcttgattgcattaacactcctttgagttacctcgattcccctatcgtgaacaagaaatccc

SEQ ID NO: 332 - DNA, 1501 bp, Oryza sativa
gtgcgctgtcgaacgccattgtctatgtctcgctgtcagtctgactatctgacatgttgtcaggcatagtccaatcggctacgaaatcggcgaggacctaggacttaatagctgttcggggcacaaagtgaacatcaaactggctttgctcgactacccatttcgcaatgcggccgacgatgtctttgtttctcacgacttctgtcacgccctaaaaatcctaaatatataaactgatgtttaattggaatttttagaaattatttttaaaagcctacaaactaaaccctaattttctaggaaaattttcaacataaaaatgagctagataaaattttattaaatactatgcttgctcctctattttctagatttttctgggaattatttgagcaagggaagtatttttaataattgaaacaacatttcacaaattgtttttattttaaaaagaccaaaaatcccctcctttaagccgttgggccgaatttggcccaacactctctctctcccgcgcggccgaagccggcccagccgagccgcccgtgccctcctctcgggagaccgacatgtggggcccacatgtcggatccatctcctacctccagccggcggaagccgagcccgagccgcccttttccgcctccgattccgctccaatccgaccccgattcttccgggtttttgaggggttttgttcctctcgttctcctctatctttcccctcaagaaacggagcaatccgttgagtatcttgttcgaatcaaactcgttttcgagtttatccctaaaaccgagtttggatttttcccgagtcgattcctctcgtttggagttcgatctcttcaatccaatgctatatataggaccacatcgtcgccctctttcgtttgccccctctctcgtcctctcccgtgcaccgtagcgccgccgccgcgttgctttagctcgccgccgccgtcggccttctccagccgcgccgccgcgccgcctccaacgtcgccgccgcttgccgtcgccgccgttaggtgcgccgtggtgaggggaacctcggccgcccgtcccccttcgccgccaaccaccggagctccaccgtcgccgtcaagccgagccgccgccgccgtcctcttcgtcgccggccatcatcgttcgtcgtttgtcgttgtggtgagtaccgttgggttcgcctcgtcgtcctctacgtgtacatgccctccaaatccccggccaaggtctctatctccggcgagctcgcaaaccctagccagctgccgtggggtgacgtcatgctgacgtcatcatctccttcttttttctttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttag

SEQ ID NO: 333 - DNA, 818 bp, Oryza sativa
cacaacccaccttaaccaggttttaattatcaattaattaacatcacacgatttaccatcgtgagctaccatttaatacaatcatcattattaataataatataacatagtttataattaatcccttaagttagctaatgtttctaagcatggctaagcaaacctatatatagcatttagctgaaccaaaccaatatataaggttcatgctagtcaaattataacccctaggaaaataaagccatcttcggccaataattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaaagaaaaaagaaggagatgatgacgtcagcatgacgtcaccccacggcagctggctagggtttgcgagctcgccggagatagagaccttggccggggatttggagggcatgtacacgtagaggacgacgaggcgaacccaacggtactcaccacaacgacaaacgacgaacgatgatggccggcgacgaaga

SEQ ID NO: 334 - DNA, 1501 bp, Oryza sativa
aggaacatcgaatctacaccaccggtacttacaagcaagattatggatgaactccaattgtgggagttggcgggtgctaagggagtgcagtgtataatgtcgcgagaataggcttgttttaatttctactcccttcatcccaaaatataacaacttttagttcttaggatttgtcccaaaatataacaacttctccactaacattctcttctcaaccaatcacaaccctccaccattcacttttcccacctacctctactgctcatccaatcacaatcctccaccattcacttttacctaattttttaataaccgtgtccaactttaaaacttcttatattattatgggacggagggagtagttacttgtgggagacatttttgttctaggaatgtcattcctgctcctgtatggttattctcttccttctataatataaaaccagctttgttgggttctttaaaaaaagatattatattattatatatattagtacctcttctctatcaatatatacgaggcaaagcttttgcccactttttttaaaaaaaatgttatatttaaagagatggatataacaaatttataataaaagtcattaacttgattagaatatcggactgaaccaataaagtccaaactaatctgatgtgagtatgtaactttaagcaacaatgcataaaaaattagagacgacatataagataggcaacgcttgctttagcccgaatagagcatcggacctaaccgagaaagtcctagcaacgccaatgaaagcgaagatgacggagctcacttctcgtcggagatcgaacttaaccgatgtatcccccctcgaaattaactaagaactcgccgggataaaaagggtggtgatgcgttgaaaataattgtattgatttatgaagattgattaaaacaactttggttgtacatatttatacctccgggttgatactagtcttgatcggacacaatataagttttctaaagataaaaataaaagatataagtcaagatcagacactaaacaaaactttttgaagataacagaaaattactaaattatgtccaattaataggtagaattaaattgccacactatgatcttcacgattccttccggagattggtctcttctgcataggtttacattagttgatcgacttctttccttacatttttttttgagaattacacagtacaacacagacactcacaacgcacgtgcactcacccctatgagcatcttcgaagactgggccggcaaatcctggagagattgacgaagtcaccacaggcgcctcgctgtcgacgggtacgtcgtctaccactgaaagcacaacgccattaaatcctggaaaattcgctcccatggggagtcgaacccaggacctcgggtgctactgaggctcttgtaaccactaggctacaggccctttcgctctttcccttacctgaatgcagtaaaaaaacataccatattttggcgttaataga

SEQ ID NO: 335 - DNA, 1484 bp, Oryza sativa
ccatacaagcatacaatttagaattaattaaaattcggaattaaaaaataggaaaactaaaattagaagttagagtccatatagaaatacaatttagaattaataaaattcaaaattaaaaaaagtaagattgggagaagtgtcatagtctatatatgaatacaatttataaataactgaaattcaaaattaacaaataagaaatcttgaaaaaaaagtccagcatctatataggaatacaatttagaaataactaaaattaaaaaaatattgagaaaagaagtctagagtcaatataggaatacggtttactaataattgaaattcaaaataaaaaaaaatattgaaagaagagtttagagttcatatagaaatacaatttataaataactaaaattcagagctaagaaaaaatgaatattggaagagtagtccagaatccatataggaatataatttatgaacaaagaaaattcaaaatttaaaataaggaatgttaaaatatgattcttgagtccatatagaaatataatttataaataactatcacatatatacaatacaataaaaatatcacacatttgttagttcaaccaagaatttaaaattatgttgtcaataataaaatatgaaaatatttaaactattgtatgagaaaaaaaatctaacaatgctagccgcgcaatctgcgcgggccgccatgctagtttagataaaacaacatgaaaacttgctggtgcaggcgtgcagcgtagtaacattttcttctttgaagacgtgacttggatctgctagtcaacgaagaacaagaattaatctgtagtttctgtttctatactcgactagtatctcctctgtctcaaaatataagatattttgatcgaacggaggtagtagcttcctgcagccaacacactatactcgagctatgtattttttgtcctctcttttatcaaacttgcagcaactaggagtatgatagtgttggtgataaagaaaccgtgggcatagaaatcactactctctcaccaaaattctctaattctaggtagcaataatttggtacggagaaagtaaaatgctcagcttgcgctagtgtggtggtctggtggaggccgtatagtagcaatagtagcaaattgacttggtaggtagacatgtcattatttagggtgaagcttaaaattctaataattaactagttggtagttattttctaatttatattgttggattcatagaattttaaaaaataatgtttaaaagagattctgattttagaagaagcagtacagtagttgcaagaagctctcaaacagacccatgaaactcatgttgtttgcggcgctacataaaggcataaagcccccttggcgtgaaataatttgccatggacaaggaggggctagctaactaggtgcattgcatgcttggcggcggccaccacggcttccacgatgtccgcggcggcagcggtgacaagc

SEQ ID NO: 336 - DNA, 1501 bp, Oryza sativa
tgtgctctcctctagctgtttgtactccaacaaagcttgctgaacaatgcctgtcttctttgtatctgacaaactgcctgttttcctcttgctcggactgcttgtttcatccatagagccttcatccaacgagtcctgataagcgctcagatccctgacagccggtatcatctcatttgaagggattggcaacagctccccccctctttcagccataatcaaatctctagagagccccttatcagtatttatgggtttatgctgggaactattcatgtccgacacgcgtatctggttggcctgttctgctagttgggcatccacaccttcatccccttttctctctcttgactcaaagccatcaaaagtatcaattcttaccggtggttctgtcgggtgcagcagatccctcttttcccctatcgaggatgagctcgcagagcccgcttctctgaaaataatcttccttggcacacctgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgttgtgaccagaggggttctgcggcgacgtcgacggctgaggcggagcggcgacgtcggacagcggaggcggagcggcagtgtcgacggcggaggcggcgacggctgctgcagaggttctcaacgcgagcagcgtgaaggaggagcagggcgcacgctcgctggttgagctgcgcaaggatttggtgcagcacaagctgtagggagcacagcggctgagagacgcgcagctgttggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaagaagaaaacaacagtgcttggcaactttattaatctcgcacatcctatgcaggtacctaactcaacttggatattagactccggagcatctagacatgttacaggaatgtcgagtgagtttacatcatatactccatttcagtcatcatttaaagaaacaattcaaactgccg

SEQ ID NO: 337 - DNA, 1501 bp, Oryza sativa
aatttggcgcatccgccccttttggagggcctgttagcgtatctgctcgagctgatttttccccttctatacggcaaatgaaggacggatgaccggttagaggaactgctggggatgctcttaggtgccaaatgacctgggtcttcacatatgtcacaaataactgcattacaatcagtaacacggaaaaaaattctctgcggcagtgccgcacgccacaacccgtgcgacaccccgcagaatagcgacgcgtgtttaatctcctgctgcaggccgagccctctttggttggtgtcgagccgagtccatttcttccgctgcttattggagtcaagctgtccagggcacatgaatagtttttgtattaggtctgtaagttttcgggttcctatgtaagggtggtgtcttgcctctctttttatttctgcaatatagaccaaatgattttacatgctgtataaatatgatgtaaacgtgccaacctaatttcaacaccaggtgtgcttttaagttgtcaatcaacacatgtaatttttacttgtcaggttgggtatagcgctagaattggtttgtatgttgcaaactttcaggctttcatgttgttggtattcctatatggctatatagctccgcacctgtacaattaaaaattttcggagctactactctatgccaataaaagacaaactctagctacgaacctagacacaagctaggattggactttttttttttttgaacggagggagtactccttaaatgttccgtgatttgttatgtcatcaaaatgtaatttctgagcacccgagacatcttgataaagtttatgtaaaggatttatatattacactagaaaaatctccagcatattatcagcaacagttgcataaaaaagctctattgaaaaatgaaattattcaggcttcatgtgtagccagtagatgcggctcggtagcattttcaacgagctgacaggtgtgtgggtgtagtataccaggcatcggctcggctccaaagttgggctcaggccggctggggctgcagcgcgctgatggacaatggacacgcgtcgttattctacgcggtgttgcatagggtgtggcttgcggcactgccgcagagaatttctttcccagtaacaccatgtcccttttctttgcacctgaagcagcgaattttttacttagccgcggtctcatttgctgccttagtagccacaacttcattctccgttgcgtctggggcaggagcagctgcgaccgccgccacgccgtgggcagctccaccagtgccagcgccacttgaaggaacagcgctgctatctcctccaacggcagcacgacccctccccgctggatcacctcttccaacgtggccgtcagcatcagcccctgtggcgtgtaccagaacctgtggctgcgtgatacggatttcggcccctaccgcgaagaccgcgcctagggcctcttccacgcatgcggcgtccacctccatctcctct

SEQ ID NO: 338 - DNA, 1501 bp, Oryza sativa
gcactgttgttttcttcttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgttgagaacctctgcagcagccgtcgccgcctccgccgtcgacactgccgctccgcctccgctgtccgacgtcgccgctccgcctcagccgtcgacgtcgccgcagaacccctctggtcacaacgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacaggtgtgccaaggaagattattttcagagaagcgggctctgcgagctcatcctcgataggggaaaagagggatctgctgcacccgacagaaccaccggtaagaattgatacttttgatggctttgagtcaagagagagaaaaggggatgaaggtgtggatgcccaactagcagaacaggccaaccagatacgcgtgtcggacatgaatagttcccagcataaacccataaatactgataaggggctctctagagatttgattatggctgaaagagggggggagctgttgccaatcccttcaaatgagatgataccggctgtcagggatctgagcgcttatcaggactcgttggatgaaggctctatggatgaaacaagcagtccgagcaagaggaaaacaggcagtttgtcagatacaaagaagacaggcattgttcagcaagctttgttggagtacaaacagctagaggagagcacagctcaaagcaagaaggacattgagtccataggacggtcgctaaagagactcaggaaggatggtggagcaacaggggaggtgactggcttggaagctaccagcgctggggctgctggttcactggcgagacctacggcagggtcccgccagggacaa

SEQ ID NO: 339 - DNA, 1501 bp, Oryza sativa
gaaaatactactactccctccgtcccagtacgtagcaacctaggatgggttccatactacgactatgaatctggacataaggtatatccagattcgtagtcctaggatgggattacccatcctagattgctacatattaagacagagggagtaatagtttaactaacaatacattgattaaacaatgacttttgctctaatacagtctactccagctagtatgaagcggccagcaagaaactcaagtctactccctttatcccataaaaagcgaatctaatattggatgcgacatattctactacgataaatctggacatatgtatgtccagattcatagtactaggatgcgtcatatccggtactaggttgtcacatttttaagaacggaggaagaatttgcatttctaccgcatcgaaacagcaagactgactccacgaagcggatatatacatatacacctatataatacacacaaatgcgaataatttccagctactagtcatcacatcaggtcgtattccctaagagataatccaagaaatgcaattgacaagcgtccaaatccaagaagtgtcatcgacaagagtgagttccaaaaaataccatcgtataaacgactttatcccaaaaataccatcgccgttagggttccgtccatcccgtgtcattaaatacactgttcatcctatagcacttaatggcgcggaatagacggaaccctaacgacgatggcatttttgagacaaaatcgtttgtacgatgtcatttcttagaacccacacttgttgatggcatttcttagatttggatacttgtcaatgttattttttggattatctcattccgtaaaccccaattggaagatgtgtgtacgtagtgggtacttgcctacttggcgtcagcttcccatgggatcctcacacctctgacgggatacctgtgacgggcaaatgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagatgtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcaga

SEQ ID NO: 340 - DNA, 558 bp, Oryza sativa
atatgagaattttcattctaaatgttcagttatttagaaattatattcctacttaaactctcaattttattttataatttctaaatttattttattttttactcgaaattttaattaatcgatctcatgtttcttttaagatggtctcttcttgcaacatttcttatttttaattatgaattttagcttttatcctacttaaactattacttttttctaatgttgaaatttattttattatttttgaattttaattaatcttgtgtcgttttctagatagaccgttcttttaatattctttttttgaattacaattatttttttcttctacccaaaagtgcacacatatatcaaattgcacttctgactgatgaaatatggtagttagagatgttttaggatagaattgatttgtgaggactccttctatatctgtaatccttccttatctccttcctatgtacttctatatatatcgccctcccctgaggctcaatacaatcaatccacgttacgcagtatttctctcatccctatactatccaacagaagctgcca

SEQ ID NO: 341 - DNA, 1501 bp, Oryza sativa
attatagctagctaatttaatttgtctaggaaatttgttgtgattcagctttcagaataacgaagcacaagtgcaggacaaagtcgattagaggatatatatatatatatttatatatatatatacacacgcacatacacttagctagcataagtgtggactgtaaatttttgaagtccagggcatcgacagagatgggcaaaaccacaacatgctgcagttcagtgccattgtgccaataccagggatgtttcgagtcacttgtttatatgatggatgtatttttcagccggccaaactcagggtcaactggtggattctttggctttaatttgtggcgttcgttttccgtgcactaattaaacagttacggcgacttggcagcttaactattttcttcgtcgtcattctaaaaaagggcatgtaatagtcggcgactaactgtactactactcccttcaacccaaatatttagagtgattataccgtacttaataaggtatcaagagtttcccccgtaatatttggtaactccggtattaacaggtactatcaaatttatactaaaaatttttatacatctcactactacataaaaatttttctgtacgaaaacccctatctttcacacatcttttatgaaactttaggacatatcgggcagaaaaatctatatcaattattttgtactaatgagcactataaatataagggatttcttctataaacatagaagtagtaaacaaccaaacgtacgaaggatgccaatgatcacatacggggagtagacaactaaacatatgacgggtggcctaataactatccatctaagtgatatatataccacatagtgaatttttgactgacctgtgtactgaatcaagagcgcgttgcattgtggtggattatgactctacgctgacaatgacatcaacctgccacttcaaaatgcctctaaaagttgctttatggaaacagtcaaagtatatgagctgaacacacccacagtttacagagaaattttagtccaaacaaacaaagttgtgtcgtcactggtgaccaatataaccagggattgattctcttctgcatcacccactcaaattcttgtctgccccctctcacacgctcatagtggtcactaggcttgtgctctatataaatgccagcatgttccagtttcatcaaaccaaaatctgtaaggaatctgctatagctagcaaaagggagagcaagatgcctgtagcagcagcagcccagaaagcattattggcacaacctgttctgatacttatcatcctcatcgtcagctcatgtccttgtgtaagttcattagcaccatccagaacccataacacatcagaagccgaccggcaagccctcctttgtctcagatcacagttctctgatcctttgggagccctggactcatggagaaaagagtcacttgcattctgtgattggcatggggtgacatgcagcaaccagggtgcagctcgcg

SEQ ID NO: 342 - DNA, 1501 bp, Oryza sativa
tagctaatttaatttgtctaggaaatttgttgtgattcagctttcagaataacgaagcacaagtgcaggacaaagtcgattagaggatatatatatatatatttatatatatatatacacacgcacatacacttagctagcataagtgtggactgtaaatttttgaagtccagggcatcgacagagatgggcaaaaccacaacatgctgcagttcagtgccattgtgccaataccagggatgtttcgagtcacttgtttatatgatggatgtatttttcagccggccaaactcagggtcaactggtggattctttggctttaatttgtggcgttcgttttccgtgcactaattaaacagttacggcgacttggcagcttaactattttcttcgtcgtcattctaaaaaagggcatgtaatagtcggcgactaactgtactactactcccttcaacccaaatatttagagtgattataccgtacttaataaggtatcaagagtttcccccgtaatatttggtaactccggtattaacaggtactatcaaatttatactaaaaatttttatacatctcactactacataaaaatttttctgtacgaaaacccctatctttcacacatcttttatgaaactttaggacatatcgggcagaaaaatctatatcaattattttgtactaatgagcactataaatataagggatttcttctataaacatagaagtagtaaacaaccaaacgtacgaaggatgccaatgatcacatacggggagtagacaactaaacatatgacgggtggcctaataactatccatctaagtgatatatataccacatagtgaatttttgactgacctgtgtactgaatcaagagcgcgttgcattgtggtggattatgactctacgctgacaatgacatcaacctgccacttcaaaatgcctctaaaagttgctttatggaaacagtcaaagtatatgagctgaacacacccacagtttacagagaaattttagtccaaacaaacaaagttgtgtcgtcactggtgaccaatataaccagggattgattctcttctgcatcacccactcaaattcttgtctgccccctctcacacgctcatagtggtcactaggcttgtgctctatataaatgccagcatgttccagtttcatcaaaccaaaatctgtaaggaatctgctatagctagcaaaagggagagcaagatgcctgtagcagcagcagcccagaaagcattattggcacaacctgttctgatacttatcatcctcatcgtcagctcatgtccttgtgtaagttcattagcaccatccagaacccataacacatcagaagccgaccggcaagccctcctttgtctcagatcacagttctctgatcctttgggagccctggactcatggagaaaagagtcacttgcattctgtgattggcatggggtgacatgcagcaaccagggtgcagctcgcgtcgtcgct

SEQ ID NO: 343 - DNA, 1501 bp, Oryza sativa
ggaggtggtggaggtgtggccgaccggtgcacgggcgaggagggacgggcggccgaacaactccggcgaggcggctggagaggttcgcggcgatgtgcggcggcttccgggcgaaaccgaggggtggacgaggtggagggctacgtcaccgtgccgagggaggggacggcagcgccggctgacgcatgggcatggcgaaaagggcagccgggggagatgccgccgaggaggaaggagaagccggcgcgggcgacggtgttccggcgaagttcgggcgaggaggaggtgatgccggggatgagagcggcgtcgtggagccgaggaaggtggtggcgacgtcgaccggcgctcaggcagggagatagaggcggctggaggcggccggcgcggaggaaatggaagggcgacggcggaaacgtagctccgggggtcacctcgcgagacggagggcaggccggggtggaggaggtggcggcgacgctggaagaggcgacggcgcggccggccggtgcgcgggcgaggcggcacaggcggctggaggccggccggcaacgtgggagagagagggcgacggtggggaggtggctagagaccacgggagaccgcgggagggggctaaagcgatagaacggagcgagggggttgcattttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaagagagaggagggaaaggggattattcccctcaatcaatttgggaatcccatgcttgaatcgcgcggatttgagggaggaatggcgctagggttcacgggagagggagagaggacggctgggcgggaggaggacgatgactcgcctgacgcgtgggccccacgcggtcaggcggcggctcgggcaggggggggggctcggctgggccgggacacggcccaggtgggagaggagggggaggcggcttgggccgagcaggccgggaggggagaggggggggaaaggcagcccgggagagagagggaggagggagtgggccgggaggggaggaggcccaagaggaggagggagagaaggagagggagagaaagagagggaggaaaggaaaacttcggccgcgggccgaggggagagagggaggactttgggccagacttggcccaaagggaggaggattatttttagattttctttttattaaactttgataattgttgttgttgtttaataattatttccggtgttctgaaaattcaagtaaaatttgagggctccttttagaccaaggagaatttaacaaaaattctccgggccacatttgaatttttcttgcacgtattttagggtttgccaatttcttttcgaattttaattaattctattattccttttagaaaatgatttttatttcgggatgaatttatcaggac

SEQ ID NO: 344 - DNA, 1501 bp, Oryza sativa
tttatcatgacaccaagtttgcatgcgcacaacagatcggagaccaatgtggtttccacgtgtgccacaacatgtcaacacttctaagagaggtgaaagatttcgaccctaaggttgttgctaatggcgaataagctcatttcaatatctacattgctattcaaaacgtgctaattaacctcttatttattaaacagaaagttagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggctttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgggccatttatttctatatcatgtactccttccaaaaatgttagatttatttcatattttgattttttttttcaaataaactagtcgtatttatagttttcatgtatctaaaacttgtttataatcggaacttttgtcggcccccggttttatataccggaaaccccatgtataatacagtaccactccctggatcaataggtggtacacagttggcacagtcgaatatcacaagctgacatcattttctgtgact

SEQ ID NO: 345 - DNA, 1501 bp, Oryza sativa
cgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgccgattaaccccctcttctcctcctcagcgccgccgtgccaagaagccgccgccgcgccgccgtgctgagaagccgtgcaccgtgcgcctgccgggactcgtcgtcgccgtgtgccgcctcctctgctcgtcgtctcctctccaggtacccctctctctctgatgcccatgaatggaatggtgcagtggatggatgaataaatgatgcaattgaatggatgaatgaatgatgaactttggatgaatgatgaactttggatgaacgatgaattttgtcattccgttcagattgttgcaactgttatttaaaacttgaatgtggatttaagtgccattttgacatgtaaccattcatggagtgtgtactgctttatatgttgttttgttcccttttgctagaactattgaattttggggataatgtttacatttagctgaaaaaggatggattgatagattggcaacagtgtttctagcttggtagggtagctagctagaaatagtttatctagctagctagttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctgtcattctttgataattaaggaactttattaggtttagggtttgaaatttagttcaaatggaagaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcattttttttgatgaaatatatgcatatttgagatatgggctatatgaggtgatgaatttggactatttgtggatgaaatatatgcagtattagatgaattagtctttttgtattagatgattttaggattaattttgctgcattggttgaattttgcatgattt

SEQ ID NO: 346 - DNA, 1501 bp, Oryza sativa
gaggtggtggaggtgtggccgaccggtgcacgggcgaggagggacgggcggccgaacaactccggcgaggcggctggagaggttcgcggcgatgtgcggcggcttccgggcgaaaccgaggggtggacgaggtggagggctacgtcaccgtgccgagggaggggacggcagcgccggctgacgcatgggcatggcgaaaagggcagccgggggagatgccgccgaggaggaaggagaagccggcgcgggcgacggtgttccggcgaagttcgggcgaggaggaggtgatgccggggatgagagcggcgtcgtggagccgaggaaggtggtggcgacgtcgaccggcgctcaggcagggagatagaggcggctggaggcggccggcgcggaggaaatggaagggcgacggcggaaacgtagctccgggggtcacctcgcgagacggagggcaggccggggtggaggaggtggcggcgacgctggaagaggcgacggcgcggccggccggtgcgcgggcgaggcggcacaggcggctggaggccggccggcaacgtgggagagagagggcgacggtggggaggtggctagagaccacgggagaccgcgggagggggctaaagcgatagaacggagcgagggggttgcattttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaagagagaggagggaaaggggattaattcccctcaatcaatttgggaatcccatgcttgaatcgcgcggatttgagggaggaatggcgctagggttcacgggagagggagagaggacggctgggcgggaggaggacgatgactcgcctgacgcgtgggccccacgcggtcaggcggcggctcgggcaggggggggggctcggctgggccgggactcggcccaggtgggagaggaggggtaggcggcttggtccgagcaggccgggaggggagaggggggggaaaggcagcccgggagagagagggaggagggagtgggccgggaggggaggaggcccaagaggaggagggagagaaggagagggagagaaagagagggaggaaaggaaaacttcggccgcgggccgaggggagagagggaggactttgggccagacttggcccaaagggaggaggattatttttagattttctttttattaaactttgataattgttgttgttgtttaataattatttccggtgttctgaaaattcaagtaaaatttgagggctccttttagaccaaggagaatttaacaaaaattctccgggccacatttgaatttttcttgcacgtattttagggtttgccaatttcttttcgaattttaattaattctattattccttttagaaaatgatttttatttcgggatgaatttatcaggac

SEQ ID NO: 347 - DNA, 1501 bp, Oryza sativa
ctgctcgtcgccggccctcctcagtgcttctccgccccatccgacaccggaaacggattccttgaaccccggagatgctcccacccctttgaatcgaatcctcgtcgtctcgttgtgttttccccttttgctcgccggtgattgccgccgccgcaatcgaccgccgtcggcacctctcgagccgattcctctcgccgccacgctcccggagatccccttgagctccccctgactgtccctaggccgccggccttctcctttgcctccgcgccgtgtcgccccttccgccgccgcataacgccaccgcgcgtgcgtcgccggtgaccatcgggtcccgcgtcaccgcgtgcgcgtcgcaaccccataccggttcggcgaagcccgagcccgcgtgcccttcgctcttctcgcgtgcggccacgttggcgtgtcggcgagattggccgccgccgccggccgtcgtcgcgcgtcgtcttcccgatccgagccgtggaatgagttccccttctcctcctcctgccgccagtgctagccgcccctccggcttgccgccgttcgccggatcccgccgcacgccgtgagccgtccgatgagccgcccggcctcctctcccttccccatccgacgtgacgtccacgttggcgccacctcagccgtcggccccacttgaccaagtcagccgacgcccagtcagcagccgccccctctctcttgctcttgggcttggcccagtagccaccctcctcctcggcctgataagtaagaaaacaaagtccacatacactccctttgtccaagcccagtgtccatcacccaagagctaaaagtccacaattactccctccaattgctcctctctctctcaccttcttattggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcccgtatgtcagtggatgtcaataatattcttgagaatattatttctataaattccataaactatttctcgtattccagaaaattccgacaaatcgtctctttgtccagaaaaattcctttaaacttccaaaattcatatccctcgatccgttcgtccgattgcctccgttccacttccagtaattccgtaaaattgagatctatttaatggcactactaattagtctaaataggatccctcttttggtcttttgcttaggttttcagttgtttgcgtacagttgcggttaccggattttcgtcgatcgcgggttttcttgaagattcgtgaagcttcgtgaagactttgagcaaggcaagtcaccctttgaccaattgctcctctaattggaaaatcattattattttgtttgtaacttgcattattagaatcacacacttaacttgcttggcctcggtttgcg

SEQ ID NO: 348 - DNA, 1501 bp, Oryza sativa
cctacatgtcaattagcagtactgcataccttccaccacaccaacacgaggtgatggatatggtggtgcagaccttcggacacactcctgtttaaattcgtaacactgtattgattaaatctggttctagattgctatatgttataattttctcaacattttttgaaataagcacatcataacataacagctgtgaattgagccctagttagattggatttttttaacaaaagagtttaacttaatcgtttcggagaaaaaaatactacatcatccgcatagcgagatactacatatatggtaaattttactatagaacatcgtgacttcgtggttttagttataggacaccgcacaaagtaacttttggagaaagacactcttaaaagttgaatatttgctggtagacaccgcaccctttaaaataacaatttccggttaaagaggaaagagaaatcacgtgaaacatcaaaagtaccaatggacccacatgtcatctctccctctctctcttctctctctatcccctccttccagctagggacagagcaaatgatagaaacagaagagagtataagagagcatctgggtcaagggcaagtttgatatttcacattatttctttttactcttcaaccggaaattattattttaatgagtgggatgtccaccagcaaatatccaacttttgagagtgtcttcttccaaaaatcacttcacgcggtgttctacagctaaaaccgcgaagtcacgatttactgtaaccaaatttgccttgcatatatatacatttaggctacattcgaatcacctcatggattgtaacttattaatttgcccttcacataaaatgaggtaacttagtagtacatgattaatactgtattaatttaaaaaacaaaaaaatagattaacatggtttttcaaaacaactttaatctatattctttttattgtttttttgcaaaaatgagagaggagaggatggaaactcatagttccgaacgctgcccggccgcgatcgaatcccctgtaaagagaggataaagttttggatatttatggcaatcttttcaaactactaataatgtgttttgtgcgaaaactttctatatgaaagttgttctaaaatatcagattaatctatttttatgtttgtaataattaaaactcaattaattacacattattaccacctcgttttgtgtgaaatacttaatcttcatctttatttttgtcttcaggaaattcaaacaccacctaagtaatgggtatatgatagacctgaagactgctagaaacatcgtctgcttacatagttggattactactagtttcccagtttggacgtcagacacagacggctgaacgatctctgactgactcaaactgtgtgtgctatatatagttgccccatcgcacgttgtggcttacaaattaatcaagctagagcaagaaaagatggtgtctcttccatcactacttcacaagccattagtga

SEQ ID NO: 349 - DNA, 1501 bp, Oryza sativa
ggctcgaacttttacggccgtacacgggactccagatgggcctgattacgagtgccccgtgtggaaatgaaaaaacagtcaaacatagtactaacgtataggaaaatatgcaagcagtgacagctgcatactactccctccttcctaaatgttctaaatgtttgacgctattgactttttaaaatatgtttgatcgttcgtcttacttaaaaacttttgtgaaatatgtaaaattatatgtgtacataaaaatatatttaacaatgaatcaaatgataagaaaagaattaataattacttaaattttttgaataagacaaacagtcaaacatatttaaaaaaatcaacggcatcaatacgtacaagggaaaaagaagaaagcattgatactttgatagctacactatcagcttggacaattgaatccacgacatggacgtcaggacgaccggtataacttcaaagtctcaagactccaacaaggtcaagcgatggtttccaatggtatactagccgtcttctttgaccgaatgaaatttagcctttcagaacattattttttatcagatagacctccatccacttttttagagtgtgtttagttcgcgaaaagaaaatttttggctgtcatatcatacgtttgaccggatgtcggtagaggttttcggacacgaatgaaaaaactaatttcataacccgcttggaaaccgcgagacaaatttattaagcctaattaatccgccactagcacatgtgggttactgtaacacttatggctaatcatagactaattaggctcaaaagactagggcagtatttacggggaggggggtgtgagtataatcttgcatgcgtagtaatgtgtgtgcgcctgtgcgcctgtagtgtaatcgtaagaaaaaattatgaaattaaagcatcagataataaaatggttaagaaacggggatgtttgtaatcggataagatgaaggagtaggtggataagttttattcggataaattttaaaccatagaaattcattcattttgggactcagagtatattccacgaaagatcgtcctatatgctattgtctgcactggcaccatatcatgcgccagtgttcacatacgtcatcaaattaatctcacaggtccaggttctaacaatttaattacgtctacattttgaaatagatttgctaaggttctagttgcaaaagaagttcccaacaatggtggaactgtaaaacgttcacttcaaatgcaaacggccttgtttagttgcaagctttttcttcaaactttcaactttttcatcagatcaaaacttttctacacacataaacttccaacttttccatcacatcgtttcaatttcaaccaaacttctaattttgccgtgaactaaacacatacgtggtgtcctatatatagatgctaacccttccgttatggttcagtcttcaagcatcaattccatcaaaagaaatgtttcgcttagctctcaataaaccca

SEQ ID NO: 350 - DNA, 1501 bp, Oryza sativa
cggtagctcaccagtgagggaattcatgcttagattgaggtatctaagatgtgttaattaaccggccaatctcaggggagatgtggccattgagttggttgccaggcatgtgaattctggagatgaaactgaggttagcaagacaaggaaatattgggccggtgatgttctgtgactcaagatccaacgcaacgactcgagatggattcttgacactacatgtaaccccattccaaatgcatattgcagaagattcatttctccaagaggctaatgctcctgaggggtcatggagctgggacttgaggcagaggagggcctcccggtcagcattggaatcgttgtggagttgagctgacacagaagaaggaaggcagcataggctctggaaatggaagcagactactagaataagaagtagcggtggcatcactaatggcttgtgaagtagtgatggaagagacaccatcttttcttgctctagcttgattaatttgtaagccacaacgtgcgatggggcaactatatatagcacacacagtttgagtcagtcagagatcgttcagccgtctgtgtctgacgtccaaactgggaaactagtagtaatccaactatgtaagcagacgatgtttctagcagtcttcaggtctatcatatacccattacttaggtggtgtttgaatttcctgaagacaaaaataaagatgaagattaagtatttcacacaaaacgaggtggtaataatgtgtaattaattgagttttaattattacaaacataaaaatagattaatctgatattttagaacaactttcatatagaaagttttcgcacaaaacacattattagtagtttgaaaagattgccataaatatccaaaactttatcctctctttacaggggattcgatcgcggccgggcagcgttcggaactatgagtttccatcctctcctctctcatttttgcaaaaaaacaataaaaagaatatagattaaagttgttttgaaaaaccatgttaatctatttttttgttttttaaattaatacagtattaatcatgtactactaagttacctcattttatgtgaagggcaaattaataagttacaatccatgaggtgattcgaatgtagcctaaatgtatatatatgcaaggcaaatttggttacagtaaatcgtgacttcgcggttttagctgtagaacaccgcgtgaagtgatttttggaagaagacactctcaaaagttggatatttgctggtggacatcccactcattaaaataataatttccggttgaagagtaaaaagaaataatgtgaaatatcaaacttgcccttgacccagatgctctcttatactctcttctgtttctatcatttgctctgtccctagctggaaggaggggatagagagagaagagagagagggagagatgacatgtgggtccattggtacttttgatgtttcacgtgatttctctttcctctttaaccggaaatt

SEQ ID NO: 351 - DNA, 1501 bp, Oryza sativa
tattttcttccaatcatttattgaaacacaaacacttgcatgtgttgtatctataagttcactagctattctctcgccgaattgcacacggtccagcgaaacatatttggctcgtttggttaatccttagaaggaagatattcaagggtattgagagagattaattctacacctcgataaatataaaattattcattttcaaatcctcttatttatagattgagtaaacaagtccttaatacttgtttggttactctcccataaggggattgaagggatttgaaggagatttattccgcttctattttagtgtggaattattttctcttactcgccccgaatccttctctcttaggggattaagcaaacaaaaccttatgcaaatactattggttcctaactgggatagggtgctggtttccaaacctgccttgggcgcatttttaaacctggattacgttgctgcaggagtaaatttttatttctcgtgcaggtaccttggaccccaccaatccatctcccatctgtcctggtcaagctccttccccgtattgtccccaaccgccatgtcacaacatgaatcacgcgccagccacggagcaacagggtgcacatttgccttaagtagcagatggtaaagggagcgaggtgaaaaacgtatatatattcagggaaaatttcaaaccaccccaaaagtcatttaacgtttgatgtttcaccctataagtaattttgttggaaaagcctcccaccacccagttttgttgcaacaatctttcaatacaaacgtgattaatcaaatcagcccgttatcactgatattgtgccaccatatgctaaactagccgagttaatcttgtctaggtgcttatattagaccactctttatgtttcactgtattgattttgttaatagctaaactcagtgcaataacgtttaagatctgatccgcaattatgtttgtgggaatctttaaaactttttaattttgacagctccttgtttatgaaaacatgttgatttggtcaaacacgtacgtactgggatggttttctggacacaacagtaggattttaggagggtagaaatttatagcaacataatttatgggatggaatatcaaatttcaagtgttttatactgtggtttttgtaaatttccgtatattttagttcgtgtcatcttttaactcgtcccacatctgtgatcgtctagaactatagtatgtagtagtatgtaataacttatgatgtattcctactaaggaaataatatttccattgcctgcctgctaatgcttttcaaataatcaatatatctatctatctatctatctatctatctattatatacatactaaaagtccattaaacttcctacaaacgctctcaagccgccacgtgaaactcctacaaacgctcctaggtcgccaagtggctctatctaatctaaccgtcgattttaacttaaattggtggacccaatattttagaccattag

SEQ ID NO: 352 - DNA, 1501 bp, Oryza sativa
ccgcctcgccgcgccgccacctggggtttggaaatggggagcggcgcgagggaaccgagctagggagggatgggtcacggagggagagggagagggggccgtatggaagagtggtggctaagtgggtcagctgatgtctgatgggtcatgacggagtgggtcgggttggtaggaggcgttgcaagaggccagttggactgtgtttggatcgaagaattgaggatttaggtgcactaatatgtgtacatgtgtatatactaaaagtatacttgttttttgataaaaaagttgggtattcccgggaatacccaggaatcatggtagctccgcccctgtgtgtagccaaaggtcatttacctatctgcaattttgcaatcaaccacggtagcatagcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagaaaaaaaaatctttcaacaccaacaaacaaacgctggtactcccagtacgtgtattgtactactaggtagtactcggtgccaaacagtttggcggctatacggagttgagtagtacaaacagaaatactcgtatcgtatcggaatttctaaaaagaaaaaaataaaataaaagaaaaacctgtactggcaggtgggccccacccgcccgcttcgacgaccacacgtgggctcgccacgtgtcatccggcgtctcgtttccttgtacccgacacccccctacgttgtggaaaaagaaaaacccatccctcacgcgagcccaccgcacccgcagtcacagacaagcgggccccatccgacccaccgaccaatcccgagcgcgagcccgcgggtgcacgggttcgcgcgcgccgcgtggcccgtgggccccaccgggccagggccgcggtaacgacctctctcctgatccgacggccgggatccctccacgccgccccgaaaccgcctcggccaatcggaaatcgacaacgaggcactcgaaaccgccctggtatggccacaccgcattccacccccatctaaaaccgccttccctccccctccctctctcttcctccccccatttccatcttccccgagctctccaccctccacccgccaccgccaccgccgccttcgccgccgccgccgccgccgacgacga

SEQ ID NO: 353 - DNA, 1501 bp, Oryza sativa
acatttcagtaatacatagagttcgactgttcgagtgatcagtagagcagcgaggtgtgtggtacaacgaggcaatggggggaaataaaattaagactccatacagcttgtaaaattaagaattattgaaaagtttggatggattttagatgagaattcgtaactattaatatcaaattttatcgctattaataaaaataaagtttgcatattgtttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgcttacggttggaaaatcgtatagtcattagaaagcacttttgaacatgaatccaacaatatcattatttatggcaaaaagaaacctaaacattatttgagatagtcagttataaggttcaaaattagacagtcaaaattcacattacatttccgagcgtacggacggaagtaaatatgcgtacacgttcggcaaatatcatccatgggccatggcgtacgtatatgctagtaagtagtactaggaaaacatttgtatatactcccttatttatatactcgtaaagaaacgtaaagaaagttgtttagtataatgtttaaatcaaacattgggaatataaatcatgaataactctaaagttgttgagtttgaaaatgtaaaaattatatgaatagatttgtcttaaaaaataattttataaaagtatacatatatcacttttaaataaatatttttatagaaacaagaagttaaagttatattttggagaccgtgtcactgtcaaaaacttcctttacgactacggagggagtatatactaccgttaccgtatggcgtacaggagtatccgagtacgtatatacggggtgtacacgtacaccgtacacgt

SEQ ID NO: 354 - DNA, 1501 bp, Oryza sativa
atctagatttattatactagctaggttatgtcttattcacatttagtttgattttctgtgaaacggactatgctttatcgtaatgataaattagatatttatagagagaaacttaatgaatgtcaacatttaatacatggtccaaaaaactgtctaaacattcatgtatttttaaagaggtgaagaaattacccaccgtataataccccgatgaagtaatggagcctggccacttgtgctgcagttgtacgaggttacattaactctatatgccaaacatgtgtttatggttccgtatttcgacgattcagaggtagatttgttgctttctccgtggcttttacgtcgttgcaggttgtgagttgtgaccactgaagctgagctcacgttcatgtctactatagtatctcagaaaaaaaaagattattttttttctcttcctatttattctaaaataaatttataaacacattggaaacagatagctagagtatagaataattctattacaatttgataaagtgagaatattatagttctttttttctattggtatgtatagaatagataaaaaatgaatttattttgtgatacagtgatgtgagagtattgctcaaacagaagacattaccaacttcgcctattttacttatgtctcactgtctcggcctcttttaagtttggacgtacctacgtctcgttttcatagacaacaactcgcaagctactgtataacagtggccgcctgattaaaatcctctgttttgtcatgttcttttgttaagataaaggattatattaacccggcctttacaccttgggggtgtacacagccaacaactgttttgtcatgttgatgtctggggataatctgctgagtttctgctgtcatagctgaaaaaagttcaggcataatgacaaatatgcacataatcgagtaaaatgagcacagtgccacagtgtaaaaactgcgtaaactcagactattcgcccaaactgtggcaaattgatagtattgtccgttcgttgctaatccgatgctaaaaaaatctcctaaatccgcggcattgtttagtggactttatgcctctacttcctctcaagtgttgaaatgatgcctctactacgtaaaatttgcgtatctttgtatcaggattcaggactggtgggtgtttggggttatatggccttgagcccttgacaagctcatggcatatgtgtgtgtgtgtgatcgagagatggagcaaatgtagcggtggaacttgtggtttgaaaattactatctccgtcctaaaatataaaaagttatcggtttggacatatgtattaaaaaaaatgtaggtgaaataaatggaaggagattatgattggttgagaaaaaaagtaagtggtgaatttgaatgatgtgtttggtttagaaagaaattattatatttttgaataagttctaaatgtaaaaaaatgttatattttgggacggaacgtgtactactcctaccac

SEQ ID NO: 355 - DNA, 1501 bp, Oryza sativa
gtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattgataacttttaaagaaaatgttccattcaggaaaaaaagaaactgtaaagaaaaaacaataggattaatgcttcttagttgaacagagcatgagtcacataaaaaaaaggttaaaggagttacatcaaaatatgagctctacttcaagcccttaaaataaatgccaagcttcttttaaacatctaaataagtagtactaaatttcttgtcaaatgaaaaataattgtgctagtatttcatgttcaaatgctaaatgaggaaggaggcaattaagtctgaacgttccttactagttggatggttggattagttgctactgccaaagttagtgactgcacctgatcccaatcctcttcttatgggttactcactgttcaccataggatgctggagtaccctgcctcatgattcggcgaaaacagccaaactgtccttgtaaacgttggattgacaggctttattggtgattctcccaggcccctacctcttgcatttctgtccattcaatcaatgtatggaaaacttttcagatggggtagtactgaagtggatacctcagccagtaaattccacagccgtgagccaattggctctgattggttgagataaaggtagaaaaatgaacaaaacaatcaaaataatttacggtttaaacctttatatctatatcatgtggtttaaaagtaaacggtagtagaaaatagactaggtaaaaaaaagctaaaactgactctaaaattaaaattaagttccactccctccgtttcacaatgtaagtcattctagcattttccacattcatattgatgttaataaatttagatagatatgcatgtctagattcattaacatcaatataaatgtaggaaatgttagaatgacttacattgtaaaacgaaggaagtaaaacttaaattttagccgtgaccaccaacaaggaattaataagagccttccaagtcaataattgagagacagagtgagtgagctattggtttcgaagagtagaagtaaaagtaagttggacattatatagggcgtaatctctcaatttcaatgtataagtatttagtaatggaggtcatatcataatacttggatgatttatatccagtactaggattttatatattggcatagagggaatagaaagagaaggtgccatccaatatatatatatatatatatatatatatatatatatatata

SEQ ID NO: 356 - DNA, 1501 bp, Oryza sativa
agctccttgacccgctgacgtgtggggcccgcgtgtcggcgccggctgccccttgctgacgtcagcgagatcctttttcctttgtaaaaataattaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagtttagaagatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgtcctttgtcaaccttgggtgataaatcgactagcttgtgttacttatgtgacctagctagaactatatgcttagccatgcttaattaccactagctcagttgatgggataattacagttttagacctttctagtatcttgttgagctgcgtgctcgaaacacctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagtacaggtgggttggttgggcctgttcaacgtggtgtagcgttgatcagtggagatctaatttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgagctgaa

SEQ ID NO: 357 - DNA, 1501 bp, Oryza sativa
agctccttgacccgctgacgtgtggggcccgcgtgtcggcgccggctgccccttgctgacgtcagcgagatcctttttcctttgtaaaaataattaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagtttagaagatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgtcctttgtcaaccttgggtgataaatcgactagcttgtgttacttatgtgacctagctagaactatatgcttagccatgcttaattaccactagctcagttgatgggataattacagttttagacctttctagtatcttgttgagctgcgtgctcgaaacacctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgagaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagtacaggtgggttggttgggcctgttcaacgtggtgtagcgttgatcagtggagatctaatttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgagctgaa

SEQ ID NO: 358 - DNA, 1501 bp, Oryza sativa
gcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttcccatatttctacctatccccttcaga

SEQ ID NO: 359 - DNA, 265 bp, Oryza sativa
  unsure (1)..(265): unsure at all n locations
catatagcaagctaaccaaatggaacctttggcacacataactttcaaaattttactcggagntgacctttaactgagttctttcgtacttgtatacagatcgcacccttctatctatctactatttcatgatcatgtaaaggggggggggggggttttttttttttttggggggggggttataaggggtggtttggggggccgaatttgggcccaggcgactgggtgacagcttccttcctccctccttggcgatggagtttga

SEQ ID NO: 360 - DNA, 1501 bp, Oryza sativa
taacggccttttttttttggaataaccgatgttatttattttactacataaaatttgaccagttatagatttaaaattgttcaacgagtgaattaatgttgttgtaaaatgattcaccgagtgaattaatgttgtattgtattaattctagattttccatgcaaattaaaacttttaagtttttataaaaatctgttactaaaaatagtggccaaagttttactgtaaacacaatgatttcagttatttaaaaaggatggagggataacttgctgtacaatagctattgcccaaagtactgaactgcagggcacatcctccaatgtgattgcttttttcttgctgactttatgatataaacaacaaagtgtgaaggaaaaaacaggggaaggaaagacatactggtaaagaagaattagacaaatatacagtggtacaaatttagaataaaagaatcttacttggacatttttatagggtttgcatagcagatacttcctccattcttgaataattgttactgttaactacaaccgtctcattctaaacagaaattacttttcaattattacattatgatggatcggagttattcgcttatatttatgatggcatatacttcgataatatcacatatttttaagtattttttttacgaaaagacaaactgccaagtttaaatttgaatagtgtaagggtcaattttattcgagaatggaggaagtaactagattcaataagattacagcatatgacaaaaaatattggccttaaaatgtgccttatgctgtcatgtagtcatgctaacaaaaaaaatgcagactagggttaaatattatttttgcatttagaaataattatattggtattaatctgaagttttaatttgttcctacatcagatacatttcgcatctttatttttctcaccattttttctgaagacatcgtgcatcgcattggttatgtctactgttcaataaaatggaggtacgtactcgtatgctgtactacgtactccagtacactttttttgcagtccaaccaatcagccaagttggtcaaaggagagagagcgaaagagagcaggaaccccgccattcctgtgcagtttctgccccaaaaatctcatttttaatcatcccatttttttcccctgtctttaaaaatcttcctccatgagacttcggtaacaacagctactactggtgcctggtagtaaccagacacagagggaaagcaaaacaagagtgggtgtctcctgttgtctgtcttcctcctcgtttgagctccaagcaagcttagccaagaaacaccataaagaagagagtgagagagagtgtgtgtgtgagaggaggtgagcttctctcacatgcacatggagggaggggagggcattgctgtagcaggtgcaggtggtggccatgaagccggcttcggtttgttcagagcggccgatgtgaccatgacagaggcgcaagaagcagccaaggagtaccagt

SEQ ID NO: 361 - DNA, 1501 bp, Oryza sativa
ccgcgcttgccgatgaagtgcgcgttgatgtggaggtcgcggtcggagacgacgcagaagtcggcgtccctccggccatggaagtagaaggcgttgccgtcgccgccgatgaacctcgggtcgccgcacgcccccggcacgttgcacactgcacaacaacagagagtatacgtcagagacaagatggaggtgcaaccactggcggagaaatgcttcgtacttccagttggtaacctcctgtgtaatcccggtttttcaaccagaaatacgaatctaagaatctaagatatctttatctctaatttaaatacttagaactaaagattaatcccgattggtaacaatggtagcggcggctgctcaccgcagacgggcttgcaggcgtcgcagtcgacgaagcaggaggtgggacacgtgtcggggcactccatcatcttggcggagcagtaggggtagagcttacggctctcctggcacttcacctttatcttcttcttctccggcttctctttctcctccggcttacctttccccggcggcgtctccctctcctccggcttacctttccctggcgtctctcccttctccggcttgccgccttttccggccggcttaggcttaggctgggcggcggcggcgacgacgacggcgagcagcaggaacgccgccaatgcaacggcgctcagcctaggcgccatcacgacactgttaattacactcagattgtagctgctgctaattaagtagctagtgatgtgtttagttgctggtgtgattgcatgcatggttgcgatggaatttataggcgatcgatggagttgcttgcttccaaggttgtacatgtccacatgcaatataccatgctttcccagcacgtgattagcttaatactccctccatctattttgatagtcatatttctaaatctgaaaattctatttttgataggcatatttcaatccaataatctatcttcttaatgactttctcgaatttaatgcatgactttccattcttccacacaagattagctacatgggcatcgagaaatgtaaatattaatgaatcgcttgtttacgaggaattactagtagcatgtttaaatgggtgataagtagaattaattatccttggtctatgtgtcaagataaaatatgactatgtaatagctttgcatgtatgcttgcagcggcaaaattatttttgcttatacatgcatgcaaccctttccacttattcgaagtgtcatcgcaggatttccgggtcagctcgatcgatcgatcgataattaggtcagctggtacaacagcgtttttacaggtcaggatcgcaggacattgtattggctaattttgtcgttgcatgcctaattactagttaattccacgtttagtgtgtaaccaatccgtcaaggaaagatacatgtgctttagcagcctaactatggaatgaagcgacccaacgtgtcagtcaccggctgtgattaagtacatttccacaa

SEQ ID NO: 362 - DNA, 1501 bp, Oryza sativa
acgtgggagttgtgtgggattatctatatcatcgatctgcaatcctatggcctctaattgagtaacctctcaaacttctttcagaacgtcaccttgtgaaagtatttaaaaaatgctcaaattaatatgttcattgcgtagctaaggctttagtttgctctgggctggccgacatgcggctcacgcacatatgttcagtacgtcatagagaataaaaattactttaaaaattactttactggtcaagatccttgtgtagtagtagtagtatgtttagtagtaagtcctaaaatatacagttcaactgcaagctcatcacagatcagttacagcaattgtcaacgctactccatcccctgcatccttttcgatcttcgcaagcaaacagctaacatctgaggatcatgcatccgtttgaccttaatttgagcgaattattctttttcaatccgagttttgttacagactagaataaactcattggatatatttgaagaaattctgaccattggttgaaatggtctgtaaattgcgaacagttattataactgaacgtagaaaaatgataattaaaacaaaaatatgtgatgatagggcatgaatttgccaatagaagtgttggtttatttctacgcccgatattagtaggataatattatacaagagtagctagctagccacgggatcttatactttgtggaaatgtacttaatcacagccggtgactgacacgttgggtcgcttcattccatagttaggctgctaaagcacatgtatctttccttgacggattggttacacactaaacgtggaattaactagtaattaggcatgcaacgacaaaattagccaatacaatgtcctgcgatcctgacctgtaaaaacgctgttgtaccagctgacctaattatcgatcgatcgatcgagctgacccggaaatcctgcgatgacacttcgaataagtggaaagggttgcatgcatgtataagcaaaaataattttgccgctgcaagcatacatgcaaagctattacatagtcatattttatcttgacacatagaccaaggataattaattctacttatcacccatttaaacatgctactagtaattcctcgtaaacaagcgattcattaatatttacatttctcgatgcccatgtagctaatcttgtgtggaagaatggaaagtcatgcattaaattcgagaaagtcattaagaagatagattattggattgaaatatgcctatcaaaaatagaattttcagatttagaaatatgactatcaaaatagatggagggagtattaagctaatcacgtgctgggaaagcatggtatattgcatgtggacatgtacaaccttggaagcaagcaactccatcgatcgcctataaattccatcgcaaccatgcatgcaatcacaccagcaactaaacacatcactagctacttaattagcagcagctacaatctgagtgtaattaacagtgtcgtgatgg

SEQ ID NO: 363 - DNA, 1501 bp, Oryza sativa
ttgcactttcctaggttaatataatccataatcacgagggactccaggctgtgtcacatgaatctcaggttttccttaaaaaaaagaacaggttgctcaacatgagactatggttgggtggactcttgcaccaaagatgaccaaaccatttctttcactcaacactgaatcttgagttagatggccaacaaagagcaaagccacataaccatgcaaatttgagaaatattaagaaattgaactgacgcatgaaaattatttgaagatttcaaactcactacggccaaatccgtcatcaaaaacataaaaaactcagtacctgctccggcttccggccgtcgtcgtcgtccttgagcagagacagcgtggccctcggcttggggcgcacgtacggcgacgtgacggcgagcgacggcggcggcagcgagaggagggatgcggcggcgacgaggaggaagaaagccaatgctgtgttcgtcatcgccatcgccatggctggtctcgccaaatctgaaatggggcactggggatagatatgaaatgaaaaagggcggttatggctagcatggaagggtggcgtcgtgtatatataggacagccttgccaacgcaagcagctaattaatgattaatgatgattgataatgtgccgtggaggaatccagtttcggatgcatctgatttcaggtgcgaatctggggatttggatatgtggtttagtcaactttaggtgactaaggcctatttagttggtgaaataaaaattcttagatgtcacatcgaaagttgataggatgtcggaaggggtttttggatacgaataaaaaacactaattttataactcgtttgttttaaagattcgaaatgatgtttttggtaaaagaaaattttgaggaactaaacggtgcctggttttactgcactctgttccagcctctccagtctgaactctagaagaaagaaacagagagagagagagaggttgcgcgttgttcggcaggcggttcggttttgcgcgtgaggaacgaaccgcacgcatgctcagttgatcgacacgtaccaatgcaacggcggtggtggctgcctggctctcatcagtcatcacctcgcctggcccccacatctgctagccacgggccactgacagggcccacctccccctgggttccattttggcataataacggattgcttttctttttttttttggtccgtgaaaattggtgtacgtcttcgtctctgatctgttctgttcccttcgttccaagtcctggctggctgcgcaatcgactggtttctcgagttacaggcttacagcagtccatgcgtgacttcgtccagtggcggagcagaagaaaatctaaatcccggataaatatagctgcattttctcatggaaatggagtccgacaggaacgtattcctccggttcggcgtaccatgccatcttcataggaaggaaccgtttccaagaggcgccaacttgaaagtttctggcccc

SEQ ID NO: 364 - DNA, 1501 bp, Oryza sativa
ataccttcattttaactatttagaactcgcctagcagtaagactaggagcaggtatggtgtttttgttgtagtcttgtcattttgatgaactaatttgatgacgccaataggccggatagataacaatatacaaagaagtagagaaaaatttctactcccttcgttcctaaaatagacatttctagattgtttagtaaatattgaacataaggaagcaagatttcctttcagtcaataaatgtgcacaacatgtggctatgttaggcaaatccaagaaatgctttgttcaaatagatgcataatagagctacgaatttttacgtggaaaatctttacgagaaaaaactacaggcacaaactggcaattatcagtattgaggaattaattataatgcaagctagggaataaatcatcatctcacccttcccgtatttctagtaggaaaaactttgagtcctattgaaactataattaatccgaatatatagtaagctgaaatattcatatcacattatttaacataaatgcttatataatatatataatttaaattattgaaataattatatttgaaaatggatggcgattattgcaccatacaggcatgaggatggatcaacagtagtagtcaaatttaaacacaatgtggtggccgtaactatcacaagacggaaagacagtacagtaccgaaactgagcattcctttcagtccttactaaccatagaccattcccacatgtgctgttgtaatgttttatttcctcaataataattgaagaaagtgatatatatacatatatatgtggtgtttttggtctaaatgtttacacgtagtagtccccgttggcgttgagtgtaatattattaatgtttgttggcatgcatgaaaatattgttgctatctagagaagaaatttcacatgcatgtgcgtgatgaatcaataatggtgagaagtgcacatgcttatatatgtcgatcgatcgagtcgacaagatgaaataacagcatatgcaacatgcatgtaaccacacgagtccgtttctcacgctcactatcaaagggacacatctgcagtacccggcttgtgacagatgtacttagggcccattcgagaagtcagtttgtggaggctttttcgcgcaatggaaaatgagaaaaacatttgtacatgattaattaaatattagctattataaatttaaaaaatatttttattattttaaaaacatttatatagattttttttacggaatgtaccattcgagaagcgtgctaacataaaaaagtttgtgcttttgagttgaaaaaagaactcagttttattggtagattgggagcaggggtagtacatgccagttgcaacttgcaaccaagaaatttgagccaaattcagtggcaaacgttcacatctgacatctctttatcaatcaatttcgttttccattcgtcggttttaattccgtaccatctagtacgtagctgctaattaatggtttt

SEQ ID NO: 365 - DNA, 1501 bp, Oryza sativa
tttgtaaggtagcaaattaaacataccattaccaacacaatcctttcaaattttggtaattccggaactttccactcacaaaatttcaactaaaatttaccttactttatcaaaattcggtaatgccaaattttggtattaccaaatattggtaatgtttttcttacaataaagtaattaagcccttaattgcttacgttattaatcattttctggctgctcattgcacactggaaaatctgctggcaatatgaacccagccaatccatgtaaattgtagtatcaattttacttttattttagggcccctttgaaatgaagaatagtacacaacaataggaaaaacataagaattgaagtgacatatttccataatcctacaggaatagaaaaccgagtaaatatgaagaggatccctttaatatcaccataggaaacaatgaatcaaaagaaaatttctaagatgttagacctcttgtttatttttctatgaaattgcgcaatagaaatacaatcctattctttcttataaattaaagagttccatagaaaaaattccttaggaaactgaatgcttcaaaaatcctatagcaatcatccgattcaaaggggcccttaatgtgcttgtatatgttgacgctttggatttgagcaaatgaagttggtggaattcagagacgagagcagagaatactataacttgtttgttttgttcttcagcggagattggattgatcattagaccctcctcctaggggtgcgagcgggcttatccgcgaatcaacggatttgacttgcaggttacctattaatttgatctataaataagtttataaattgacccatttgtatatctagatctgataagttaggccacgacgcgaaaattcatgggttatcatctatttaacctttaagtgaactcgcaggtcgttctccttgcatctaatattggatttgtttgttttgttcttcggcggaggagagattgaattgatcatcagaccctcccccgacgcaacttccaacatttccttgtcccaaaaactgtttgtgtttcgtttttcaacacagttgcacagaactgatgatgagcagcaggtagcagattcatgagatcatcagagctgctgcatctgcatctgtggagtggacgtggcagccagctcggcagcttgagcttgcagagctagggcaggaacggggcccacacagtaacagctggcgaagtgggacccacgcccaagctagcagcagcacgtttgatggaaggaaggaagccgccaagtctacacacccacccatctctctgatctgcaataatctgccaatccgtattggccagccaatggccattgccaaatgtcaagtactcgctccatctcaaattataaaagattttcaatggatatgacacttaattactataagtacaatgaatttgtacagaaattgtctcatctatttaaaatccttcatactataagggagggagtagtat

SEQ ID NO: 366 - DNA, 1501 bp, Oryza sativa
atatacgccatccatgacgtactgaggcccgttcgaatccagttataaaatgagaaaaaagaataattggcacacataattaattaaattttccctgcaaaaataattttcaattatttaaaagttgaaaacttgatttgtctaatactagcaactttaatatatataaataattttttttgcaggaaatacacctaatagcagtttaaaaaacatgcaaacaaaaagcgagataaatttttttctccctccatcccattttaagtgtaaccatgatttttcgtgtccaaatttgatgtcttatctaaaagattttttaaaaaaatttaaaaacataagtcatgcataaattactattcatgttttattatctaatagcaataaaaatactaattataaaaaaatttcaaataagacgaacgattaaagttaggcacagaaacttacggttgtacttaaaatattttaagactgtccccaagagaagcaacctaggaggggaacaatgaatctgtaccaagagttgtctagatttattggggttgtctttttttatttttacagacataggattgtctagattcattggggttgtctttttttttttaaaggcagaggaagtatatctaatcagacctaacttaatccattgatgatacgcgcacctctcatctctcgatcggcgcctgtgcccctacgtctctgtcaccgcacgaacgaacgatcatcgactagactgatgcaaacccatgcatgcgcggatgcgccgccgtcgtcgtcgtcagtgtgctgtgctcctactacactgtagatggaagaacagtgtagtaggaaccatgcccatgcatgcagtgatatgatgcaggccatgagctattgagctactactagctagctatgtgatgggaacagtcgctagcaaggctactacattcgacagtgcaggggcagcatgcaacagctacagcagccgccgttgactcgtattcgtgctccctccgttactaaatatttgacaccgttgactttttaaacacatatttaaccgttcgtcttattcaaaacgtttaagtaattattaattctttttctattatttaatttattgttaaatatacttatatgtatacaaataattttacatattttataaaatcttttgaataagacgaacggtcaaatatgtgctaaaaagtcaacgatgtcaaatatttagaaacggagggagtatatatgaacaggacaagttcatatatatggaactgtgagaaggaagaagaggaaagggtggcgccatgatggatcaggatcgacttcacgagcccacgctgccgatggatgagatgattgctcaaatggttataaaaaagttaaaaataattgagaaaatgtattaacattagatatatcattttcacaaacatgcaaagttaaatttcacttttacgtgttatataaaagataaatttaactataaatatacgttaactagctatagttt

SEQ ID NO: 367 - DNA, 1501 bp, Oryza sativa
gatggaagaacagtgtagtaggaaccatgcccatgcatgcagtgatatgatgcaggccatgagctattgagctactactagctagctatgtgatgggaacagtcgctagcaaggctactacattcgacagtgcaggggcagcatgcaacagctacagcagccgccgttgactcgtattcgtgctccctccgttactaaatatttgacaccgttgactttttaaacacatatttaaccgttcgtcttattcaaaacgtttaagtaattattaattctttttctattatttaatttattgttaaatatacttatatgtatacaaataattttacatattttataaaatcttttgaataagacgaacggtcaaatatgtgctaaaaagtcaacgatgtcaaatatttagaaacggagggagtatatatgaacaggacaagttcatatatatggaactgtgagaaggaagaagaggaaagggtggcgccatgatggatcaggatcgacttcacgagcccacgctgccgatggatgagatgattgctcaaatggttataaaaaagttaaaaataattgagaaaatgtattaacattagatatatcattttcacaaacatgcaaagttaaatttcacttttacgtgttatataaaagataaatttaactataaatatacgttaactagctatagtttcatttgttttatttttacaacttgtaaaagttgaacgaaaggagcaggtttacattatcggttgaccactaaattttgagcctcatcagtatcacggttttcaataaatttcaactgaatatactgtttaaccttcgaaatctcaatcgaaacttaattccgagccatgtcgaaacatcgaaattttacggaattcgaccggttttcgtcggaattgtgaacagggagtatcttactcacatgctccggtttgattttcctcgtggatttatcctcttctcccgtcgccatctccctcgtcacggcgcgcgtgccggccggatgaagggttggtttggtttgtggcctaaatagaccttaccaaattttgtcaatgcccaaattttgataagttttggcatgactaattttggtatggcaaagttgtgtttggattgaagccaaaacagcctaagttcactattaaaatggcctattttcttagacatactaaaatttggcttcaaaccaaatagacactaaacactattgaaattgtcaaatattggtaagcctaatttaagcctcaaaccaaaccagcccgaagtcttcagtcttcacgcacgctgcacacatgccactacctccaccactccactgtagatagtggccatggcgccaatgatgcagccaagcagagctctgaatgcgtatgcatgcagaagcagcagctgcaaatgaacagagcatgcgtagccgctgctactgtctgtgtgtgtctactattccctcagttataaaacaaatactactccctcccttatagtatga

SEQ ID NO: 368 - DNA, 1501 bp, Oryza sativa
attatctctcacaagagttctatttttctggattagacgaaaacacaagtagtaatattatgcaacaatcaactattgcgttccctttgccttgtctccgacatatatatccatttcatacagcatccctttatcaccaatgtccaatatgcttttcttttcacacacacagtagttcagatgacccacaaaccaaatttacgattgtttcaagagttgaaattctgctagtagaaaattatcactaattaaatagccatgtttagttggtttttagactagacctaactcaggccaaccgcaaaaactttgcgttttgaccaacacggtagtggcagttaccgtagcatgaactaggtgtagtttgtttggcacctttgagcctctgtttgttttggaaaaaaaagttttattagcagcttaaaaataatttataggtaaaacttttcttttttttgaggattaaaaaaaagaagaaaagttaatattctaatcgatttaaaagttaatatatattggaaaatagagtatgattaaataccctcaaaatcaactctaaaaataagtttcaaaatttaaattttgaccgcatgcagctgataagccaaaaggcaaacgacagcgttgtttgttgccgcgagaaaggactggaattctaatggaatttctagcttgtgaatttcttatccctaggtttctttgcccccatattttggtgattggagaaattaagggcccctttgatttggaggaaaaacataggaattttagagaattttaatcctatagaaaaatttcctatgaagccatttgaaataaaggattgaatcatattcaatcctttgaaattcctatggaatggacaatcctataaaaattttggaggaaatttagcaagagcttcaacctcttgctaactttcctttgagtctatctctctcatccaagtcctgtgtttttcatgtggttcaatcaaacggtcattcctgtgttttgcaatccgctgttttacacttacattcctatcaaaatcctacgtttttcctatttctacgttttctcaattctgcgattaaaaggggccctaaaggattgataatttttacatatatatatatatatatatatatatatatatatatatatatacattaactaatcttaaatctacccgtgttttgtatgcatgcggccgatccttataaaattaacaataatcctgccctgtctggccacttcctgtgtactgtacatgtaacatgtgtttttcagttcactgtgtgtatcaaacaacggcaagttgcaacgaaagcaagccacttcgcccgattataaatagcctccactacttctactactcgccgccacccaaacccaaagcagcaattgcaagaagcaaaatctcttctcctcctcctcctcctcctcatcatcatcctcctctcgcccttcgacaacgcaccatagtttaacccaagctagaagaagaagacgatagata

SEQ ID NO: 369 - DNA, 1501 bp, Oryza sativa
aaggtccaggcttgtgctaaggctataaatagacctctagggccatgtaatggggggatccccaaaaaaatttacgaatcaatacaattgcttttacattccaactactgttgagagaatcacgcctttcgatgtggcattgttgtccattcgacaacatttaggaaattttatttcccacatttaacttcacttgtaaattaatgaacatttaatataaattctattaataatttattaaataatttataaatcctgatacggaaaatcaggctgtgacaacttagtgtgaaacaacagtcatcatgcttatgcaaggattatacaatacttaatgtaaaagcctcgttgtgacctgtaaacccactcaatatgtaaagtgtggtggtaccgatggctaccagacaaactagagcgattcacctcatgtggataaagctatacaaactctgcagagtctaaaaactaatcaattagccatgctcacggtcatgagtgcttggtaaagtgtcatgagtatagacttatgttttaaaatgtgttatgaaacttggatttggaatgggtgaaatgtattgagttgtgtgagtgtgatgatgattatatgacttgttgtcaaggaagacaacaagagtatgcttatgatgatataatgatatttattatgaacttacaaaaatgttttgattaattgaatcatcaactcctttacaaaagtattgtgaaacaaaacttgatttatgctaaaattgaactgcatattgcgctcctttgaatagaaataatgtactgactcctgctatgttgaaatatctatttgtgcaggttgtatgtttagattaagttgagtaatgcgggtttttcgactgcttcttctaggacttgaacttattgggggtaaacccctagtcggtgtgcttgtgtttgggtagtcaagcttccgctgttctctgatatatctatatttggtcggtcggcccatgtatctattaagtagttgtaatttgtgatcactttcgtcttaaatgtatcttgctatgtatttccatgcttaagatgaaagtgtgaatctagtgcacatcctgggaactagattcacatgagtatgagttaagaatatttgacatgttgtagatctttagccattttgtcaagtctactgaatgtgtaacacatctggtcgccgccttcgagtggtttgacgagcacatctcaggctgaagttgactggtaggctaaaggcccagcaatgtctctaatattcttctcttgaggcatcaaatactttattatgcttgtttgatgaattgatttattcacttcatctctgaaatataatgtaagatctggagagcctacgacatcaattcccgcaaataattccaatatattctatgcaaatctatacattttaccttaaaaatattaattaaaggtaataaaagcattacaaataatcaataatcataaatacaataaataaatttcttaatcataaaca

SEQ ID NO: 370 - DNA, 1501 bp, Oryza sativa
  unsure (1)..(1501): unsure at all n locations
ttatcgacattattgggtttactcgttgctataaacttaatgctgtatcggtttagtctgatctagccaggtaactcatgtatactgttttatcggtgtgctagtcgataagttatctttacaacggattttccagccaatgtatgctttaaccatggagcttacatttaatattttgtatcaatatcggccgattggttcattagacatctacttcatcatattatcatcggccgattggattgtttgttcaagttcttccattgtatttatctaagtgtcagaatctacatcgactagtgtcgacattggctattatcgctacatcggcttattggccgatcggctctatgatcatcaatttatttatctaactgacacgctcgcatctcatcaaaaatttaggacctgcactgaagctaaacagatttcccaggccttcgtgtttttggcatcaacagtgcctgaagcatttggtagagttttagctttaacttaagttagctagttgaatccataggaatcctctctagcctatcctatcattagttgttgtccttggttgaatcccattcttatatatacacgcatgttccttgcaattcaatacccttagaatactctgaggtgaagtgctacagtgatatacgtgcgcttgcggatttatatgtgactgtatcaagtaccaataaggagacagcnnnnnnnnnnnnnnnnnnnnnnnnnnnttaagccctcggcaggcacacgaccgagccacccgacgcgtcgtcgccacacggcaccgatgctcgcgcttcgccgctgcacggccacgtgctcaccgttaccacatggccgcaccgcacagccctgtcgtgacatcctgtccatccaccgtccgtcaccccgccgcatggctgcgccgccattatttggccacgctaccggctctgcaccactctagccgctgcgcctccccggccatgtgtcgagccaacaggaagaagaagaaaaggaaagagaaccggaaaagaaaggaaagaaaggggaaaaaaatgaaagaatcttctggttttgcaaaaaggtcgtggcagttttgggaaattaagcgcatatttttcagcagtggaaattttgcgattaaaacccaagagctttatgaaaatgtatatacaccctagaaatttgcaaaatcaatgaaaaagcatattatcgcataatagagccacgtgattttgaatttgatcccgaccttgcaagttgaggcacttttattgttgatgtttatgattaagaaatttatttattgtatttatgattattgattatttgtaatgcttttattacctttaattaatatttttaaggtaaaatgtatagatttgcatagaatatattggaattatttgcgggaattgatgtcgtaggctctccagatcttacattatatttcagagatgaagtgaataaatcaattcatcaaacaagcataataaagtatttgatgcctcaagagaag

SEQ ID NO: 371 - DNA, 1501 bp, Oryza sativa; identical to SEQ ID NO: 277

SEQ ID NO: 372 - DNA, 1501 bp, Oryza sativa
attattgattatttgtaatgcttttattacctttaattaatatttttaaggtaaaatgtatagatttgcatagaatatattggaattatttgcgggaattgatgtcgtaggctctccagatcttccattatatttcagagatgaagtgaataaatcaattcatcaaacaagcataataaagtatttgatgcctcaagagaagaatattagagacattgctgggcctttagcctaccagtcaacttcagcctgagatgtgctcgtcaaaccactcgaaggcggcgaccagatgtgttacacattcagtagacttgacaaaatggctaaagatctacaacatgtcaaatattcttaactcatactcatgtgaatctagttcccaggatgtgcactagattcacactttcatcttaagcatggaaatacatagcaagatacatttaagacgaaagtgatcacaaattacaactacttaatagatacatgggccgaccgaccaaatatagatatatcagagaacagcggaagcttgactacccaaacacaagcacaccgactaggggtttacccccaataagttcaagtcctagaagaagcagtcgaaaaacccgcattactcaacttaatctaaacatacaacctgcacaaatagatatttcaacatagcaggagtcagtacattatttctattcaaaggagcgcaatatgcagttcaattttagcataaatcaagttttgtttcacaatacttttgtaaaggagttgatgattcaattaatcaaaacatttttgtaagttcataataaatatcattatatcatcataagcatactcttgttgtcttccttgacaacaagtcatataatcatcatcacactcacacaactcaatacatttcacccattccaaatccaagtttcataacacattttaaaacataagtctatactcatgacactttaccaagcactcatgaccgtgagcatggctaattgattagtttttagactctgcagagtttgtatagctttatccacatgaggtgaatcgctctagtttgtctggtagccatcggtaccaccacactttacatattgagtgggtttacaggtcacaacgaggcttttacattaagtattgtataatccttgcataagcatgatgactgttgtttcacactaagttgtcacagcctgattttccgtatcaggatttataaattatttaataaattattaatagaatttatattaaatgttcattaatttacaagtgaagttaaatgtgggaaataaaatttcctaaatgttgtcgaatggacaacaatgccacatcgaaaggcgtgattctctcaacagtagttggaatgtaaaagcaattgtattgattcgtaaatttttttggggatccccccattacatggccctagaggtctatttatagccttagcacaagcctggaccttctagggtttagggttacagaggatttaacatggttg

SEQ ID NO: 373 - DNA, 1501 bp, Oryza sativa
tagggaggcttgtatttatacccataggtgtccccttgtccaagtagaactagggaaatcaatatggatacaatccgagtagtccttgtcgtttccatgtagaactctggttgtctttccttatccggaactccctcctatatccgtaggttgtttccgtataggacattgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgagcctccgatgggatgggtcataccaacctccactccgccggaagcaggtgcaacgtggaagcacggttgtttgctgatgacgtgaccggcgtcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggctccatctagggacaagtgcctagaggctctcatcattccgacgggacggggcgaggcgtgcgaaaggccgcctgttgccacctaactcgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggtctcatcaccctcgggcccgacccccccgagggggtcaggccacgtgggtgaccgcggctgccccaaacctctagtcaagatatccccggtcccatgtcaccgacagtagcccccggggttatgccagggcgatcaccctcctcgaggaaaacgctcgggcgtgacgccactcctcaggcctggtgacaggtggggccggtctctaaaagcggacaggaatccagtggtcgcaaatcgcgcgcatcggcaagggaaaaaccgaccgacaataa

SEQ ID NO: 374 - DNA, 243 bp, Oryza sativa
ctttattaatttcttgccgcatcataaaaaatactagcacgacaccctatttaattaaggccggccaatcaaactgtgacttgatatctgtgtcttgggcccaccagaataaaagattaaaaattattctcattagagtaacttttagacatgcatgcaaccattgatcaacacagatcaacaccccaaaagagaaaggatttgattgttagagtttatatgcatggtatatttggtttcagc

SEQ ID NO: 375 - DNA, 203 bp, Oryza sativa
tttggaaacattccgaaaaatccggtgcgtgaaaacggcatggagtccggataggttacgcgcgacttatccggttcggtttacgcgggcgccctgatcaggcgatctatctctatataaaccgagccaccgccttcacgcagcacacgcaaaaatcaatctagggtttgcctcctactctgtgctgcgccgtcgctcgtaga

SEQ ID NO: 376 - DNA, 1501 bp, Oryza sativa
gggaggagataggtggtggggcccacggggtttaaggggtcggcccacagaggaagggtggcgcagccatgctggcgccgtggtataaggggcggcgccagtgtggctggcgcccccttcggcctagtcagcacctccacgacagccctactgccacggtggcacgggcacggcgccagtgtggctggccccgccatgttggggtacggcgccagccactctggcgtcctaaaaaggaccatttccggtttaagtttttttaggggtctatttgtaaaataagtttttaaaaaggatcaaaatgtaaaaaattttagtgccggcggctggtcacactggtcgccaggctgcagcagttggaggagtgcctcgcgcggccggggccgctgctgtcgccggagacatggagccgcgtctcgacggtgcacaccatgagcatcatggtgtgatgaagggggcggggcgcccgcggcccgcggtgcgcgccggccttctgctgcacgcagttctgcttctgtactgtgggaggctcactaaggtgaaaattctgtagtttcttacttctcgcgagagctcctttgggatggggaaaatctggctcacatctgcgaccttgttcgtgcctgttttccttgttgctgcatgcggttctttgcttccttagacctcagagctcagacgtaagcaacttattcatgctttgtaaattgacccacttggtgcatttgtttccaaggacaaaatcttcgtacagacgctcttatgtattcacacagtcaaagtgtttgcggtacatgcacttgccgtagagatctactccctccgtcctatagaaaatcaatagtactataaatatctggttgtaggttgagttttttttacggagtgagtagtgacattaggttgatcagcacctctagcctggcagcgcgctaagccatgtcgtgaccaatcgtatctgaatacccgcgccatatactgtaccatgacgcaatctccctgttccggtctggaggccggcgcaagtacagtacagatctattgggtgggtcagggtggctcgtgcttggtttttccacttttgggatgtactatctgactatatctggcccacggcaccccggcagaggcccatgggttttcgctgaacatgacaaaggctagcgccgcaaccatctgcgcgggccgtgcggctccggttgttctttcgatatgggctattgcgttctccttcgggaataagatcactttgactccctcaactgaccccgaatctaaatcgtatccctcaaccgcaatactagaaatcttaacccccgaacttacaaaaccggtgcaatttgactccctcggtggttttggagggtggtttcgctgacgtggcgcacacgtggcagtgttgacctagtctttgtacaacgtggcattgacgtggcgctgatgtggaattaaaataaaaaaatatatgcgggcccatttgttattcacaaaaaaaaatttg

SEQ ID NO: 377 - DNA, 1501 bp, Oryza sativa
tctaggtggatgtttaaccttaatcggtctccatcgaaccgctggtatataaacagtacattggaaaaggcaaatctcagtgggattttgagatttggtgggggattgttggaattaatagatgggctaaggcccattcgaagattaattcttttgaaaatcacaaaagcccacctcatgggatggcatgcatgtgaagtttagtaccaccttgctttttctatgagagggggacctccttaaaagggaggatgccctcctagccacttgaagcatgtgtggtggagagaagaggggaaacacgcgcgctcgctcacctcgcctggcttggcaaggcaggcggcgcgcgtgcacgacgtacacgtcaaatggtccgcaaaattggctcctcacccttgcgcagatgtagtctccttttgcagttttgttttgctgcaggaaattcggatttgttttgttttgaaacattccgaaaaatccggtgcgtgaaaacggcgtggagtccggataagttacgcgcgacttatccggtttggttacgcgggcgccccgatcaagcgacctatttctatataaaccgagccgccgccttcacgcaacacacgcgaaatcaatctagggtttgcctcctactctgtactgcgccgtcactcgtagactactccatcccgctcgccggcatgcaccggtgatcgggagagcaggtctccggaacctctgccttcgacgtcctgcaccgggagaaggcggcaataaggtttttgggaaatgcttcgcgcgactgctccctgttcgtccgtgacggcttgccttcctctctgctcgtgtgctgcgcgccttcgttgacgtccgcaaccgcgagtagttcctgccgagcaaccggtctttccgccacctcggtacgtgttcgacatgttgcgcatatttgatctgctcatgttttactgcttagtttacatgtgtagatctaatgatgcgttcaatctagtttacatctgcaatgtcatgatttatttatggaataaattaaatcattatgcgcttataatttcaacatattgtagccgcacacgtagcatgcagtcctggattgcttgaatctatcggcatcggctgattgacaactaatcaaacataaccaattgaccttgaccatatcatcaatcgaacctttcactggatatataagcatgcatatacacactataggcatgagattttatatatagagagagagagatagagatctgagttgaccgccgtcgacttaattagcattcaagtttttaggagatattctttttatcttggaagcaatgtacatcgatctgccatgcaagcatgcatggatcatggatgcattatgcatatatgcgtgatgaggaagcattatatgcatctggcatctcaacacttgacttaattatctcttgaggccacaatatatagctaggataaagtagccgatcaagcatgcatgaagcacttgaaaccttgtgtg

SEQ ID NO: 378 - DNA, 1501 bp, Oryza sativa
acatttataaaaaaagtatatgtttcttatattatatcgcagctagcgcactgtataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatattggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaattttccattatttgtaacacgcttaattctctgcaaaatcttagtttaaaatcatccctacatatataacctgtgaatctggcatattaatatagccaaggtcgtcgagtcgtgctcgatctgtggacacgagcattctgatcaaaagaagaggaccaaaatttcctgagtgaaattaaaaggtataaatcaaacccctgtccgccgtgacgacgagctgtcagccttggatgcactgctcagatgatgacctatcgattcgtctacgtaagggcaccaaatttcatgttataaatcgttttatcttttttcttaatcaaacttgtttaatattgatgcagtttaagaaaaacataatatatatattttttaaacacaaaacatattcaatgttagatttaattaagctaatttattgttttaaatgtttttatttttttctataaataacttagtcaaactcaacaaagtttgattagaaagagttaaaatgagttatactccctccgtttcacaatgtaaatcattttagcatttctcatattcatattcatattaatgttaatgaattttgacatatatatctatctagattcattaacatcaatataaatgtgggaaatgataagatgacttatattgtgaaacggaggaagtaatatggaacgaacggagtatattcaagtcctgtgtatcgatcattcatgtatatgatcagtcggaatctcaggttgtacatgtatgtagtggtagacacctttgatagctatccattttcacagtagtttcgtgtgatctccacagcctccacagtacatgagagatcgaatgaagagggaggctctactacatatggtcacctgcggtccatctgtcccaggtcaccaccagtacatatggtcacta

SEQ ID NO: 379 - DNA, 1501 bp, Oryza sativa
cgctccgcctccgtatcggtaacgcgtaacgcccgatctggagcgtaatcaactttgtattgggctgggattcgtttgcgggctaaccgattacggtccatctaaaacaaacagatgtaagggaatcaattcacgctggtatctgatacgggccgaaaacagcccaaccaaacagctccttagtgtttatcggttacatgctcattggttttgtctcgggtgaatgaattaattgtttttggtcttggtgcaaaaagaaatgacttagacttttgtaaggagagagtaccatagtatgtcacatccggtattagattcgttttttataatatgtcacatccggtattagattcgtttttttatgacggagggagtatataatagcatattaggcacatgtcagaacagcaggtcagacctggttgtaagcgttaaacaaagttgcactttctccatcctaaaatatataagcggctgggtttagggagtatataatagcttattaggcacatgccagaacagcaggtcagacctggttgtaagcgttaaacaaagttgtactttctccatcctaaaatatataagcggctgtccagatttataatgctaggatttgccacatctctcttcaaattaccttatattttaaggattaaagccaggagtagcaacaagtaatagtgcctgtgcgagcgcgcgtggtgaactgctgagtgccgacagagttttaggggtagcgccggtgacgaccagaaggatgatgtattgccaagcgggagaagctgtgcaactgtctttactcaacaagcagaagcgcacaattgctatatatcctccacttattcatatttgcactttcatctcttagtcccagtttccctcaaactaaattactgaaaactgaaactattttgtgatttctgttcttaaattaagttgagtgggcaaaggtatgtgaacaagagcagtgcctagtgtttatttttagtgagcaccaaagaattcagattctagctatattttgacaaattctttaatttatatctttcattacataaatagttgcagttatatcttctatctgacaatttttgttatgtactccgtataagcgtctgaggcttatttgtgtttgtatgcataaagacatatattttcttttaattggcatatgtgggtacacccaacacttgttttttttctgtgtccgccatctgcatctcttcatttttaagtattgctttaaaaatcatcaaaaaaaatattaacagaatagattcatgaaaatcatcaaaagaaatattaacaaaatatatcggaggtacttataagggtagggtttgtgtgtgtatttatagaggtgagcgcgcacgttgtgatatatatcaaataaatcggtgatatatatcactattgtgatatatatcgcatgcgtttgtaccgtgttttaaaaaaataaatcggtgatatatatcactattcaaattcaatttatatatgt

SEQ ID NO: 380 - DNA, 1501 bp, Oryza sativa
gaactgtatgttctatttagagtcaaatttatttttttctacatatataaattgaatttgaatagtgatatatatcaccgatttatttttttaaaacacggtacaaacgcatgcgatatatatcacaatagtgatatatatcaccgatttatttgatatatatcacaacgtgcgcgctcacctctataaatacacacacaaaccctacccttataagtacctccgatatattttgttaatatttcttttgatgattttcatgaatctattctgttaatattttttttgatgatttttaaagcaatacttaaaaatgaagagatgcagatggcggacacagaaaaaaaacaagtgttgggtgtacccacatatgccaattaaaagaaaatatatgtctttatgcatacaaacacaaataagcctcagacgcttatacggagtacataacaaaaattgtcagatagaagatataactgcaactatttatgtaatgaaagatataaattaaagaatttgtcaaaatatagctagaatctgaattctttggtgctcactaaaaataaacactaggcactgctcttgttcacatacctttgcccactcaacttaatttaagaacagaaatcacaaaatagtttcagttttcagtaatttagtttgagggaaactgggactaagagatgaaagtgcaaatatgaataagtggaggatatatagcaattgtgcgcttctgcttgttgagtaaagacagttgcacagcttctcccgcttggcaatacatcatccttctggtcgtcaccggcgctacccctaaaactctgtcggcactcagcagttcaccacgcgcgctcgcacaggcactattacttgttgctactcctggctttaatccttaaaatataaggtaatttgaagagagatgtggcaaatcctagcattataaatctggacagccgcttatatattttaggatggagaaagtacaactttgtttaacgcttacaaccaggtctgacctgctgttctggcatgtgcctaataagctattatatactccctaaacccagccgcttatatattttaggatggagaaagtgcaactttgtttaacgcttacaaccaggtctgacctgctgttctgacatgtgcctaatatgctattatatactccctccgtcataaaaaaacgaatctaataccggatgtgacatattataaaaaacgaatctaataccggatgtgacatactatggtactctctccttacaaaagtctaagtcatttctttttgcaccaagaccaaaaacaattaattcattcacccgagacaaaaccaatgagcatgtaaccgataaacactaaggagctgtttggttgggctgttttcggcccgtatcagataccagcgtgaattgattcccttacatctgtttgttttagatggaccgtaatcggttagcccgcaaacgaatcccagcccaatacaaagttgattacgctc

SEQ ID NO: 381 - DNA, 219 bp, Oryza sativa
ggccgggggggggggggggggcagccactctggcgcgctccccctgccacctcagcgccgccccaccacggtggcaggaggttggcgccatctactctggtgccctgaaaagaaccatttatgggataagtttttccaggagtttatttgtaaaataagtttttcaaaagtactaaattgtaaaaattctagggcaggcgccaacattagcgtggagga

SEQ ID NO: 382 - DNA, 1501 bp, Oryza sativa; identical to SEQ ID NO: 377

SEQ ID NO: 383 - DNA, 1501 bp, Oryza sativa
tggatgctcttttttctataaatttactaacttaataacattagttttttcccgttgcaacgcactattgaataataatttattatgagctactatatttctatgtatcatttgagattttttatagcaagcaaacattcaataatttattatgagctactatatttctctatatcatttgagactttttctagcaagaaaaagtaccaaaacagtgtgaaaataactttggttaataccgtagcgaagcacggacattttgctagttcatatagtaagcatatactccctctgttacatttataagacattttgactttaactaaagtcaaattgctttaaattaaattaaatttgtagaaaaaaataacattttcaacctaagacaaattattatgaaaacatattcaattattgatttaatgaaactaatttggtattttaaatattactgtatttgtctataaacttcgtcaaacttaaaatagtttaactttgaacaaagtcaaaatgtcttataatctgaaacggatggagtattcttctaaggccttttacagtgtggtgagctggagcgttatctcgcacaccacgtcggacccgcgcatatgtggtgacgaagcatggtactctgtttagtcgcccaccccctatctgggcaatgagttttctcgtcgaaaggaggacgcgtgacacagggaatcacctcgcgtctgcgctgtggaggtcgtagcttcaatcctctgctccctcgctctgcatctttgttcccgcgctagaatcattgctcccgtccagctctgtctgcatcgatgcgccgtcggatggggaggagggagaaatggtgcggcggaggaaaagcggcgtggggccggagagctcgttggccgcgcctcttgatctgagccgcctggagctcgttggccgcgccgccccttgatccgagccacccggacctcgccgcccacgccggctctcgatttgagccacccggagcgccaagttcgtcgtcgccaagtgtccgtcacggtagggggagggaggcacccacgtccacaaattccaccctgacgaggagagtagggggaggggagttgatgtcatgtgccagttcagggagggagaggaagagagagaggggaaggagcggaggttggtttggtgcaggagagattgatccgggaagatgaagagaaacgtcgtggtggggtcggcctcaggaaaataaattgatggggtccacctaaagctacactacgcgtgcccgcactgtgaagagaggtgcttcgactcctttttccggggttttctcctatgtggacatatgggctcctcacttttgtgggacgcactgctactgccctaaccgtacacagttcccatcgatcttcatgtccaatccatcttctagcttgctacaactccctttctagtttccacctcttatttgatctatctattgttatggagatatgcaggttgcaagcagctagcaaagatg

SEQ ID NO: 384 - DNA, 1501 bp, Oryza sativa
tcttcaatttttataatagtagagatagctttaataaaacaaaaagtaaattgcatcgtcggtacacaaacttgtcaggtgggtgcaatctagtacacaaacttgtaaaattctcgtctttgtgcatgaacttgtctattgcgtgcggaggaaggcgaaaaagacactatatggataatcttattgatttagggcatatatttgagaaggttgctattagagatgtacctcttcaataaaaaaaatagaataggatatagtgatagcagaaaaagattaaaagacgagcaatgatataaatgttagaaatatatgaaattcatcatttccatgatgaaggatacaatatagaccaaatttataaatattgaatgtcttatgcatactcactacacgtatgcacgtcacatcctaatcaacgtcaacttcgtaaaattaacattgccaacatattttggtcctcattcgcacaaactagacaagtttatatactgaaacgagcattttacaagtttatgtactgaattgcacccaccaaaatagtttgtgtaccaccaatacaatttactcaaatttagatcaaaatcaaaacgactttgtaatccgaaacagatggttgtaatctgaaacggattgagtaatacctaatcagcctaaaaggctggggggccggcccttcagattcttctctcgtgatgggccgtagtaggcctgatgggacacatgcccaatcttttcggataggcccaatctgatttgtatctttttggttaatttttttcagtttatcacttgatgaattcataaatcagaaggttaaattggatccgtgaaaagaagaaaacaaaagtgaaagcgaatgtatttttgtagtcgaaaatcgtttctatatttgcatatcaaatttgggttgcgtgttcatggagggacaccggacacgcgatgaaatcatctgcgcatcctgtactttcaatttttcctgtgtcatccaataaaaaaaactaattcaaacaaggaaaaccaagtgttgaaacatggtaaatgatttaccgttggatcgaccgatcccgttctctcacttcaacagccatatatattatattaggcccatccacgaacaaatcgaaccgtcgaagtgactctgtagccccgtaactggaaatgaattcatattcagatttgctagtcctcacggccgcacgctctcgcatcctcgcgtttcatcctcctgtccgtgctgtggatggactcaatgtttttgttcattgtttctcggtaaaatttctgcaattttgtttgagaattcaaattttgtttgaaaattttcgtgatttcgctgacccccgaaatttttcccatttccgataggttgaaccattttgatcttcaagactccaactcgtactcggtttgtagcccatctccgactcggattacacgtaggcgcgcgcctatttatagctgctgccctgcccgtctccttactccattagcttgctag

SEQ ID NO: 385 - DNA, 1501 bp, Oryza sativa
ctggcgctgtcgacgtaaaaacccaagaaggcggggcgggtggaggacggccaagcggcggaggaaggcccggtcggaggcgtggcggagccagcgcctgcagacgagcgcggcgcggacgaggaaggtggggtgggcgagtcgaagaaggatctcgcggaggaggtccccgtcgtcgagcaccgaggaggaggaggaggaggcggcggaggaggccaccggcggcggcggcgacggctggggagggcgcgggcgcttgcgatccatgtggacgcggttttgggtggatcgtggggtaattaccaacaaatggagacttgggagacctcccgttcatttggggatgtaaatcgaaatcttgatttgtcctttcgatggaaaatccatcatcatttaccccatccagagtgctaaggttagtctattcggagcattgcggtaccaaataaaagtattttactttgttctaaaataaaaaaaaagaagtaaaataattatttttccttagagattgctattatatgatatctcatcccaggtcggtatggtaccatctgggtactgaagttatgtatgttatggtatagtgtcattaccagacctgatttgaaagagggagagatcgactctccaactcggtggctaccctcctatccgacgacagcgtctccctacctacctgtagccaccatcgtcaaatccagccaagcctagatcatcgaagtcgagtctaggctaagacagacaacgacgagatctggcatccttgagtttgggacgtaccaaattcggtggctagaaagtttgggttgtagatccatcacggattggcaacagagagggcgtgatgttaggggcttcggccaccttcgggatgtgcaggggcccaggtggagtggagctttgagacggcaacgcagttcactgatcggctaagaagccatggcacacacaggtctagtcaagtttaccttcccacaacacacacgcagcactaaggttcctgtggcaactgaactaggattcaaagccaggatgagtggatctaccactccaagccctttcctattcttatactaatatatgtaagttccttgcatttagaactagaacgtgaggcatagtaatggcgcatgtgtgatattttattgatcatatttaggctgctttaggaaagcagtcaagcgggaatggaaaaaatgtcttctactgctatcttatgtgctaaaatggaaaaaatcttctcttcttctctatgtcactcatcacagtcggagagacccatgagactttcttttctcccggtaggctctagcgctacaatgcttatggctgcaatccaaatagcaatggtcctcgcggatttatgtgcacccaatccattaaggattcctggtagtgagattcctctagtcaagtctaaggattaaatatgagggatttcatccagtccattgcggaatgtatggttacaaaatagactcatccccctgcttatagt

SEQ ID NO: 386 - DNA, 1501 bp, Oryza sativa
cgatcaagttacccctattgtatatttagactaactggatccgtcaaccctttagagccctatgtcgccaccccaaccatatatatgctctattttgacattgccaccatgacccgttcatcatccctgacccactaggaatagggatgcaagggtgatctcgtgctaggagtggaattggcttgcagcaatggctacactgttgtcagagcagggcgtggaatctgttacgaagctggtgaatctaaaatgggtgtccaaagggtaggctcgatttttctttgttttgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggcccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccgcctgactgacccacgtcaatcgggtgtgaccagtctgtgaccggcctgttgtcggccacgtccgattggacgggtggccgtgcccccacgtcgcctctgtatccggcggagtggaggtaggtatgtcccgtcccattggggcgtcatccggggttccctccacgcgaggaggactgccacaagtcttcactcatttaagagggaatgatagggctgtcccccgtggcaggcggggggcggcgccgggtcccactaaaggacggactgccgcttagcttccgggcgaaggcacggatcgtggtccggtcaaggtaaagtgggtccctctcccgtaaaagagtaggtaggagcggcgcatgtggtatccccttgaactataaaaggaggaccttgcccgccgaaaaagggggacaactcccagcaggcctgagctttagagggagcagaccaagagcactctccagagttggggaacccttgtaacactcaatcataaatcccacacacaagagtagggtattacgctctatagcggcccgaacctgtataatcttggcacccatacgcgatctagaaaccctgagggcggatacacgatctcgagaggtgaaccctttcccccggctgaactcaaaaaggaggatctcacgatctcccgctagagaggatcattcctcgacagctggcgcgccaggtagggggaattcgcgtgcttcaaagagaagttattttcttctgccccaagttttcctccgccttcgacgatcatggtcgaggtct

SEQ ID NO: 387 - DNA, 1246 bp, Oryza sativa
gaggccccccccccccccaaccccctcccccgcgctatccctgctcttcgttgttttggttttcctatagccccccacctctccccccaccaaaaaaagtagattagattttgaatactcttagccttttttaacctcttttacatcctataaaaaaaataagttagggttttttctgctatattcgagtgtcatttcttaaaacaggcgtaactttctcatacggacttagaatcaggcaaataatatatccacggacatctacagaaaaagttacatccaattctccctggctttgctgagttcagcgagattaaaacctccaaattcagctttcaagattgtgttttcaagacgagaagcttttcggtagagctttggaaaattttacaggtcacatatttcgtccatttgagttaaacttttctacggttggttcttgtgggttcctaagtatgaaaaaaatatcaataaaataaaaataaaaaagttgcacatctctctcatctacactagagaggaaaaattctacaagtcacgtatttcgtccatttgagttcattttttctatggttggttctggtatattcctaaccatgaaaaaatatcaaaataataaaagaaaaataaaaaaaatgcgggggccggggggggcagccacattggcacgctccccctgccacctcagcgccgacctgccacggtggtaggaggacggcgccagcgactctggcgctcaaaaaggaccatttttgggataagtattttcaggtatctatttgcgaaatgattttttgaaaggaccaaattgtgaaaaatccagagcgcttgccccctttgacctttgtatactgatgtcagccttcacgccggtagcatatctcctacgtcctccgagctccacccttggcttcagcacgaagatttgacaatgaagaagacagtggggctgatcatggttggtagcaactagctagcccagaactcctgttttattgattttgatcaagaaagcactttttcttcttaattttgatctactgttttcttgattagttgttgtaagttccttgctccatcaggtcttctagacgtgctggtgataaacatgccatatacatattatatatttaaaattatgagtgattttatagttattaagaagatattgggagacatcatatattttctagggaaaagtccattttacaccctcaaactcttatgcttatccaaaatacacccc

SEQ ID NO: 388 - DNA, 1501 bp, Oryza sativa
ctagggccctaaacccctaagacagcaggggtattattcgagcctaataaattcctttactcaaaccagtagtgctttatatgaaaatttctttgatttaccactcgcaaaagcttattgtacaaaataccgttaacgaaaatgtgtaacataggccatttcgtagaattcgttatggttttcctcctttctaccattatctctctattattacgtttataatactcaaaatatccgtaggcccgttattatttacccaatggccactctaccaaggatttggttgagatcaagggtgaaatataatgtgtatttagatgcgatagttgtcatccatattattttgaagtagatttgaagtgagtaatgtgggcggattgcttcggatatcgaagatggattagagtcgatgcaagcttagtttaaaaatggattaaaattattggaggttccacgtatatataatcagttattaataatgagtcaacaatgcaacaggcaacaatataataactatagagcatatgatttctgaacatgatttatactctcgaggacaataatcagtcagctatcaagagacgagagtcggagaggcatcgcttgctgctgtctaccatcgtgttgtaggccatcaccagccgtggtggaaatcacattatcatgaggctatatgctgagtcggagaggagattaggatggccggaaggggcgtctcttgccgctcgttacatccctgcattgcgttggtgagtggtggcggctacataggtgtgaggtgttacagtgtgagcttgcgatagaggagtctaggttatctgatgaattgatgcatgggccaacttatattctatggaacaaatggagtgattacatgggttaaaaacaaatggagtggttacatgggttaaaattttttggataatccaataaaaattccgtagcataattagtatccaccagatattaggaacaccatatctatatctgaatgcacgtattatatctactagatttctataaatacagtcataccatattctcatttcggatggatttgaagtagatctgatcttatctattttaacccttaggccctagtagtgtaccatgtaacgttgctagtgcatgtggttcttgatcaaagaagtcgtgtgtgggatacttttcattcaaaaagtacaaaaaaggtaaaaggggaagaaattttttcgtgtgatggcattcatcaaattcatttcgtagcggcatttagtagaacgaagcattttgtaatgacgaattgtacccttataaaggctactcagagtgagtatgacattttatcgattttacatcaaggtgtctaagtccgtcctcgtagggtctttcgtgtcctcctccctcacgggcgacacgggaggcggcaaccccgccgtcgcccgttccccccttcctcctccgcctcgccgtcgccggcaaagccgcgcggccacaaggacgatggcagcggggcttcgtt

SEQ ID NO: 389 - DNA, 1501 bp, Oryza sativa
tcaaacaacgttctgtacagtacatgttcagcagtgaatgattttaggtggagttttgtgcttgtctttgatgtacatctacacttcaaatgactatttatgggtcattcgtgtggttaattggattgctagtagcgaatgcgtactgcatgtgtactgacaatagaatttgttacttgttagccccttttattggatcatcagctatcatgtacattttgccgattccgtttatctgtgtgtcataactaaccttggttgctctgtgatctagttcagctatatgtgctcgtaagataatcaccgggttatttaattggacaatcatcatcgctcaattagacaatatcacctgtttttttattataagacattttgtttcattaggataagattttagctatcattcgctttattaataattagttatgtgacatggaagcataattagtaagcatttttttaataagaatcttttctattaaaatagcgtaatagagaaattgtttgttaaagtattatcctcgtaaaataaaatatgtatatgaattccatttagaaaaacgtcaaggccttattaaaaagaacaccacacactaattatatacttgagctacatagtcatctcctatgttataaaatatacttaagctacatagccctctaacttactattgtctaactttgagggactgatatgtggacctacatgtcagtgacccacgttagagggcagtactttagatgagccctttcccaaccaaccatatacgatctcgaggtttctcatatactctctccgtcccaaaaagaaccaatttctcgctatgaatctggacaagatcatagccaggaattggttctttttgggacggagagagtacaatctaggtataaaatactccctctatcctaaaaaaacccaatcctacgtttgaatatgtatgtccaaattcaaacccaagattagtttttttttggagggggtatgtgtcaatcctgttataaaagcaccaacttattttgtctctcgttatttgcttgttagcttatcaattccaactcaaatttaattttattaagttgattttgagtcttttttttattgtagtctattttctagccttgccctttttctattgtaaccaccaaggtttaacggaaaaaaaattgtttttggttgcttttttttcgacttatttgtagttctaccatcatagccaaaggtaaatttagcaagggtttcgccaatttaccttttaattttttaaactgttgaacatataggggtgggcagaaaaagaccgaaccgaaaaattcaatcactaggccagtcaggtgttgaaagattgaattttattcggtcaattcggttagtactcgatcaacaacccaattaaaccgaattttgacccaattttagccttcagtatgctttgatttgatccatgatagtcaagagtctattttgtgtttatatttttttatctagaaattaaga

SEQ ID NO: 390 - DNA, 1501 bp, Oryza sativa
tatactaatatgagttgacaccatggtttttagaataattaattggttagactttttttatgaaacatgctaattaaccggatttaagggttaaacttagcatagatgctcatacttatggttaatttgttaatcttaagatgtcaatgtctatcatgactatcaaccttaaaatataccagcccggtatctattatattattaaaacagccttgaaagaaggtaccacgttcgcttaggggctagaaattcccacattaatcggagaaaaagaaaaagagagtccaagtataaaatacaatttaaaaataaaattcgcaacaaaaaataagtaatattgaaagaagagtctatataagaccccaatacgagattattcaaaatttgaaataaaaataaaataaaatccgaaattagaaaagaaaaggagagttcaagtagtaacaaatttagaaatagctgaaattcggaattaaaaataaggaatattgagagaaaagttcatataagaaccagtacgagattatctaatattcaaaataaaataaaaataaaatccaaaattagtaaaaagtacaaggaaaatttaagtaggaatacaatttaaaattaactaaaattcgaaattaaaaataaacgatattgaaagaagaatccatataaaaacccaatacgagatcaattaaaattcagaataaaaaataaaatcatatccaaaattagaaaaactaaaagagagttaagtaggaatacacttttgaaacaactgaaattcaaaaataaaaaataaaaatatttaaagaacattatacggtattaattaaaatttgaaaaaaaaaatctaaagttggaaaagaaaaaaaaagatttcagttagtattacaatttataaataactaaagttggtgataaaaaaactattgaaaaaaaataccatctgaaacacatgacgagataaattaagtaatagacctataaaggagtagagtggtggcggttgatacgacatataaaactgttagtaaaacaccaaatataatcctaatgatgattaaaagaagggacaacaggcaggccatgaagcaaacaggcaaggcggttgccgggacttctagaaagtaaaaaaaaataaacctcattgataatcatatttgatttttaaaatctcaatgacaataaaaatgaaaagcagcgggcggggtgtataggagtatagttgcagagccgccgacggttagcgggacttctaaaaaataaaaatgaattccaacgatagttatgtttgatttttagaatcacattgataataaagagtaggcggcagatgggccgtagaggagtatagtaacatcgtttgacgggacttctaaaaattataaaaaatgaaacccaacgagacaataaactctgaaaactataaggtccaactcttttaaaggttcgaaacttctaaaaagtaaaaaaaaaccaatgaaaatcatgtttgattttaaaatcttaa

SEQ ID NO: 391 - DNA, 1501 bp, Oryza sativa
tgcctcctaatctgggtcattcattttttttaaaatccatgcagtttttttaaggagggtaacatatgcacaggatattctttttggctttttttttgtcagtacaatgtatttatatgtacgtgggatttttttgggaggagttattttttaatagatgtgatctaatactataactggttcatcaatttaagtgaaaatcgaaggtcagaatttctagtatttcttattataattacataatttttatatgaagatgaatgatcaaatatacactcaaataatgtgaatagcataaaaaaagtaatggttgtaaggcaaaaaaaaaagggttaaatgggggagtgaaagaagcaggtgtatgtacaaacgggatgaagcaggtgtatgtacacgtggctaaggcctatctattaattccaacaatccacttcaaaggtgcttttttacattatattgggtgactaatagcaaacaaattaacaaccaataatcccaaaaacaaacaactaacaatttattttatgtcggtttattataatttataatctagattacaataatcttaagctgaaacaaattttaatctaatataatggtctaaaataatagacccgccaatttacattaaaaacaaatttattcggtaaataatgaagtaagcacgtaaagaggatgatattttttggcttttttttcaggtgaatagtactatatattcgtacgtacttaggatattctttttggtttggtatgatatataccatgcaatcgggatgagggagccttacgtacgcgcaggtgagatgaggggaaggactaattttttttttagtctaatcaaatctaatggcctaaaataatggacccaccttttaagtgaaaatcgagggctagatatttttaatatattaaaacgtcacatggtgatctaggagcgcttttagaaatcccatgtggcggcttgagatcgtttgtaggaagtttaatggacttttagtatataataatagatagataataactatcactaatatgtaatacaattatatacatatgggtcctccgactacatactagcccccatataatttaattttatcgtaccaggatagatcacatctcatactagctaggttaagtaagcttttatccaaatttattgtattagtatgggtcacattccattataggttaaggttgtgtttttcaaaggtttgaaacggctaattagccgcacataaaatgagaaatgtgattagtacataattaattaagtacaaatatataaaaaattgatgaataaatttattatatttttaaacaacttatataaaaaaaagtttttacgtaaaatgtattgtttaacagtttgaaaagtgctaacggagattgatgagtagctaagttccaatagctacaaagaacgcagcctaagggctcctttgaatcgtaggaatgaaaaaacggaggaataggaaaaacataggattctgacagg

SEQ ID NO: 392 - DNA, 1501 bp, Oryza sativa
ttcaagtctcagtaaatcaagaaaaatgcaaagaatccattaaaaatggttttgtttcctgtttctatagtcttatagcatgttttgcttgtgtgctttgtttgtcgcgtaggtttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgactagatgttggtttaggaaatgcttagccatgcttagttcaactagcacacaaatggggatcactttattacatagactttgtctatgagcatagctttggattggtgccaccgcaatggtgttagttaattaaaatacattgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgctcgctgctgaagtcaagcttcccggtttagctcgcttttatcttttccgctgcatttttatcttttctatttttgtaagacgtggatctgtatgtcaacaattgtcgtttgtgtacgctggctggtcctggacagggatttaatgcacattcagcttagaaattctggtttgagaatttc

SEQ ID NO: 393 - DNA, 514 bp, Oryza sativa
tagtggtgccactatcgctgtgatgatgcactgccatatatatcaccggccatcgatcaacttcctaccccatgcagccatacctattattgaagccccctttgaacacatccttctttctctctaaaattttcctcctccgaacccctatctccccccccccccaatactagctaatcgggtgtccaagtcagtctgtgggcaatatttatttttattgaaaatattgagcactaaaagacgaatgagaggttgaccaccacatcattgcaaggggagctcgattgattcgcaaattggactgacttcaaacttttcaaccggattaatagtcaacgactttgatagcctttccttacaaggtttttaatccatcgccccattatatttttcttaagtttaattacacttaaaaacttaatgaaaaattagaaacgacttataattaaaacacagaaggggtaccctatatagactaagtcaaaatataagcttccatctataaatggccaaa

SEQ ID NO: 394 - DNA, 1501 bp, Oryza sativa
ataggtttaaccgcggtttctttgtcttcgtttgttgttgattgcaggatcaaatcaagtggcacgcttgcatacccgaaggcgagttttggacctgcactggagtttttcatcaacacgcttttggcacgcttggtgggacccattagaagtcagaatcacaacagcagtttttctccatggccgagaaaccaccagcatcgccgtcctcggctggtcctggctatgttaaagaaaagatctagaagctgggcttatccgaggttgatgaagccaacattgtgcccgtcactctagacaagttgacacctgagcagcaaaaagaccttgatacaatgatgcagtaagcacggaatcagttcttgagctcattcacggagacccgcaaggtgacattggttcagaagtacaaagtgaaggtagttgctgattcaggagcttgatggaaaagaaagagttgtattctacttaagtcgttgactcatggatgcaaaaactagatattctcctgtggagaagttgtgcttgtgcttgtatttttcatgtacaaggttaaggcattatctattgtccaacgaatgtattgtcatatgcaaagccgatgttgttaagtacatgttatcggctccaattttgaaaggaaggattggaaagtggatattttccttaactgagtttgatcttcggtatgagtcaccgaaggctgtcaaagggcaggctatagccgattttattgttgaacatcgtgatgattcaatcggctcggttgagattgtgtcatggactttattctttgatgggtcagtgtacactcatggttgtggcatcggcttggttattatttcccctcggggggcaagttttgagtttgcttatactatcaaaccttatgcaaccaataatcaagctgagtatgaggtagttctcaaagggttgcagttgctcatggaagtagaagccgatgctattgaaattgtgggggattctttgctagtaatcagtcaattggcaggagaatatgagtacaagaatgatacattgatggtttataatgagaagtgccaagaactaatgaagaatctttggctagttactttgaagcatgtatctcgagaacaaaacattgaagctaatgatttggcccaaggggcatcggggtataagctgatgatcaaagatgttaaggttgaagtcgctgcaataacaaccgatgattggagatatgatgtgcatcaatatttacagaatccatctcaaccggcttctcggaaattacgatataaagcgttgaagtatactttattggatgatgaactctattatcggacgattgatgcggtgttgcttaagtgtttcagtgccaattaggctaaggttgcaatcggcgaagttcatgaaggaatttgtggtactcgtcaatcagctcataaaatgaagtggttgctgcggcgtgtaggatatttttggccgacaatgctagaggattgtttcaagtattaca

SEQ ID NO: 395 - DNA, 1133 bp, Oryza sativa
gggtatagaatagttattttataccccgggtgtagagctctaactcctaaatataactccaggagttgagtctggagtggagttgtggatctgcataaacctagctccacaactccagtacattttgtgagagagctccacccaactccactcccagttttggtggagctgaaactgtttggctgagctccagctccagaagggatggagctggagctagagctgtgccaaacaggccctatgttgaaaaaaaagtccataaaaattaagtgaaattctagactgatccgactatatatatatatagtcgactatatatatatatatagtaggtctaacgtctccgtactatttggtatttggttttggagtggccatagttaggacgttgggattggctcattttggtcatgagaccaccacggacgggagcacgcagtcgacagacatatgctgaatcggaaatgcctggacgaataattggagttgcatgtaatgttgtggcgtagttgtacaaatctcgagaccgtgttttcgttagtcattttgattgaattgatctctagtttgatgagcaatgacaacagaaatttaaatgatgcatggttcttgtgggggacatggacatacgtatgtatcattataatccaaatcgagaacgggatgaactatgacaccctgatttttgttttagtgatttataaattatttatagaatttatactaaagtttaactaatttattagtgaagtaattgtgggaaataaaatttcccaaataaaatatgtgggaaaaaaaacatgcgggatggggcatgcgggagggggtatagaatagtcttaccctatataatagaatagggcaagagctcacgaaagggtttactgtagtttcaccacgatattactggcaaatgtgcaggacacctaaaaaacataactttgcctaaggacactctaaaaatgtggtaatttattgtagggcactggacacactaaaatataatatccatctaaggatgagagagaaaccatataaaataacatttttacccatatcttcttctcctttttccggtcttcttccgacgctcctctcacttgtgccccctgctgtgattgtaaaggaaacca

SEQ ID NO: 396 - DNA, 1501 bp, Oryza sativa
tagtttcgtccatccacttttatcctttttctccatgtaaaagatcgacgccattcaagaagtagttcaaaactgtggcctacgcatacacaaaaaatatgctaggcctaggcatacaaaaaattaacttttgttatcaattattttttgtatccatctccatatatatcgtcatctcattctctacatgtaacccatactccgagtgtaatcagtaatattaataatacagcagcagctcagacacaaaagatgtaataatcctctcaccgcgaatgatttgcccaagattaactatatctattatatcactacatgtgattcagacggtaactctgtaataacatcccatgtccaacaatcaattcgagcccaaacatgtgctatgtgacttgtcgacacacgtataccacacgcatatgtgaatcgatcacatgcagcagagtgaacaagctatgcccatggaagaaaaaaacacaaaagcacaatatattgaagaagggcagttacaacagttacctctaccaggtaactacctcccattgatcttgaatctggggcgaatgcgtctcatcctagaagctagaacataggcacactttactttccccaaactaattaaatgatatattgtctacaacttaaacagaaaaacatagactccagtttgaacagcatagagtactccgacttaattaaatagaatacatagtatcaagcatgaacttcaaattaaaacacataaacaggtcataggtctttctcgcaccgaggaaacactccgcttgcaatttttactggacacagctgagtggcttcctttatttagttcatgccatggccataaccatccttgtcatccgtgatgacatcggcagacacatcactcccttcctcgaaagatggctgccccaggaagtcaatggcaggaagggcgagggcgacttcccttgtattgccaattgtaggaagggcgaggatgagttcccttgcatcgccaatggatggagggatgatgaactgtggtgttcgttgcctcttcttgtagatgcgacatatccgcaaagaactatcaggttcgaccatggttttctcaagtgggccatgagtttgtccagctgatggacttccattgttttcctgcaaaacggtcgacatataatatgttactagatgctgcttaaggaggaaccatggtatatatagcatgtacaacaaagagagatagatgaaatctattaatagcaaagacatagttgtattccagatttgtgctaatcatctagtgactgaattagaaggaattggtatcttctatgtccaattttcttccatatatgggcaaaggagtgtcatcaatctaccatccggtttcaccaataaactgtagagatgtcactttccatgaaaaggtacagaccaggatcaaaacatgatctgaacatcccttcccgacactaaggggataatgatcatgcatggagctcaacaaagagtttca

SEQ ID NO: 397 - DNA, 1501 bp, Oryza sativa
cgtaaatatattataattgtaacgtaacttatatgtaattacaatgacattgttttttttcactactagaaaacgcattttttttccgacgtgggggtcttattttcgcaggcggacatgacgcttagagctaaatgaccgcttaagtggttcgcctgcgaaaacaggcggacatcaaatttcacaggcggaccacatgaggtgcgcctgcgaaaattagcatggtatatatatgtggcacatgcggctgaaatttttctaaggggctgtttggttggctctcaaaggttgccatgtcaaaccttaggcatgtcacaattttttagtatattgtttggttggttgccacaattgtatgatgcctcactttgctagtcattgaacctatgcatcatagactcaaattcttgccaaacttagcacacttgtggctaacaaattgctagcctcactttgtgaggcatgacacattttgtggcaaagtgaggtgtggcatgacacattttgtggcaaattcctcttctctcccctcccctcccctcccctccccttcacctctcctctcccctcactctccccgccggcggaaggggcggacggcgcggggcggccggcggcggctcccctccctccctccttcccctccagatctggccggaggggggaggggggatgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacatcgaaacaaaagcagcagcagcggaaaaaggcgatcctagcggggcttcagctccactccacaggcaaaactcaactggggtctgagccttggtcttctaacttcatcttcagctcagaagcactacacttctgaaaagggggaataatagcaagactgagtacaaccaccgtactcagcaagccacaccaatgatgcagacgtgcaaaggaatacaaggaggggtttgtggctatttgcataaaggcggttggaaaacattttatttagcaaacagtaaaacggttgggtaattaaagtaaattagatctccactgatcaacgctacaccacgttgaacaggcccaaccaacccacctatactacagtgcattgggtcgatttattaagatgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggc

SEQ ID NO: 398 - DNA, 1501 bp, Oryza sativa
ttaatttgacgcaagtgacgagaatttgtgcatatgccttttgtgcttttctttcggcggcagattgtaagcttttccgggtctatcttagctttaattgttgcctaatcctcgctcgctccagagatttctccttttttgttccaactgaaatccgctctttcaggagcaccgtagaacgttaacgaggctataataaggaattatgtgaccatattttgcatgttctagaattttttttctttgttttgataattttctagggacaaaacaagacaggtcattttagtcatggatgattggatgttgtgatcaaactctggcaacgaaaagcgcagaacaaactagggattcgaatttattttaaatctattcaaaacagcttgcaaaaacccacgcaaaagaaaaacaaatcgctaagagaactggtgtggtgcacgtctcaagcggcccaagttggcccagtagcacgcgggctgcatgcgttgcgcgaggcatgcgtgacagccggccggcggcgttcagattggcgtttggtacttgggtgaaagtatagttggccaataggcccgcagtccgacggcccgacccatggtatgaagatttggcccagcccagacacgacacggctcgactgttgttaggcctgtgctggcccgacccgacccgaccgtcgggccgtttctgggtctcttacttgacacgacatgccagcccagcacggcatggtccaacaatcggcacaaccgcggcccaacattcctggctcttgcaggccgtagcccgtcggtggccggactaaagagatgagggagccaaaatagacttattaaaaggacgagtatggtaggctgatcttgccttcgggccgacacgacatgacccgagtcttattgtgggccatgcttagatgcaacccgtgggcggggcacggcatgacatggcgtgttggtcgggccgtgccggtgctggcctgactgatcacgggccgtaccttggtcatgctcaggctgggccgtgcagggcggtccatttggccatttatagatggaagcttatattttgacttagtctatatagggtaccccttctgtgttttaattataagtcgtttctaatttttcattaagtttttaagtgtaattaaacttaagaaaaatataatggggcgatggattaaaaaccttgtaaggaaaggctatcaaagtcgttgactattaatccggttgaaaagtttgaagtcagtccaatttgcgaatcaatcgagctccccttgcaatgatgtggtggtcaacctctcattcgtcttttagtgctcaatattttcaataaaaataaatattgcccacagactgacttggacacccgattagctagtattggggggggggggagataggggttcggaggaggaaaattttagagagaaagaaggatgtgttcaaagggggcttcaataataggtatggctgcatggggtaggaagttgatcgatggccgg

SEQ ID NO: 399 - DNA, 1501 bp, Oryza sativa
agattcaaactgagatcatatagatttccccccagtactgttgttgtaaaacatcttcatattatagcacatgaacataaaaacacctatatatgtatatattgctcactgttaatgagggaaagtttactatttgccaaccaataaatgcattaataattatttgctactacatgcacagatatggctgctgattatttggcatctagctgatcactactcccagtaaaatgacaatttaaccaaactatctgcacattacccaccccactacctaatcatgctaaccttaacttttcgcacagaaaatcgactcctttccccactaactagttgctcttgtctggcaagaagaaaggatttgcagagtggtgcttaacccttcctgtgtctgctccacatcaaatttttttctaattttatgagtatagctagtgctgcgaaaaactatatgcaaccaaagctattttacttttatatcataccatgattaaattcatgttgtgcttttggccatgactagatgtggatagcatttatcgttgcgtattgcattgcctttaaacttggcctaggggttggcgaaatcctaggtttcctgcagtgacagaatccctgtcattgtaaaaatcccagcacacatacatccctactgacatcttgtgcaaggaaatgtatcttaatctcctgcacaagaccactgtgacatgtgtaggggtaaagtcgacatgaattacggtgtcccgtgattatcagtgggtaaagtttggagaaaattatatacaaaaaatgtttcattaggggcacctatggtggcgtgaagctagctttaaactcgatcacatttccagcacaaggccccccaacgtgtgactagcaaacaagaaaaggaaaagtcttaccaaccatccaaatgataatttaattacaagcttgcaaacaaggctcattcaccctttaattccagccttaataggcgcccacagttttcctaatgattactcttgtgcatgtctcgtcactgctgtctcctcccccacaaagcaacaaacaggaagtgaggtagagtgagattaaccggttgggtgaactctcaagggatggaaaagcacaaaaaatcagaagagaaactgacattggggtcatcatctatcccctccccatctcaaattcttcttcttttgggctttgtgtgttagtgcatgcatgcactcatacacaatggacgatagctctatagctgttgcttggagatatatgatagagttgtgtcggagtaagagacaaggattgatacggcacccacagctgcccatccaagtgtcagtgatgagttggagatgcccccctagctgggtgctataaatacagccctttcttggcatccatctccatcaccacagaggctttgagtattcattcatttgagtgaccctatagtgtaactcgagcgagtgagcgagtgatatttgtgtgtaggctgtagctagcgagctaggac

SEQ ID NO: 400 - DNA, 1501 bp, Oryza sativa
ccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgctcgctgctgaagtcaagcttcccggtttagctcgctttcatcttttccgctgcatttgtaatcttttctatttttgtaagacgtggatctgtatgtcaacaattgccgtttgtgtaccctggctggtcctggacagggatttaatgcacattcagcttagaaattctggtttgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcaggaaaaatcttggtcgttctttcggatcggattttttttaaaaaaaaaaattagctcagtctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttacttgcattagtgtctttatttgagttcatgaaaaatgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtcggattgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccatttctcatatttctacctatccccttcaga

SEQ ID NO: 401 - DNA, 1501 bp, Oryza sativa
gtgtccctacatgtcacctcttttatgcagataaagtgaagattttcaataattctacgattaaggaccgtcaggttggtgatgccaggatactgcaactgcagcccatagcatctctgaagcctgaaatgagaagattgcagaattttgcaaatgcaactgattctctctgatcaattgaggagttcaaggtagcatgtaggccatcatatgatacaatgcatcatgtcaatccaatcaaatcatccagagtttcaggccagtgaatggccaagaaaagcgttctccagaattgagccaacagtcacctgcaccatcctgcagaaagccataataaaagcgaggaggaaggaacagagaaaaaacggctgtcatctttcagaccggagcatttgtccggtgtgttttcagaattcagacatgaattccggaggtcagaaagcaccagccccccatctgcttaattacttcgtccccaccgttccgatcttttaatttcatggagtcattagcacacttcccaagttgacatgctcgcttctccagccatgtgagctaaagcggtgtggagaagacaacctgacatgtgatctttcacatcttttttttgcaggtgttgttcttcggattaccgggtagtttgtccatgaactgtgttcagtgataaacttcttctggagttctggagattgtgaagtagttgatcctacattcggtgctcgagcaatagcaaattcgttccagctgaaaagtataaactcatgactactgatttctgaatattttgggtattcacctctgaactctgaagatattcagaacactagtgcttatcaggcctgaatttatagtgacaccactggcccatgatggcataaaaccatcatttggatcacactttgattaggccgtgcagccccaaccacaagtccaaaactgaccaagaaaactttgatgccgcatgcctaacaagtagagtgaaaggttttcctttttcttgactgatagaagagtcaaaagtttgtgagcaaaatccttctagtaacccaaatttcagtcagcggtgaacgcgtaattagagcatgagagggggacttaaatgaaccaagtgtccaagtgtgcaatttttaaggggaaaaattacggtagaattcagtaagtggcgatgacgaacggatgaaaaaaaaacatgagaataatatgacatcaataaactaaatatacatattttttcttaaagtttatcgctttaaaagttgtatattttttaacgataaactgtgctaaaattatggacagcaaagagcggtgagtgggagaggatgagcatcctgtccaccactcctaaaaaaccatttcggatcacgattttggcacggaatgccgacaaaatcggaaataagggttgaacagtccattctggtgttgtctgaatcgcgaaacagaaaattccgttcctaaaatcgaagagagacagcttcatcggacggccacggcccca

SEQ ID NO: 402 - DNA, 1501 bp, Oryza sativa
ccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctgggactctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcacggggagtacgccggctattacgccggcgctcgatgttgaggctggcatgcctgctgcccatgctgatcctccccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctgg

SEQ ID NO: 403 - DNA, 614 bp, Oryza sativa
ccctgctgaatattcatcatttacaattcttcatttatcaggggacagtatagcaacacttctctaggcattactactacattaatattatcacagtgacgttgatagtgtctctggtcgcctgatcactttcaagtttcaactcatttatccctgcctccaaaatcgtctcatttctagtattttctttccaaaatttatctactcgtcagtttcccaccagagagaaccatccacttgcaaattgcatggctcaaaattaaattgcaattccaaattgacagtgtacgggtctataaatacgagcacccagactacgattaatttccagtaagcttagcacgaagcttccatggccacagattcttgagctgccgatcgctgtgcgtagcgcacgcttgacgctgacgctgacgccgacaatggcgaaggcccagctcgtcgcccggttctccgtcgaggtcgcgccgccgctgctgtcgtcgatcatcaggccccgccgccgccgcgggttcccggcgatgctggacacgatagcggaggaggagcccgacgcgccgccgctgccggccatagtcatggcgcgcgagctgtcggcgagctacgcgctgctc

SEQ ID NO: 404 - DNA, 1501 bp, Oryza sativa
tctcgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgagaaactgggttctatgtttggaaaacctgcagctgatgggatcagctaggcccgggtggccgtttaaaagttgttggcccgggtggccgtttgaaaggtgttggcccgggtggccgtttaaaaagcttttggccgggtgccaaccttgtttcaaaatctaaagactgatacattgcacatactccgaccggacgagacgcactgcctcatccgtgtcgtttgagaagcactcacttagttgcttttagaaaagagttcaaataaaaccaatcgcaaaaacaaacagcctttccttgaagcttgcattaaacacttaattcccatggcttgctgagtacccccgtactcacccttgctctatataaatatccccccccagttgctgaagaagatgaagcagatcctgctgatgaggagttcttccaggagcaagccggctacgatgagttttagggtttcggcctagttcccaagtcgcgcctgtgattgtttggtccaagtcctggcttccgctttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttagtttggagcgtcacgggttagttccggtcgggactagctcggggcgtgacaagagatggtatcagagcacaggcttggccctagggcgaaacccgacgcttaggacgaccctaaggatactagattcaaaactacttgcgaaaagctaaggtttctctcttcttctttcttttcaatagtttgtttctaaaatggttactgatcctttcttcctctttcaaaattgtagatggcagtgaacgccagtttcagttcccacggttttggtgagggtcaccacgtcgcccagcttcgtgacctcgcccgtttccttggcttctcgtgtcccgagtacacggggtactccgtggaccgtgttccccctcactg

SEQ ID NO: 405 - DNA, 218 bp, Oryza sativa
ccccccgccggctcatgcttctcggttcggctccggcgaccccccgagcgtagccagatctgggcgtaggtggtgggggaggaggaggaccttgctccgtcggggatggggcggggctgcggccgctggtggtgggtcgccgtggctttggtggtggtggcgccggcgccggcgccgtagggggcgcgtgagaaggcagcggtgccggtggcggtggc

SEQ ID NO: 406 - DNA, 1501 bp, Oryza sativa
tgctagccaaaggggaacatcatcttctggtgggctgtgcaacagctagacttttacttcttgggcttttgcttagtttcagcccactgatgcatactgcctactaaatcttttccgaattttctgggtatgccggtgcatacccggcaccagccctgggtccgcccctgtgtagatgtcggggatgaaatgccaacagcaacttaccaatcagtggagattgagaaggatactgaggccgcgagcagtgggtcctcatcatccagtggtacgatcgaactgtcactttataatttgaacatccaacttcttgatgaacggaaggttttgggttgtgtcttatttgatttttgttactggttcagattcagggagctcaaaggacagtgtctcagaatctggcaatgcccattctctggtgtaaggcctccattctaacagtaggatacgagtaggtggatgattaatttccttttgtgtgattggtggtgtagagacaacaaaagtgtaggtgttttgtaagttgattaagaggagttggtatctgtttggatttagtcaagattaatttgtagcgagtgaactggctttgtggctattctgatagcgcaggtgtcctatgtacatataagtgaaaaatggagactacggtagcaattggtagactggtagttcaccaggctttctgatctgaagaagtgaatatggttcatgtggctgtctgttcttctagttctcaatgcagttgttttgttacaactgtcatatactcttaatactcttatgtaatttgatgtgtcattatgggtgattgtaactgtggcaattgaagtagcaacatataatcttttctgggagctgtcttgactgtagtgtttcagtgttgttgctccatgctggcaaaagttttatatatcttggtattgcagactgttttgtgattattaaattgcttgagaattagtttagcttatggttgcccgtgcaataaatttgcttcttgataatgttcagctaaatgcatacatgatcgaaatggtatgcacctccaatgcatacatgagattatatgctgagtttttcaccacagaaatagaaaaagaagagtttgtcgttagtcttctctagtgattctgtctgttttactcagattacttatgtggcatttattttcatactatttctgaagagaattcttttgttagcaaatttttgacactgttttagcaacctgcaatgctgtcaaccactcctttgttaacaaaaaaaaaaaaacttgcgtagtgcgatgctcaactgaattgcatgtgcgaacaattcttgagtgcacactgcacagaggacacagcaaagtgaattaaccaccgaaattggctgatccgagcacaacctggaacacaatgtgaatgcaaaaatagcacgatatacacagttccttctgtaatcacgaaaatgaacagcaatcatccttttcagtagatagaattatagaatttgtatg

SEQ ID NO: 407 - DNA, 1501 bp, Oryza sativa
acgatggatcatggatcgctgcgacttgcccgcgaatgaatctccgtcgagggctcgaggcagtcctgggtttggctttgtgcgtcgggtttcgccggtgtattaaacaggcacaagcataaaactccaagtcaccgagcagctccgatttttttatttttagtttttattaaaatatttacaaaactaattttgtgttttaaaaatttacaaaactagtcacccatcgcccgtggcagatggcagttgcctcatgcctaacgggcggcaaagaagggcgtgccattttgcagatggccccccttgctgcccttaggttataaataccaaagaggccgcttccaaaatgccaagccgtcctcgccgcccttttgcaggcggcccccgcacagtagaaaatcgccctctataagggtggcaagggggccgcctgcaaaaatgtccctacggacggcaggagggtagcctgcaaaatggcaggccttcctttgccggccgttagacatgaggcaacgatcgtctgccacgtcattaaaatcgatctttaggagggatttatggaccagtaagtccaacgtgtgcaaagtattccacccgaaaaatccgtcgggaaaccgatagagtatatgcgtggccgttcgggtttatcattttgtatttcttccgcttgcgcgcgttggcactgcactgctcactacgctctcggcgagtgattactctggtcgcgcgacaacccgtaacgcgatctcgcggtcgcgggttcggtttcggttgagctgtggtgtggatcgctgcaacttttgcttgaaaaatgaaaaacatgttcgtccgcgattttctgtccgtcgcctctcactgatcgagagatgcaacacagtctgagcgatcgggttcggtttttgtgctctgctttcaccatgaagtcatcaccaggctcactgcgtctgcctcctcgcaccattcagcattcaccgagttgaaaaaaccacaaactaaggcgttccccctgatgatacagcacgcgagctacgcacgcacagacatacggtacagacatgccggcgcccgcatcgacgtcgagaagctgctcactcatcccgtgccggcgtcttgcaagtcgcggcggcggcgctctgcctgggcttacggcccaaattcggcctgcaggcccgattttgagttgtcaagtcagagcccaccgacttggaggcagtcggcccaagcatttgaaagcccagaaacatctgctccgagtgctcaccttccgtgtagcttcctagtagttcctacactaccaaactaccgcattatttatatccctcacaaaaaaaaaataaaaaggactacccgcattttatattgctcatctgccctcctcgaatacctcccatattattcccatctctgccttttgcttaccactgaccactgtcttctcgcgaggctcgccactggtccattgtcgcccaagctccaaaggcttctcttccgccggatctga

SEQ ID NO: 408 - DNA, 1501 bp, Oryza sativa
cggctgttcttttttgatggaagcccccgggtagaattttattttcacaaaagccctttatccttctctacactgtgcgtggtgaggacgtgactacgtgaggttggtttaagacgggctgaccatcgtcaactgcacaaacttatttatggaacgtaatcatatgaggaaaaaaaagtatgtatattgagcaattatagcaagttttagctataaatctgaacacacaattatatagatttatagctaaaaatatttatatttgggacagaattagtataaagtatagaattattcaaaactctttcttacattcaccaaaaagtcttttacaatcaaaacacaaagatcatggatggtagctaagttaatttatagtaccactagttacacaagtggccgacacaaaacgctaacataaggcaaaaatgcacgagcccctctacagagttcacaagtaaccaagggatcaaaccgcaaaaatctggctggcaaacgcgggcgccgtgggcgtgcgtggtcgcgtcgcctcctagaggtcgagtagctaaaccggctcttggaacgagcaagcgccacataagcctccccccacaacgtcgacgtggcgcccccgtgggccccaccccgtcctcatccgcatgggcccaccacggcccaaaggaagcaacagccagtgacagctcagcatcgcccccgcctccgcggcgaggcgaccaccttgggctctatccgggggaggcgacgtggtaagcacatccgacgtggcgcctgattagtttagtcccccttgtacggccccgcgattagttactaatcgagtaattagtagcaagttggttgtgggttatgggatgtctcggccacatgcatgaacggcggacgtggcgagtagggtgcatggtttttgtgagacttatctctttttggatggattaaaccatgcttgatctgttgcatcaagtgtagcaattctaaagaattctacagaatataaatagtgcagttgaattgacatgcactgttcttaaatgtgcacttttgagcactttttgcttcttcggagtgccaaaggttagttccaagattattctatagagcatattttggttagctacgaactatgtttaattccatggataaattaagtagtctgtgcatgacatgaagaagaggtccatgcattaatctggaggaaagaacctatgctagttatacctagctatgcattaatctggaggaaagaacctatgctagttatacctagctttctgttgagcttaccttttctcgagccctaagaattgcttataccaaacatcatggcctaaaaaaagattcaacttatcggttaagatagatggttattagatcgcttgagatatctgatcacttcgtttaccaaacaaatttcctaagtacactagttttcttctggtatagtttgacctttcagacacgccatttctgggccactgagaaggaggttaatttgcccctt

SEQ ID NO: 409 - DNA, 1501 bp, Oryza sativa
gtggcccagaaatggcgtgtctgaaaggtcaaactataccagaagaaaactagtgtacttaggaaatttgtttggtaaacgaagtgatcagatatctcaagcgatctaataaccatctatcttaaccgataagttgaatctttttttaggccatgatgtttggtataagcaattcttagggctcgagaaaaggtaagctcaacagaaagctaggtataactagcataggttctttcctccagattaatgcatagctaggtataactagcataggttctttcctccagattaatgcatggacctcttcttcatgtcatgcacagactacttaatttatccatggaattaaacatagttcgtagctaaccaaaatatgctctatagaataatcttggaactaacctttggcactccgaagaagcaaaaagtgctcaaaagtgcacatttaagaacagtgcatgtcaattcaactgcactatttatattctgtagaattctttagaattgctacacttgatgcaacagatcaagcatggtttaatccatccaaaaagagataagtctcacaaaaaccatgcaccctactcgccacgtccgccgttcatgcatgtggccgagacatcccataacccacaaccaacttgctactaattactcgattagtaactaatcgcggggccgtacaagggggactaaactaatcaggcgccacgtcggatgtgcttaccacgtcgcctcccccggatagagcccaaggtggtcgcctcgccgcggaggcgggggcgatgctgagctgtcactggctgttgcttcctttgggccgtggtgggcccatgcggatgaggacggggtggggcccacgggggcgccacgtcgacgttgtggggggaggcttatgtggcgcttgctcgttccaagagccggtttagctactcgacctctaggaggcgacgcgaccacgcacgcccacggcgcccgcgtttgccagccagatttttgcggtttgatcccttggttacttgtgaactctgtagaggggctcgtgcatttttgccttatgttagcgttttgtgtcggccacttgtgtaactagtggtactataaattaacttagctaccatccatgatctttgtgttttgattgtaaaagactttttggtgaatgtaagaaagagttttgaataattctatactttatactaattctgtcccaaatataaatatttttagctataaatctatataattgtgtgttcagatttatagctaaaacttgctataattgctcaatatacatacttttttttcctcatatgattacgttccataaataagtttgtgcagttgacgatggtcagcccgtcttaaaccaacctcacgtagtcacgtcctcaccacgcacagtgtagagaaggataaagggcttttgtgaaaataaaattctacccgggggcttccatcaaaaaagaacagccgttcaaaggaccgcagtttttggatt

SEQ ID NO: 410 - DNA, 1501 bp, Oryza sativa
tttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcagg

SEQ ID NO: 411 - DNA, 1501 bp, Oryza sativa
cagtccttatgtgaccgtttcttttggcttacaaaattgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgattcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatagaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttataaaaaaatttagagcacagtataaaatcgccctcccccagggcggcaagggggccgcctgcaaaattccatgcccccctcaccgcccatttgcaggcggcccccccacagtacaaaatcgctctagcggagggcggcaagggggccgcctgcaaaattccatgcccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctcgccctcccagagggcggtaggcgactacttccgtcaatttttaaaatggaaaattatttttgtaaaacttttaataaaaaaaattataaataaaaaaattcgaggtaggcagccccaagaggggtatttttcatccaaacaaacgccgtcagtgggtgagcgaaactagcaagaaacgcgtgcgtaccgacaatgcaagaaaaaaatatctctttgatacggcaaaaatctgtatacgatcatgcacgacaatgtatacataacaccaaactcggtatgccatcattttgatttacagagatcggtacgtaatcatgcaacattggttttggaactccacatgcatacgcgaatgtgcatgtgattcttgatggccaatccaaagaaactaccaaagctgcacttggtcctgattaactgaagaagttaaaaggcttgttacctgtcaaaaataaaagaataataaaacgataaat

SEQ ID NO: 412 - DNA, 1501 bp, Oryza sativa
gttgggctcaaggggagagagatctatctaacagtgatcacaacgaaaagatgcaaatcttagcgtacattaccaccggtagcagcaacagcgagaacagtttcaagttcaaaaattaattgtatgagatgcatatatactacttcatacaataattttttaaactgatttttaggtgctctttaaaactgatattcaaaaccttgatcagaaccaaatggctcgttagaacataatgccctatttgaatgggagagactgatttcacagaaatataagtgcctcctattcaagcagcccctaagtctatagggtgggtggggagaggagcaacgatgttggttagatggcttaattgctgttcccggattttttttttaaaaaaaaagacacgttgaacgaatactctcgacctcctttttctactggagtactttgagtcaccaacatatagatccttcttacttccaaaatataaacatttttagaatagtgtcaagttattttttttaactttaactattagtagaaaaaagatcaatcatgtaaaattgatgttactaaatttatcattaaacaaactatcataatatgcaactcttttttatttaaaacattatatatatatatattattgatcaaaatagcatctcgaaaactgtgtcgaagtttaaaaatatttatattttggaacgaatagagtatgtatccacatgttagtgatcctaaaatcacttgatttaaatcaaaggatctcagtctaggataaatcagggtacctacgtttgctactaatcaaagacccacacaagacacgttctccctccgttccgaaaaaaataaatctagtaatggatgtatacgaatctaaacatgaacaaaggtatctccagattatagttatagatatgtcacatccagtgctaaattgtttttttataggacagagggtgtaagcattgagcatgctatgtatatattcctactcctttggtcccaatataaatacacttaatgcataatataaatgcacttagtatatgatgtgatatattctaatacacatactccctctatccaaaaaaaaggcaaaccctggatttccgtgttcaactttgactgtccgtcttatatgaaatttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagacatgacaacaccaacaatgaccccgaccaaaagcaacctcagtacgctctgctcagtgcttggggtcctagctgctcctatttggtgcgtgaagcaattctcactctttcttcgtctactaggagaggcgaagtagccaac

SEQ ID NO: 413 - DNA, 1501 bp, Oryza sativa; identical to SEQ ID NO: 412

SEQ ID NO: 414 - DNA, 1501 bp, Oryza sativa
caatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagc

SEQ ID NO: 415 - DNA, 1501 bp, Oryza sativa
acgttgggacaccgaagctagggaagactacgcggaggccggccggacaatggttttacgcggaggtctcgggctggaggcggtcaagtagatactttatacccccccctatttattttattttaagtgcacatgtgattttttgtctaatatttaaccgtcagttaaaaaatatataaaaaataacaataacaataaatcatgcataaaatattattctagttttattagctaataataataaataaaaatactaattataaaaaaattaaataagttggatggtcaaatattgaataaaaaattataactacattaaaaatgaggcgaggataactttgcataataatggtcgctgttaattaattgacgccaagtccacggtaagtttgatattcggttggtaacttggatggcaagtaagtgcacactcagctttcttcacttcattgcgtgttttccttatcctcaatagaaggcaaactttaataatactagctactaattaatggattaaggtgatgttatggtactaacagacagtcaatgcaaatatagttttcacgcaaatacaatataataaaaaatatgtttatgcgtacgtggacagcacctataacataagtatatgcatcactcaacgatcgagcttgcgggtgttgaccggccatatatatctcgtagacctgcaactgctgagataataaacaacttattaacattttatcaatatactgctgctccatttgcccttaattatgctctctcaataaacgatgtgtctgactccaatattgcaaacgcatgtagcagttgattggccgacgttatgatatggtagctgaattagttaatttgtgagcatgcggtctcagcttgtgcatggctgatctgatatccaggggccggagaattaatctaaatgaacactctttcgaatactgagaaattaacatgaccaattgcgacttctgactttatttctgagctctcaattatatatgactcatgtgtagtaataaaacttataagttttttctagcaaacacagaaggagtcaggccccgttttgagctgtgcacgcgtagaaaagaattgtgtccaaaattctcaaaaaagagagagagagagagagagaagattttacggcccaatatttagaagtattccaaagcccaaaaaatactgtagtagcctgaattttgggccgggcccaaactaaaaatgggcctccgcagtcgtaggcccacgcgaaccattccgtgtgcaaatacggcgaagcctacgtcaagtcgtcaactggtagtatcgtgtactggagaagcgaatggggaagcgtcagcagcagcggcggctcgtccgcttcgccgtcgccgccgccgtcgttgtcgcggcggccctcatcctgaccggtatccgcacaaccccgttccccatccccatctcctctcatagctcagccgacttgtaaagatctgttgtttttctactcttcttgttc

SEQ ID NO: 416 - DNA, 1501 bp, Oryza sativa
ctccccgttctccctcctcgctccatctcctccccttagactcgggtagtagcacgagtagcctccccgtagctagccggcgccggcccgaccgttgccgccgctcgccgtgtgctcaccgccgtcgccgcccgagctcggaagcgccgctcgtcgccggcctcgctcggcgcagctccgcccaatccggcgcaagggacggattcccgtagccccgtagatgctctcgccgccaggaatcggcccctcgtgacctcgtcgccgtttccccttccctcgccgccggttgccgccgccgcaattcgccgccgtcaagctccctccggcgaatccgagccgttggctcgtctcccctcgtctcgtgcaaccacccggtgtgctcgcttttgcctgtatcgccgtggttcgctccgccgctcgccgctgtcgtccgccgtccgttccggccggcgtcgtcgtctacctcccgccggcccgcatggctgccacgtaggcgccacgtcggcgccacctcggccgcgaccggcagccgctccctccgttttcccccgtgcgcatggtccaccgcgagccgtgaggctgcgcgtgggcccgccgcatccgcgtcctccgcgaaccgcacgcgtgcaccgcgtctttcccccatcctagcgccacgccgcgtgctccctccgcacggtgagccgagtcgttgacaagcgggtcccacccgggaccacgcgggatggacccggtccaccggccctctctctcctcccctcccgcgcgcgcgtgccttgggccgccttgggccggccggcccatttagctcggccaagccgccccttttctctcgggccgcgccctagccgcccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgcgtagttttggagcccgaagacccgcagtgcgaggatttcgaggatcaagctcaagatctcgagcaaggcaagccacctttgaacatcttgagcctatatttgaatttaattatgttgcttgaaaaatattatgcattgataggatcgcacttgatctgcttgtcccgtctgcaaggcagattggcagacctacctaatttgttgcatctgatccttcctttgttaattgttataccatgttcccttatagccacccagtcacgcttcggtattcgtgcactctgtgcgagtatcgacggtcgccttcaaacttaaaatatgataaacatcttgggtaaaacttgggttttacaaaaggcttggaaaacccgacacctggggtcggtgcttgcgaac

SEQ ID NO: 417 - DNA, 1501 bp, Oryza sativa
ccaccagaaagtaccattttcatgcctctgtcagtagaagaagactgcctgaaccaatcacactttttgtgaggacatggggattccaaggagatgatatacagaactgaagtatcattgtaataatataatttgacattaacttccaacagtatgcatctaattgtaaaggaagaagattaatagtagtgaggcacttacaatgttaccattctgtcactagttaagcgagattgcaagtatgaagttgggcagcacgttaaatactgtgcatcctgatttagtggacataacaaaaaaaatgaattactttgacatggacatcagtgagaaggcaattaagtaaccgtacaactcaatatgaagaagccgacagaccggagttacagaggttcaattgcgcttcaagagtgtgctaggcacactagtttttcttctcttcttttgaccatcgtgtcgttcacttgtcttgccattgtacagtttgttcccttgtttgtaatattcatccagtgataagagggtggaatgtttccaaaaaatagataaaaaatacacaattttacttcaaatatcagtactgtacatgttcagaaattggagatgttctgaagttttaagataaaacaacatgaactaaaggaggaaaacattttccaacggtgtttactagatcgaccatcaaggaaacaaaatgacatacttaacaactcccaggaatggtataaattagcgtcacaggtggatcaaatagtagtctatttatagctcaaacatgaaaaataaatactcctgaaatctgttctgctttgctggaatatctggttagctaaatacctaagcagtaacacagaagcatacccatcttccgaaatgcaaatgttcaagactgcataccatttgagaacactgagagtatgggaactaaaaccttcaagcatgtaactgccagtttgccacactgttggtttccaaagctgtgccgctgccgcactatctagcaatccaataatcgtagttctgaatctgaaagtttggaaccatacgtcagttcatattactactttttcacaaggagaacataaaaatagttatacaactactgtttcatgagaacatgttgagcataatactagccagagtctgaagggactccatgatgcactgatatgatttgattgggttttcttgtgacggtccggtacgccattaaatttcactaagaaatggtaactaataaattaaacaatgttagaacaccttttatagtagcaaacgtaccactggagtgaaaaacaatatcagttgcagagcactggaatttaccatgttccaccattattatgccgtgatgatattttgatccataatgtatgtcagtgcaactagctgaacaccactggttcttcaggagtgatgaccaaaatataatacaaccgaagtattaagaagcctactggaactcacaaaagaacacctgcacaacaaactcccaaaacaa

SEQ ID NO: 418 - DNA, 1501 bp, Oryza sativa
gctaggcgaggcgacgcggatcgaacaccagcgcagctccagagttgtttccttgtcgcgatctcgtttgttcgtatcctttgctctacctctcgaattcgtgttgtttgcttgtcgtgatctcgtttttgttcttgctagtggcgatccgttcttctccctctgtttcttccttgacttctcgccggcggcgtggtgtgcacgcggcaaccagaggaaccgcgaccgcgagcgcgcgcaggcgcggaagcccaacgccaaggacccccaggacgggctcacctcggagcagcgccgcgagaggtctgtttgctcggtgtctcccgattcgatctcccttgtccccggcctgacgcggggttccaatctgcgggttcttagatcttcgagtttggatttgacgcagggataagaaggcacttgaggagaaggccgccaagaaggcggcgcaggccgcgggcggcggcggcggtacctccacggacaacaggagtaaggccggcggtgcaaagaagtagccggcaccgccgtttgtacgattagtaatgccttataagctttgtacctcatgcatctgcggattccgggctcccccgcctcgcctcgacctggctccccccttgccggagacgacgacctcgccgccgacgacacggatggcggattgctcgagctccccttggattttctctctctaccttggagccctcgcctgccgccgcagctccggcctcgccgcccgccgccgctcgctctcgctgccctcccgcccgttggccgaaggggaagaaggggggagagagagaagggagagagggaggaggaaggaggactgacatgtgggccccacatgtcagtgggcccacattctttttgtgtgaatgactaatgggtcccactcatattttttaattcaactgccacgtaagtgccacgtcaaagccacgtacaacgaagactcggtcaatatcgccacgtaggcgccacgtcagcgaaaccgctctccaaaaccgcccagggagtcaaattgaatcggttttaagagtttgggggttaagatatttggttttgtggtttagggccacggataagatttcgataccttttgagggtcgcaaagtgaacttattcctacagtgaaagggagatgcggcccattacgagtttacgacatggcccaatcacacgcggggaaagttgcgtgagggacttctcatgcgtacgagccgcgtcgcgtctccccccccctcccccaaggaccatgacacgtgggccatagcaaccgacctagcccggccccacacgcttcgcatccttacccatcaaaaccaaaccacgggcctcctcaccccgccgcacgccgccttcctcccagatccaaacctccctcgtcgtctccccttcccctcctcctcctcgacccccacggcggcggcgccaccggactccggcgaaccctcgcgcgcgcgcgcacgcaccgagacgtaccgtaccggcgaca

SEQ ID NO: 419 - DNA, 1501 bp, Oryza sativa
tgcgccgccttcttggcggccttctcctcaagtgccttcttatccctgcgtcaaatccaaactcgaagatctaagaacccgcagattggaaccccgcgtcaggccggggacaagggagatcgaatcgggagacaccgagcaaacagacctctcgcggcgctgctccgaggtgagcccgtcctgggggtccttggcgttgggcttccgcgcctgcgcgcgctcgcggtcgcggttcctctggttgccgcgtgcacaccacgccgccggcgagaagtcaaggaagaaacagagggagaagaacggatcgccactagcaagaacaaaaacgagatcacgacaagcaaacaacacgaattcgagaggtagagcaaaggatacgaacaaacgagatcgcgacaaggaaacaactctggagctgcgctggtgttcgatccgcgtcgcctcgcctagccttcgtcgccgtcgagggcgccggagatggccaatcaccgcctgccctcgcccgccgccgcagctccggcctcgccgcccgccgccgctcgctctcgctgccctcctgcccggccgaaggggagagagagaagggagagaaggaggaggtagaaggaaggaggggccccacatgtcagtgggcccacattttttttgaatgactaatgggtcctactcatattttttaattcgactgccacgtaagtgccacgtcaacgccacgtactaacgaagactcggtcaatatcgccacgtaggcgccacgtcagtgtgaaactgccctctaaaaccaccgagagagtcaaattgcaccggtttcaagagtttggggtcaagatatccggttttgtggtttagggtcacggattaaatttcgatcacttttgagggttacgaagtgaacttattcctttcactgtacgcggccattgcttgggctctggatggcctggtagtcctcgagctacaaatactcggcatagtggcccaggagaatagtagacaagtttgaggtctcatcggaggcatttcacaagaatctcgaaggaaatatatagtttttctttgtataagatttctgcgtttcaaatgataaaaagctttcggatgaccttgaaattttttaataggttgttttatgtttaccgcaattgaaaataggggacaataaaggctaagagaattgaactttcacgctggctttggtccaacgtgagacatatgcgctaaactcgagtctcgaacatcacgcacacgaaagatgggattggcagcgctagtgaagttagcagaggaggctgtagccaacatacattttggatgagtaaatggcttcatatctgcatgctaagttgttgccccaacctccaataaccgttggcatgttactaggagatatgtgatggtatttttatttgaattgaagcagcgggtgctaggaacaaagatgtctagtatatagcacagatgcataaagtacacatcctcacttcctttgtgggtgtctgac

SEQ ID NO: 420 - DNA, 1501 bp, Oryza sativa
cgaagtcgcaaatggttgcacgagttcattttaagcagaagtcgggggctactgtcaaggttacgggttaggcataccctttacccttcgatatacgttacatatcgatatggcatacccacgcgcatgcagatatttcctgtatattctaaggaaaccttttacggaatctacagatgggaagaatcctacttaggcagaactgggtcgttggcgtatcgtatagggtctgatatctccgagttctatgtggagacctccagatctgcgatataaaaggggccccccggggagggtttaggcattgaatctcagagccaacacaatctccacagcctacgaagccggagcttacgaggagccaagtcaccgagagctagttgaatcaactcgactacaatctcgccggatccgacaagttcccttgttctctttgtaacctgtgttttctaccatataatcccacatcaactggataattcttgtctcttgaaccagtataattcttgtcttttgtttgcttgatgtcgtactacgtagatccttgtaccaacgtaccccaataccctttatatccggtctacgggtatcacccgtcaacataatattttttactgttcttaaatataggatattctacatacgtgtacatacctcggtgggagcaccatgttccaagtcctatatatacggaaacaagtatgttatattagagtccgtagtagaaaataaaggagtccccgataaagaaaaaaaatacaatcgtactttgacccgaccaagaccactcggatcgtatccatccttgcatcctagttctacacttctacttggataagatggcacctgagtgtagaaatacaaggcccaagagaagagtggggaaccaccaataagaaacagagataacacaatacaagctacctctaatctcgtagcttacaacagctaacctcaaccactatgctcgagttccacgcttatatattggctgatcaataggagtagggctattatgggtgacgatcaaattgaaacgaatggaatatgttgtaagaaaatgctcttgacgaagatcgaatcccatgcatcgtaccatgcccccatgctcattcaattccagcttttctttagaacttgtttttcctcgtgaagataaaatttgaactgaaatgtttgtggtgtgacatatatcatcatgctctatgttaaattacttcttcgttcgttcaaaatatagcaacctttgaacgggtgaatcatacaaatcccctatctagattcatagtacgatagatccaatctatttaaatgtggttatattttcatattttgtgatcgagataatattttatactaacccatactgcaacgtttataagtggttagttgaccttttacaacaacagtagcactactttaaagcttaaaaccgggagcactttacaaacactacctcaactccatgacaaacgatggagtctatatagggcctaccacc

SEQ ID NO: 421 - DNA, 1501 bp, Oryza sativa
caaaggagccacgtcggccaaaaccgccctccatactgccgagggacctcgtttacccggtttcgtaagttgggggacgggtcgtacccggtcttgcggtcaagggacgaaaatcggactgaccgacaaatagagggacctaaagtgaacttatttcctcagcaggtagtcaatggtagagttgggctgtaaatactcggcccatctcgatgatgctggaggtggtgctcgttcatttccttataggcttcatggattaaatcacaggatcgttgatggactaattataggcccgccggagccagcccagccgtagagtagaggccaccgagccggcactggggcggcccatccgaggtggaggccgttcctcccgaattcccgatccgctactgaggtggcggagatgttgcaggcgaaggcgcggcgaggcaggagagcgagcggccgccggccaggacgtggaggccggatcgaggatgcaggcggtggcggttaagcagggagcagacggcatcaagggaagaagcgcggcaggtctctgttgaacttgcacacctctcaaaggtgcagtgcctatctaatctctaataccgattatagggttctaaccctagccaaagattgggccacgtggcgtctcagaaatcaagttttgcgcctctgaaaatatgccacgtgtctcctttctctcctcccccaccgttcgatcgagtatcgacggttaaatttcgctgcgatggacctctttataaaactgaggtttgaaaaaaatgactactataaagaggtagggggtcttggaaatgtaggccgacacaggtcgtagctgcagtgccgaagtacctggcacccccacccccacccccatccccatgcatgcgctgcatgcaaacctcgggtgattatccatctaatccatacaattagctcattaattagttgcaagttgagcctatatctagctgtccacctgagttaattaacatatcaaagcgatgtggttgcaagtctccaaaactaaaaaggatgaatagaaatgatgtcgtgtcattcaagtattgagtaaagttggtgctatttagtgacatagtttaaaattggttctttttatgctatattaagggtatgttctgattgtagccaaaataaaccttaccaaattttggcattggcggcaagttgataatattcccaaaattttggcaggatttcttatgtatttaccaaagtttggcaacaaactaaacgtaggcacttttttaacaactttacccaaaaaatggtatggctaaaaatggcataaatctgaacagcccctaaagtacattcagactcggacatacactctccatcctaaaataagttcaattttatatatgaatctagaagaatgtgttgaaatatataaaaaaaatcatatcaacaatcattttatgtatatattagtgcaaacgacaaataaccacaaaattcaaaatataattatacgaggggcgac

SEQ ID NO: 422 - DNA, 1501 bp, Oryza sativa
ttctgggttacgctaaaccttcaagccttctaccagcagatgaatacttaatctatcccctctgcgcacggaaagggaaagctactcttcacttcaagagtatatgccgaaaatcctatgtttggagatgaccatgaacacacagcttgagacccttctttcgtgagacagatgtgattccgctttcatgttttggattgagctttgtcactctttctatgcctctttctttttcttggaggaccttcccaacaacacacacgcggcgctaaggttacccgtggcaactgaactaggattcgaagccagaatgagcggatctaccgctccaggtcctttcctattcttatactaatatatgtaagttccttgcgtttagaactagaacgtgaggcatagtaatggcgcatgtgtgatattactattgatacctgtttagactgactttaggaaagcagtcaagcaggaatggaaaaaatgtcttctgctgctatcttatctgctaaaatggacaaaatcttctcttcttctctatgtcactaatcacagtcggagagacccatgagactttcttttctcccggcaggctctagcgctacggcaatgcttatggctgcaatccaaacagcaatggtcctcgcggatttagtgcacccaatccattaggggttcctgatagtgagattcctctagtcaagtctaaggattgagtatgagggatttcatccagtccattgcggaatgtatggtcacagaatagactcatcccccggcttatagtatgcagcttggaaggccttggattcacacgtctggtgctgccccgtcttctccgcatcaaagagtaaagtatgctgttgaggtggtaaaaaatcgactttgtttgtcactaaacctgcagcattcccgtatattgaagccgctgaagaagctattgagacttccttccagtcactcgaaatttggaatgctaattctgtttctgagggcggagctatgcccaaagatgtctgaagcttcgaagatggtagcaagatttatgctgaacagcccatatcagaaaggcaagggattgggcaagaactagcaaggaatattcgccccagtggaactcccttctgctgatgagagattttggataagagttcataaaaggcgctagccagtttcaaggtcaggaagggaaaggaaagagctgggtttctaacaaacacagaaacgtttcctttttcgtttttcgctttgatttcgatagtaaattgtttgtattcatcgcattgatttgaaaagtttgaactttgatttcaggatggttacgggaaatttcactctcttggctaattgtaccgtcctttcctctaggtattgagatccttcgacaagttgttcttcccccgaagaatcgtcaccaaagacattcttccatggtttttttacatgggggggggctcggttttgtaaaagattatgggtttgtgtcgaattattttattcttcttac

SEQ ID NO: 423 - DNA, 1501 bp, Oryza sativa
cattcttctagattcatatataaaattgaacttattttaggatggagagtgtatgtccgagtctgaatgtactttaggggctgttcagatttatgccatttttagccataccattttttgggtaaagttgttaaaaaagtgcctacgtttagtttgttgccaaactttggtaaatacataagaaatcctgccaaaattttgggaatattatcaacttgccgccaatgccaaaatttggtaaggtttattttggctacaatcagaacatacccttaatatagcataaaaagaaccaattttaaactatgtcactaaatagcaccaactttactcaatacttgaatgacacgacatcatttctattcatcctttttagttttggagacttgcaaccacatcgctttgatatgttaattaactcaggtggacagctagatataggctcaacttgcaactaattaatgagctaattgtatggattagatggataatcacccgaggtttgcatgcagcgcatgcatggggatgggggtgggggtgggggtgccaggtacttcggcactgcagctacgacctgtgtcggcctacatttccaagaccccctacctctttatagtagtcatttttttcaaacctcagttttataaagaggtccatcgcagcgaaatttaaccgtcgatactcgatcgaacggtgggggaggagagaaaggagacacgtggcatattttcagaggcgcaaaacttgatttctgagacgccacgtggcccaatctttggctagggttagaaccctataatcggtattagagattagataggcactgcacctttgagaggtgtgcaagttcaacagagacctgccgcgcttcttcccttgatgccgtctgctccctgcttaaccgccaccgcctgcatcctcgatccggcctccacgtcctggccggcggccgctcgctctcctgcctcgccgcgccttcgcctgcaacatctccgccacctcagtagcggatcgggaattcgggaggaacggcctccacctcggatgggccgccccagtgccggctcggtggcctctactctacggctgggctggctccggcgggcctataattagtccatcaacgatcctgtgatttaatccatgaagcctataaggaaatgaacgagcaccacctccagcatcatcgagatgggccgagtatttacagcccaactctaccattgactacctgctgaggaaataagttcactttaggtccctctatttgtcggtcagtccgattttcgtcccttgaccgcaagaccgggtacgacccgtcccccaacttacgaaaccgggtaaacgaggtccctcggcagtatggagggcggttttggccgacgtggctcctttgactaggtcttcatcccacgtggcgttgacgtggcgcttacgtggtaattttatcccgaaaaaataataaaaaccgtaggacccacatgtcagatacatgtaaaaa

SEQ ID NO: 424 - DNA, 1501 bp, Oryza sativa
tgaaaagttaaaaaaaataaaattttggccgaaataatatcgtatcaaaggaggtccgaaatgactggaatttccaaacctgattgtttgtttctctttctcttgattattaactgtttgttagctgttagtcactcaataatctaagaaaaacacatttagagtggatttatagattgtaataatctatcataataagctatatgtttgtttcatcttacttctattataatatagattaatagaagtaagatgaaacaaacagatagcttattttgatagattattataatctataagctagattactataatctagttatccactctaaaggtgtttttttagattactgggtggctaacacctaacaactagctaataattccgagaaacaaacagctatactgggtggctaacacctaacaactagctaataattcagagaaacaaacagctaacaacttattctatgtagagctaatgattcagagaaacaaacagctaacagcttattctatgtaggctttttataatccaacttataataatctgactcaataatctagattacaataattttaaactaaaacaaacagggccttagtacccttgggtatgcgaatttaacagtctttattcaatttcataaaagaataattcaatttcaataaaaataggaataagtttactgtaactctcttaacatctagtagctaaatctaatcggtatcaatgaaccataatactggatatagtggagtagcttggcggcgttgcgaccgggccgagtcacgggtcggcggtggagagcacccagcccgccagcgaatttttttcggttttagattttttttaaaatatttacagaaataatctatcggccaaaaaaattacaaaaatagaccataccgcccacctctagggcggcaagttgacgtggcaaacgggggaggaacgggcggtgacggagggagggtttttttgcaggaaaacccttgccgccctctggtggggcggcaaggggcccgaatgcaaaaaagccagtcggggccggccattttgcaggcggccccttgccgccctctagccgggcggcaggcctcgctgcctataaaaggcctgccgcctagcccccagccctcattcttccctcctcaattccagtgaaaaaaaaaagaagagaggggaggagaagagaagaaggggcgaagccctgccagattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcattgacagata

SEQ ID NO: 425 - DNA, 1501 bp, Oryza sativa
acaaattttgtggatgatctcctttgtagcccatgaagcctttgcacagtttattgggcccataaccagtactgggcctcgatcaaaggtcgcccattagaccctgtatttccatgtattattaaccccatgacctaattctttaataatcataagaggcatttccggccgggacgtcccgaaagctaagacaacgcatccatcatgccgcgtgttcgtacttaacgtgcccatgcatccagcagccggcacccaatcaagctcatgattaactaaaacacgtccaaaagttaaagcctttctaagatccccataaaactaaaccttttattagaccaactaatccttctttctgtagccgctagctaacaatctaaactaatgctatcaactccggctcaggtggaggggcctgcacttactagtacgtacgtgaccgataataatcatagagtgacaaagtgtaccatctgtttgtcctaatcccaaatatcccaatcctttccctttcctttcggtctctgttgcacagaatcgggaaccggttggtgagacgtaaccaaacgtgggtccagccggtgccgtttgatgacttggcctccaggctccaagtgaccgtaattatggcatgttaattcggtttagttagtaagcttattagccaataaattaacgaatttggtgtaaatatagtgccacatttctgacttgactcaatcattttttaaatatgtgattgctagtgtttctctctcaatcttatcttccaagttggtaattatttacttttatcattattctcttatataacttacagtataaatgttgtacttccctcatttcatattataagactttctaatattgttcgtatttatatatatgttaacatccataagttatttacattgtaaatgtatgttatttacaatataaataacttacttagtataagttttgaagtgtaaatgtatgctatttacattgtaacaagattttaactttttttaatatgatatcataaatatagctagtcccataaataaatacataaataaattcaaaaagagaaaataacaaatagttagaaaagttatatctaataatactgatgtacaaggttaactttggcgaaatctacttttgtaagcgcatcacagaagtattctataccaccattagcaaagaacgggtcttgtcgggcatcagggaagaagagagcgtggagcggagcgcgccaccgcgccgcgcggccggcgacggcgatgggtgcatggcccatccgttgtcctggtgacctgatccctgcattgcaatcttgcattcgactactctacatatgttttttaaaaaaaatctaaaactgaacgtgatatatactagtagaagtatgtctataatttgttgcactagaatatatgatagtatctagttttaggtttgttttttttaacggatgaagtatactctctctgtctagaaaaagacccatcctacatac

SEQ ID NO: 426 - DNA, 1501 bp, Oryza sativa; identical to SEQ ID NO: 410

SEQ ID NO: 427 - DNA, 268 bp, Oryza sativa
ctacaagttacaaccaccacatactgcaggttgcataatcgtcaaacagtacatatattcctacactgttgccgtaccatgattgggcgagtccgcattctgttggactgctgcgagcgcgagcacgcgacgagtatcacagtgacacgggaacgtcgaaacggccccgcccataacgctgcagcaggaggagcgtaaatttcagatgttagtttgcttattaaatcatcctcccttttggacaattataactagatgagtggaagaa

SEQ ID NO: 428 - DNA, 1501 bp, Oryza sativa
cataatattttgcaagcaatataattaaatttcaaatataggctcaagatggtcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtcccgggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgtagcctcacggctcgtggtggagcgcgcgcacgggaagggactgaccggggtcggctcgacccggtctaggctgagctggcgccgacgtggcgcctacgtggctgccacgcgggccggcgggaggtagacgacgacgccggccggaacggacggcggtcgacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagaggggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggcgagtgacggcaacggtcggggcggcgccggctagctacggggaggctactcgtgctaccaccgaaaactaagggggggagatggagcgaggaggaagaacggagggaggcactaccatgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggagggggaaaagaggaagggcgggcgcctg

SEQ ID NO: 429 - DNA, 1501 bp, Oryza sativa; identical to SEQ ID NO: 401

SEQ ID NO: 430 - DNA, 1501 bp, Oryza sativa; identical to SEQ ID NO: 420

SEQ ID NO: 431 - DNA, 1501 bp, Oryza sativa
aacagttgggtcgataatctttttccacaagagtaagaacgccatgataagttcagagtcccaagatctatgttctgaacagtttattttctcctctaccctatatgtggtgaaaattcacatggtgatgtgaggtattccatatgaaggctaaaaagttggtgattatatctcccatgctgttcatgtagatacagaataatagctggtttggaaccatgtgtgtccatatctatttgtccctgctaaattacatttgtcaaagctcgcccaatggagcatttatttgcccctgctattgcaataatgcctcctaggggtcgatagtgcaattacgagctgaggtaaactactatatttacttagatgttagtgatactatgtttttttccttcaatactatttataggacagtcatttgcaatacttttttttttgtaattttgatgaaaactggatatctgagttgactaattacatgttcgtagttttgatgaaataatggatatttgaactgattaatgatggatttattcatctttctgaagccataaacattagccatacttatttgagatgcgtaaattattctcctgtcacttccttagctttttgggctacccaataagtctaacttaaaaagctcgccatgtctttcagctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctggatgtctgtgttccttcaattttgtttttctggttggggagaaaaagtgtgaaggtatgtctgtgtcacgattcccacatgcaagtggtgatcagaatataagcagattccatgtttaggttggtgcataagcaaacggcgtactactatgggcctatttggtagagcttcaactctggattttagctctaggagttgggtctggagtggagttgtagagctgcctgaacctagctctatctctgagattttcacccttctattttaagtggagctgaggtgccaaacaggccctatctctcagcaa

SEQ ID NO: 432 - DNA, 1501 bp, Oryza sativa
  unsure (1)..(1501): unsure at all n locations
tttaggatggagagtgtatgtccgagtctgaatgtactttaggggctgttcagatttatgccatttttagccataccattttttgggtaaagttgttaaaaaagtgcctacgtttagtttgttgccaaactttggtaaatacataagaaatcctgccaaaattttgggaatattatcaacttgccgccaatgccaaaatttggtaaggtttattttggctacaatcagaacatacccttaatatagcataaaaagaaccaattttaaactatgtcactaaatagcaccaactttactcaatacttgaatgacacgacatcatttctattcatcctttttagttttggagacttgcaaccacatcgctttgatatgttaattaactcaggtggacagctagatataggctcaacttgcaactaattaatgagctaattgtatggattagatggataatcacccgaggtttgcatgcagcgcatgcatggggatgggggtgggggtgggggtgccaggtacttcggcactgcagctacgacctgtgtcggcctacatttccaagaccccctacctctttatagtagtcatttttttcaaacctcagttttataaagaggtccatcgcagcgaaatttaaccgtcgatactcgatcgaacggtgggggaggagagaaaggagacacgtggcatattttcaaaggcgcaaaacttgatttttgagacgccacgtggcccaatctttggctagggttagaaccctataatcggtattagagattagataggcactgcacctttgagaggtgtgcaagttcaacagagacctgccgcgcttcttcccttgatgcgcgctgctccctgcttaaccgccaccggcttgattctcgatccggcctccacgtnctggccggaggacgttcgctctcatgcctcgccgcgccttggcatgcaacatcttcgccacttcagtagcggatcgggaattcggaaggaacggcctccacttcggatgggccgccccagtgccggctcggtggccttctttaaaacctttccttttaacccgggggcctttgggggggccttgggcctnccgcgcgggccttataatttagttccatcaacgatccgtgtgatttaatccatgaagcctataaggaaatgacgagcaccacctccagcatcatcgagatgggccgagtatttacagcccaactctaccattgactacctgctgaggaaataagttcactttaggtccctctatttgtcggtcagtccgattttcgtcccttgaccgcaagaccgggtacgacccgtcccccaacttacgaaaccgggtaaacgaggtccctcggcagtatggagggcggttttggccgacgtggctcctttgactaggtcttcatcccacgtggcgttgacgtggcgcttacgtggtaattttatcccgaaaaaataataaaaaccgtaggacccacatgtcagatacatgtaaaaa

SEQ ID NO: 433 - DNA, 1501 bp, Oryza sativa
gggtcgctgggcgtggccgagtggttgaaagcggatgcttaacaacgattatcacttccgttgcagcctatacgttggtggaggggtattcctgttgtagtgccgtgagtggggggagcaccgggcacgggcggcggttggtgcgcgcgcgagagaagctcggctgctttgcggttttgggcgcgttctcgcgttggaattcgtcgcgcgttcaacgccgatgtttgtgtttccgagcgggttctgtgtgtggtcgcggtggcgttcgttctcattaccggtgggtttccacccgctgacggacgcctgacgcggcgcggcgcggcgcgtgccacggtggcgcatgtggacagcgccatcagagataggacgagagaatatgtgatggactgatggtggagtgggtggcacggcgacgggagcagcagcgttgatgcggacgcccggcgaggggtgtggatgcttaggcgcgttaaactccctacggtgtgacggcagtgacgcgagctctgcccgcaggatgtggtaaacttggatagtgccgtccgatgtctagatctttatttttttctctcctggatttgcttacatggtttttgaaggagggaaaggaaaacaagttcactgacatgacgtcaaggagaaagaagaagggggggtgttttctcttcttttgaatgcgacagttcgttcgttggtaaaaagaagcatggtggccgtgtataaatgggccttaatcccagcccaatcaagcgtgaaaaggatgaggatttgaacttaaattctagcccatacagataaatgggcttgaattgaggcccattctaaatgaagccggattgtaggttgttccgcatgggaataagttcacttgggtccctttatctgtcgtccagtcctatttctatcctttggtcgcaaaaccagatacaactcatctctcaacttacaaaaccatgcagaaaaagtccctcggcagtattgtgcccggttttaaatgatgtggcacctacgtggctccctttgactagctccttgtctcacgtggcattgacatggtggtgacgtggcaacttgatatgaaaaaatattaaaccccatgggacccacatgtcagttttagacataaagtaataaaaaatggtggggcccacgtgggccccgcatgtcactcacccctacctcttcttcctcccctctccccatctcccctctccggccacggtcacggcggcgccggggacgacgacctcaagaagactccgcccgcgcgtccgcccgtcgctgccccagtccatcccgtcggcttcgcgctgccatccgccccccgctccgccccgccccgccggcttcgtgccggaagacgacgacgacgaggctggcgccctccgcttggctccgccgcccgccgagtcgcagccgcacgtggacgggagctcgaggcagcccgccgccgctgccgcggaggaggaggaggagaccacggcgctcaagactctgc

SEQ ID NO: 434 - DNA, 1501 bp, Oryza sativa
  unsure (1)..(1501): unsure at all n locations
ctgccgagggacctcgtttacccggtttcgtaagttgggggacgggtcgtacccggtcttgcggtcaagggacgaaaatcggactgaccgacaaatagagggacctaaagtgaacttatttcctcagcaggtagtcaatggtagagttgggctgtaaatactcggcccatctcgatgatgctggaggtggtgctcgtcatttccttataggcttcatggattaaatcacacggatcgttgatggaactaaattataaggcccgcgcggnaggcccaaggcccccccaaaggcccccgggttaaaaggaaaggttttaaagaaggccaccgagccggcactggggcggcccatccgaagtggaggccgttccttccgaattcccgatccgctactgaagtggcgaagatgttgcatgccaaggcgcggcgaggcatgagagcgaacgtcctccggccagnacgtggaggccggatcgagaatcaagccggtggcggttaagcagggagcagcgcgcatcaagggaagaagcgcggcaggtctctgttgaacttgcacacctctcaaaggtgcagtgcctatctaatctctaataccgattatagggttctaaccctagccaaagattgggccacgtggcgtctcaaaaatcaagttttgcgcctttgaaaatatgccacgtgtctcctttctctcctcccccaccgttcgatcgagtatcgacggttaaatttcgctgcgatggacctctttataaaactgaggtttgaaaaaaatgactactataaagaggtagggggtcttggaaatgtaggccgacacaggtcgtagctgcagtgccgaagtacctggcacccccacccccacccccatccccatgcatgcgctgcatgcaaacctcgggtgattatccatctaatccatacaattagctcattaattagttgcaagttgagcctatatctagctgtccacctgagttaattaacatatcaaagcgatgtggttgcaagtctccaaaactaaaaaggatgaatagaaatgatgtcgtgtcattcaagtattgagtaaagttggtgctatttagtgacatagtttaaaattggttctttttatgctatattaagggtatgttctgattgtagccaaaataaaccttaccaaattttggcattggcggcaagttgataatattcccaaaattttggcaggatttcttatgtatttaccaaagtttggcaacaaactaaacgtaggcacttttttaacaactttacccaaaaaatggtatggctaaaaatggcataaatctgaacagcccctaaagtacattcagactcggacatacactctccatcctaaaataagttcaattttatatatgaatctagaagaatgtgttgaaatatataaaaaaaatcatatcaacaatcattttatgtatatattagtgcaaacgacaaataaccacaaaattcaaaatataattatacgaggggcgac

SEQ ID NO: 435 - DNA, 1501 bp, Oryza sativa
atgttagtaggtggtggtgcaattaaccccattcacaagcacatccactaagtatgttggtccttgggggcttatcggctcaggtgaaggaagtaagaagtgaagggccacgacggtgcttggcgaggaggaaaaggaatgtgctatcggagcggagaacctcaccggagctttgctggagtttgtgtaggaggatcgaatggattctattagcatattttccttggtatatatcaaatttaggttaacgggtctccacacaggctacgccccctagtcgtgcaaggtcaacacaacacgacctgacatctcactagaccatacctgggcttcagcctcaacatatgggctgacacgacacgcctgtgtggtgagccgtgcttaatccgataatgctcagatgtacttagaccccctttgattcaaaggaaattcataggaattttagaggatttcattactataggaatttttcctatatagccctttgaatcaaatgaatggattttatgtaatcctatgaaattcctatggattgcgtaatgctatgcaagttttggaggaattctaacatgaggtaaaacctcttggaaactttcgtttgagtctttatctctcctataattcttgcgtttttcctgcggtccaatcaaacaaccattcctgtgtttttcctgtgttttgcaatcctctgttttacacttacattcctatcaaaatcctgcgtttttcctattcctatgttttctcattcctgcgatccaaagaagcccttaatatttatctaacaatctcaatcctataaaatattaaaataaaaatcttaaaaaggtccagtcccaagggctccgtttggaaagattttcaccgtttgggtaggttggggatgggatgagatgtgcaatcccgggagaatcccggtgaattgagtgctcggctcaattaggaaattaccctcgccattttgacgtagtggcctctgtcgtccgtgagttaccctgacccctcctcgtcagtttgcccgccgcggcgccgccgccgccgccgccgatccccatccatcccgcgagcgagcagggcgccgtcgttcgtcctgctgcatccgccgcatcctggtgagcacctcctccgccaccgccgcctgcgtcgatccccatccatcgcgcgcgcgagcgagctgggtcgccgtcgttcgtactgctgcttccgccgcttccgttacgcacatcctctttctacccacgcactttttctcggatttgcgttaatcctagcttctgttctagaaactgacttaaccttagaaaatagtactaataacagttcaatggttcccaaaaagtttgggggtttaactgaaccccatgtcccatgttagatccgccactgcttcgaggattactaattccgttctatttgggtgtgaatattctcaatggtgaattgtcatgacctcactttgtaaatttctctgttggaatggcagtaaacatgaaccctt

SEQ ID NO: 436 - DNA, 1501 bp, Oryza sativa
taaacgttgaaaaaatacgatgctacagttctttttaccgatgcattctgataaatttggctgccaaatgtacatgttctacacttttcttctatattccagagcgacttcgctatatttttttagtgatgcgatgtccacgggataggattatacgctagtcaacctctctgatctctgcaagtactagtatagcttgcatttaccaacttcttgactagacaactcttgagcccttctttccttgttcatttaggttcccagttcaacacatgctgaaactttcttcccttttctaccttggatttcaatgcctaaatcggataaactagtactaacaatcactggtccagtccaacacggaaggttttcaggaactctgaatctgctgtcacttgccatttgccaccaaatccgttgatcaagtccacatggatgatggatcaactcacactgcatccatcaccgttcccaaaagctttgtaaagctaggcaaagctcctccaagggagccagcctcctatcaacaatcagtcgaccaatcagatagatcctgatggcttctgataacgacagaaaagttcacaagtttatccacagcctcttatcttctttttaagattttgcaggtagggtatagtatttatcaagctaaagcccctgcctttcaggaaaatcagagctcttatccaaaagtcacttgtgtccattgaccactcttttggcttaactaggacacagcctcactttcctgtggttccacacacaaaatggccagattctgccattagctgcagtgtgcatttcatccataaactttattccatccacttatgtatccattcaagccccctgcaaaccacagtccacactccacagtgagttcaacgtctgatccacctgaaggaatccagtaaacagaaagatcctgctactgcctgaagactgagattcgttgtgtcatgtggcaaatgatttgctaagcagttattccagagtcttagttaagtaccttttgcagactgaattaatccagcttaaagttggtcaacaaactccacagattaatcccctacattcccttgcctgcagagtgttcagcacaatacagttatactccctaagccataagaaatccagtgcctcccctccaccacatgtcatgctatcttcagcatgttacccacatgcacctgcttgcaatatctgagacctgagccaccaaggatcccaagtccaatgcatgggagaaacatacagttaggagggaagggtgcaagattcgacaatgcagcaattctcatacctcaaagccattggcctgtgcctgcctcctcctcccaatagtgagtttttcgatctctttttttttttttaatcttgagagatgccccatggtgagagttgggagtagaaaaacaggagcatgatgtactgcagagaaatcaagattggtccatgaaagatagagcatttattccaagcaggcagagaaggttcc

SEQ ID NO: 437 - DNA, 1501 bp, Oryza sativa
cctttttaagatttttattttaatattttataggattgagattgttagataaatattaagggcttctttggatcgcaggaatgagaaaacataggaataggaaaaacgcaggattttgataggaatgtaagtgtaaaacagaggattgcaaaacacaggaaaaacacaggaatggttgtttgattggaccgcaggaaaaacgcaagaattataggagagataaagactcaaacgaaagtttccaagaggttttacctcatgttagaattcctccaaaacttgcatagcattacgcaatccataggaatttcataggattacataaaatccattcatttgattcaaagggctatataggaaaaattcctatagtaatgaaatcctctaaaattcctatgaatttcctttgaatcaaagggggtctaagtacatctgagcattatcggattaagcacggctcaccacacaggcgtgtcgtgtcagcccatatgttgaggctgaagcccaggtatggtctagtgagatgtcaggtcgtgttgtgttgaccttgcacgactagggggcgtagcctgtgtggagacccgttaacctaaatttgatatataccaaggaaaatatgctaatagaatccattcgatcctcctacacaaactccagcaaagctccggtgaggttctccgctccgatagcacattccttttcctcctcgccaagcaccgtcgtggcccttcacttcttacttccttcacctgagccgataagcccccaaggaccaacatacttagtggatgtgcttgtgaatggggttaattgcaccaccacctactaacatcgttgacatgcataccttcgggcggagcttaaaaatacattctacataaaagttgtttatataacttatccaaattcattttttaacattttaatatctaattaattaattcgtttgtgttgtaacatagacggatataccccctcaaccccaatctacaatgaacgggttgtcatgataccaccaaccaaatcctgacgagctgtcgataacctattgtctcttcattgcaatttgcaagctgtagatgcttaggggcaaatttactacatgacaccaaaattttatgtaatttactgacagacatcgaaaaaacgtgttacggctgatgacattaaaaaaactagtaatttcctagataacattttcagctcaattggagagatgaattcttaaaaaaaagataagaacgcctctatggtcacatgcttcaaacatggtgttagagtaaacttttagaaattatgcaactcaaaatttgccatagcccaaagtggcaaagtacatcactagcatacatcatatttcattttcactctagtctcggctaaaaaaacgtttgaccgggtcattgtcttatttttaaataatttatctattcaattgagctgaaaatgtcatccaacaaattaccaattttagagcgtctttcactcgtgtcactttttt

SEQ ID NO: 438 - DNA, 1501 bp, Oryza sativa; identical to SEQ ID NO: 401

SEQ ID NO: 439 - DNA, 1501 bp, Oryza sativa; identical to SEQ ID NO: 404

SEQ ID NO: 440 - DNA, 1501 bp, Oryza sativa; identical to SEQ ID NO: 410

SEQ ID NO: 441 - DNA, 1501 bp, Oryza sativa
taatggatcaaatcatttctactagagagtaacgaaccatcgtccaaactacgaacataattacaaattcacaatagtctctagtctacaagtaaaattagggtgtgttaaaaaaactcaatttgtgtcattaagaaagaaggaaacaggcaacaaattacatttttttagaaaggtcaaattacatataattcgtgcaaagccaaactggctcaagctccgccacattggcattagcattttgagggcgcccgacattctcatcctcatcgtcgtcttacttaagtttttttttttatttttacgcaagtcttacttaagtttcatccatttgttccatgcttttacgttcaaacggctcccttatggcccggtcatatgctcctaccatacacaacacgctgttccaatgtcagtacaaatgttactaaggtaccactgattgcccacattctctaataaacagtaagaaagtgtttggcaaatgggaaacggaaatgatttcccaccatctttagattctaaccattcattctcccttttccatttaatcctaacccttcattcatttcctaatcccaatcccaccctccatttcccattatccaaacacaccgtaagggcttattaagaaataaaaattattttacaggtaaatttttatatatgtgttcttagtgatttaaaaccaatgctgaaaaaaaaacgttcaaaatatcttaaaatcaacttcaaaattatttttgaaaaatttaaattttggtttttgccgacggagctcaaactttgtatgaactgcgtttttttttaaaaaagaatcggaacaactttaagatgtagggctagcttggtttgaagtctaaattaggcttaccaatatttggtaatttcaatagtgtttagtgtctatttggtttgaagccaaattttagcatgcctaacaaaataggccattttaatagtgaacttaggctattttggcttcaatccaaacacaactttgccttaccaaaattagtagtgccaaaatttggtaaggcctatttaggccacaaaccaaaccaacccttaaactaaaattagggttaatgaacaacctttagaacacaaccaaaatcgcacactaaggtaaaggaacaaaacaacaaatcacgttacacccgcgaccaaagccaaaacggaaaacgcacacccagctaagggttgggcatcattgcagcataactaaacacaccgtagaatagaggagcgctttacgcggaactaattaactaaaattaaaccccgctttctcggtcacgggcaggtcggtcccaccaccccaagtccccatccactccaccaccccggccattccattccattccatttcttttcttttctttctccccctcaattattgccgcttctgtccatcccctccccctccaattccattccatcttcatctccatatcttctcctcctcgcgtcggcagttatctcctcgttgataatggcg

SEQ ID NO: 442 - DNA, 1501 bp, Oryza sativa; identical to SEQ ID NO: 425

SEQ ID NO: 443 - DNA, 1501 bp, Oryza sativa
gagcagccagaggtcacacctgtacaggcaggacgggttggccgtgccgtacccccggaccgactcacgtactcccaggggcacattagggcgcaaggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacataaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaataataaaattgtattttaccagtcttggagattttaatcttgtatagttttcaatataaaaaaatttgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttccgtctgccacgtcactttcgccgccctctgggatggcga

SEQ ID NO: 444 - DNA, 1501 bp, Oryza sativa
cagcaactggtaagcctgctgccctgctatggctgccgagtggtttcaatgctctcatcagtgtagtagtatacagtactatactacagtatagtacgtatttatatgttacaatagcagatgagttgaacaaatctcgcgggccaatcataaagctcttgccctttctgtccgcattccatgccatttgcatgcttgtttatgcaactatgtcggctaagtctagctgaactggtagaatttacttcctgattgaatcgattaaaacataatttttgaatcgactcaagctttatttaaaagatagtagagaatagtatattgtgttcactgaagagagtgcaagaatacattcaaagaacacaaaacgaagtggggcacaaatgagaaaagctagctgaagaaattatgtgggataccaaatagtaacacaaaaaatacaaatttcaccgtcaggctaaaggcacagacatcatcgaacagaaggggctgaaaaccccaatcagcctcgaacaaatctcgcagcacaaaaacaaatcacacgggtttccatccaatgggctgttgttgtatcccccaaattaaaaatcaacaagggttttaaaatgtttaaatgttttggcaatgggctagaggtagtaggatacaacccaaactaccaagcatcctttgtccccttcccctaccccaatttaatgattggttgatctctcaatttcatgagcaaaagaacaacacccctttgcttcgggaccatcaccttcagtcattcacctccttatcacttagaaaaatactaccagtatcagaaaacaaaacacaaaaaaacaactattattattatctccattcttaaaagacgatgccttcaaacctcaaattattatatcattaatagattaaaaatattatgattcatatgaaaatagcattaatatatttattatgaagagtactttcataagttatacttttgataaggtttatatataattagaaaaaagcaatgattagatatgtttgtcagactatcagtgtccataacgctaagtaaaaaaagaatagatttactttttccgttctaaaatataaataattgtaaagtattttacggtgattaaggagataataaaattagatgatgaatgattgtaattggttaagatatagaagctggtatagaaataaaatagaatatgatttttagtcattcgagatgagtaggtagatgtagagagtagctactcttatattttgatataaaatttaaatgctaggagtagctacaatttactctatccagaactccagattagtgcaaaagcatatacccccagtatagtgctccttcagtcctaaagcataaaatattttagtcggatgtcatatattttagtattatcaatctggacagcgttatatctttaaaaaaactattatattattggatggaggaaatactaagtaacatatatttttttaatttgtttttgttttgcag

SEQ ID NO: 445 - DNA, 1501 bp, Oryza sativa
tcgccgcccgagctccgtagcacccgctcgtcgccagcctcgctcggcgtagctccgcccaatccgacgctagcatcggattcccgtagccgcatagatgctctcgccgccgggaattggcccctcgtgacctcgtcgccgtttcccctcttccctccccgccggttgccgccgccgcgattcgccgccgtcaagcttcctccggcgaatctgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtcccttcccgtgcgcgcgctccaccacgagccgtgaggctacgcgtgggcccgccgcacccgcgtccttccccccaccctagcgccgcgtcgcgtgctccctccgcacggtgagccaagccgctgacaagcgggtcccacccgggaccgcgcgtggtgagcccggtccaccggctctctctctcctccctcccgcgcgcgcgcgtcttgggccgttctgagccgccttcttgggccggccggcccgttaagctcggccgagccgccccttttctctcgggccgcgccctagccgcccgagggaagtctaatttccatccctcttttcttttcttttcttttcttttccaataaggatttaattaaatccttttcctttagacgaaaaatccaagaatcttagaaattcaatatcctcccaaccgtagatccgtttgactccgttcaacttccaaaattcctcaaatctcgagatctatctaatagcacgcttagaggtcattaatagggctttattttcgccgtttgttgagttgtcccgtttcgcgtgtagtttcggagccctaagacccgcagtgcgaggatttcgaggatcaagcttcagctctcgagcaaggcaagccacctttgaacatcttgagcctatatttgaaatttaattatattgcttgcaaaatattatgcattgataggatcgcacttgatctgcttgtcccgtctgcaaggcagattggcagacctacctaattttgttgcatttgatcctccctttgttaattgcgataccatgtccccttgtaaccatctagttgcgtctcgatattcgtgcaccctgcgcgagtatcaacggatgccttcaaacttaaaatctgagtaacaacttgggtaaaacttgggttttgcaaaagacttggaaaacccgacacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatggga

SEQ ID NO: 446 - DNA, 1501 bp, Oryza sativa; identical to SEQ ID NO: 424

SEQ ID NO: 447 - DNA, 1501 bp, Oryza sativa
gtgactccgatgtcgccgtgccgtccactagttccaccatgcatcgtcgggccaccgcttgtcggcaagacgccggtcgtcatggctggtgaagaaggggtaattggagcttgaggagaaagaggtgaggtcgccggagcaggaaccgcaaagcaaatctaatggtagaaatttacaatattttagcctcaattttctaccaacagtagtttagcatttccgtgtaaaaaaaaatggttgacatgtccgtatagctggctagctattactttctccatttcacaatgtaagtcattctaacatttctcatattcatattgaatatctagattcattaatatcaatatgaatgtggaaaatgctagaataacttacattgcgaaacggagggagtagctagcagctgtagttagcaatctcgtgaactagtgttggccctgcgaggtgtgagttcaggctgcacctgatgggcacaacctgtcggggaagctagcgagccatcattgggagcagcatgatagcagtggggatcaacccattgatccgagcaaaaacacgcacacagggcaggcagagcaggcaccacacgcgcatacgggattcacacgcctccagtacgcatagtgcgaacatattctcctttctgctcgccatgaagaggaaaatctctgcagaaatgcagcctctcgaccgtggcgagctgaggctgagctgagatgagctttcggtcgccatcgacgcatcatgggtggcatcgttgtcgtgcatttggatgctgccgaaagaatcagagaaaacctcgagaagaaagaaagggagagatgcagatactctgtctgtgctgtccaggtttgccttcccttttcttcctttcatcagtcaccaacctgcatgcatggatgatgatttggagagaaaaggggaaatggatgaatgatttgattgcacaagagcgagctaaagctctcatcatgtaccacaacctggatgcacctgtaacaagctcgtagccgtcacctacatcgggaaatattcagcctgttttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtaggatgggtctttttctagacagagagagtatacttc

SEQ ID NO: 448 - DNA, 1501 bp, Oryza sativa
cagtaatagaactgcatctgcatagttagagacacaaatcctagcagtatagtacaatactgtagtggagtagtagttacagtgagcatcagagcatcagttgcaacttgcaagccaaacattcatcagttagatcagtctgccttagtaatcatgagtttgacaggcatttcatcatgccaagatatgattataataattctgtaatgcaaagtgtcacagccaaaataggacttttgtgcatattctcccactcaaacaaaagaagacataatatagtttggtgatcagaaagaacataaaaaaaatcagaattggtcacgtctaaggtggtgtttacatccagggacttaacttaagtccctgtctttagacactaatttagagtattaaatatagactacttacaaaactaattacataaataaaagctaattcacgagacaaattttttaagcctaattaatctataattagagaatgtttaatgtagcatcacataggctaatcatggattaattaggctcattagattcgtctcgcaaattagtccaagattatggataggttttattaatagtctatatttaatatttataattaattttcaaacatacaatgtgatagggacttaaaagttttagtcccatctaaacagggcctaagattataaccactagcactcaggccaggccaacaaactgtcacagcctcacaggaatgcagataggttactttttacttcacttggcccggtccatgtcccattcccggacggaaaactcttttaatcactactagtaagtggatatccacccgttgattattatatcacctgaatagttacaaaaatattttaaaaaataataaaatagatcaatatgtaatatatcactccacaaacatgtaagttaaaatttaactttctataaattgtaatgaaaataacaaataaaactcaaatcagtatagatatatttgcagttaaatttgttatttttgttaagactcttataaaatttgaatttgaacttacatgtttatagagtgatatattacatatcaatttatcttgttaatttttttaaaaattgtttcataatcatttagttgacataaaataaaaagatagacgttcactcacgtgattagaatccatctccgaccgaccgcacatacaaagaaactcctacttggcgcagaacggcggccaactccagtccaattctaacccgaggccccgccgctgcatgccaccatcggctttcccgccggtacggccttgcgcccagcagcatgcacatggacacatgcaattgcaaacgcagcgcgcatgtgcaacaacgcgagcagcaatatatgagtatctcatcaaatcgtacgcgcgcctgcatgcatatggccggagccgtgtcttcacggccggcgacaagccggcgagcacatggacgcacgtcgtcacgggtcgccacggcgcgcgtgagatcccccatgtacgtac

SEQ ID NO: 449 - DNA, 1501 bp, Oryza sativa
aggaggaggttggagaggcgggccggggaggcggcgaggtggccggaggtgaggaggagggcgtggcactggagcgcgtgggaggcggagctgcaggcgcggaggcgggagaggagcgtggcgagggcgtgaggaggacgacgacgagacatggcaaagtttgatttgggacgacgaggaagcagttacaaaacgactcgtttgtacatgaactctagcctcggcccctgggtcattttccagatgggccgtacctaaaatgatcagttgggccgaaaagaagggcaattatggttcattttgaatttcttgattcaaaaatggtagtggtggacatgctgcactctcatgtgtaaatgttactgctagctacttaaagtttactacatccgtcctagaatataacaacttttagctataaatctgaacacacagttgttcagattcatagctaaaaatatttacattttgggacggatggagtacttaagggcagtagccagtagattagaggatcaggttccattcagagtgtatgaatcgctgttggttcttatagaaaacaaaactgatttatgtcaaattctagtgagaatactgtgaatttcatggttccatctagagaattagccctgattataatgtgagactttgcattgactaataaaatacctgcttgttataacggatttctaattatatgtcttaagttgttagcttaaaaatactcagaaaaaaaacatatagaattacaagcaaatatccaaccaaaaagtttaagccacatgcacaaaaagaccatttatccatccttaaaaaatcatatcaactctagatgatgttagattcatcatcatcactagattattttacatagtagatatacggaagatggattgtttggtgtgaaattcttgcggaatttgtacgaaactcataaacccgcacgtttacatgggtaatatagatttagggacaattcagattaataccatttcaaatcataccaagttgtcaacgatgtacatacattaatttttttccaaactttgataaatactacataaaaaattctgtcgaaattttaataatatcatcgaggtttattttggatacaaaccctcaatgaagtcaggaatttatcgttggtttgtatatctttaagcgcgatgtccacagtgcaaacttggatgttagagtactttacggtgttcacgttgaaagacgagagaaagacgcttcgatttagagttgacggggcgcgggaacataggggccggatgaatccacagccaccccccagttatagtataggcaatgagcgcgggaggcgaccgacgcatgcagcttccctcgtcggggaagacgacgtacgaccccgacgtactacgcgcccacgcacgcacgacgggacggccggcctcctcacctcgctcgctcgcgccgcgccgctcgccggcaaatccaccacgccatggcgttccctgcaccctcctcctcc

SEQ ID NO: 450 - DNA, 1501 bp, Oryza sativa
atgtggcttgaaacgacagtacgacaccacatttacctggccagaatttgcaaagtttggagcaaaatcacaagcaaagctggaagatgcatctagtaggagtagtagggagggagtagagatagcaacggtacatgagtccacgtgtgtactgggcgacacgcccagtacaaggtccctttcgctagccgtggcggcgtttggtggtttcaccaagaagctcaagccctcctcgttgccacgtggatatctggtccaggacgcggcgggcccaccgcagcctcgagtgacaggtctccttgcaagtgggccccacgctattatttattatccgtaataatctgatggtcctggaccactgacaaattctttttctcctctgatcgcccttttccttatccgctttaaaattaaaaaacttcaaatggtatagtggattattcttgtttgtttgaaatggaattttcggttaaatttcaagcaactcgttactcaggatttaaagagtatttcgtggctaggtgatcaagggggagcaagtatgcgtatcatatgatcgacaatccacgatgctgaatcttgaagagagaaaaaaaataacgtacgcagatcacagcaacgagagaggatgattaggctgattgtattattattgttaaacatatcgtcgccgacaagcgccattagtaaagcataaacatccgtggcaccattcaatccacgctaattcaaccacacccacccgccgcgtacatcgtttcttgctttgttttcctgcaagatcttcatattataatcttttccctagctaaagatcaagttcaagtatgctacacaataatatatcatcaccttttgcaagaacaatttgctccttaataattaatctcgaccaaaaatatctgtacaaaacaaattcgagagcaactcaaagttgaaaggaactctcgctctaattaatctctacatctacaaacaccgttaattaatgccttgattatgatgtttcatcgccgagtctacttgatcctcgccgccggagcggccggcggcggcgtgaagaacccgacggcgcggcacttgacgtccatcccggcggcggcggcgggcatcggcattgctccggcggccgacggcgaggtggccgtcgacctcttgtaggggccgagccacttggcgagcatgtaccgggtcttgcgccacggcgggacgtgcaggccgtgcgaacggagcgaccgccgcgccgcgtcggccgcgacgcgcacggcgcgcccgacggcctcctcccgcgccaccaccaccgacgccggcacggcggccacgacgacggcgtactccgccgtcgcgcgcgcgacctccagccccgcccggaagtccgcgtccacaatgtacctgctcttctgccccctcgccgccggcgcgaccacgtcgacgtactcgtacgtcccggccgtgatgccaccggaagcctcccaccgcgacttgcacacgccggcgtcgt

SEQ ID NO: 451 - DNA, 1501 bp, Oryza sativa
acttgatcctcgccgccggagcggccggcggcggcgtgaagaacccgacggcgcggcacttgacgtccatcccggcggcggcggcgggcatcggcattgctccggcggccgacggcgaggtggccgtcgacctcttgtaggggccgagccacttggcgagcatgtaccgggtcttgcgccacggcgggacgtgcaggccgtgcgaacggagcgaccgccgcgccgcgtcggccgcgacgcgcacggcgcgcccgacggcctcctcccgcgccaccaccaccgacgccggcacggcggccacgacgacggcgtactccgccgtcgcgcgcgcgacctccagccccgcccggaagtccgcgtccacaatgtacctgctcttctgccccctcgccgccggcgcgaccacgtcgacgtactcgtacgtcccggccgtgatgccaccggaagcctcccaccgcgacttgcacacgccggcgtcgtacccggcggcccgcagccgccgcgccacggcgcgccggaacgccgccccgtacctcctcagcgccggctccgcctccatcgcggccgccacggcagcagccagcctgacccggaacgggtcctcctccaccggcgggtcgagcagctccctcacggactccgccgccgccgccgcgcgttccggaccgtcgccatcatcggagtcatacccttcgccgcccttgctcgccggcccggcgccgtcctctcccgccgcggcgccctccgtctcaagaaacgcctgcacgagcccggacaggcacgcggaggcctcgtgctcgctgccgctgctcgccgacgacccggcgtccccgcggagccgcgcgcggacggcgtcgtcgaggcggatgtagacggccattttcgccggcggcgtgcgtggatttgaggtgtctgagctcgcggtgaggggaggaggcgcacacccgggtgactcgtttttatagggtggttggctatgaggcgaactcgagagagaggaagggtttattcctttggatcattagtgattagtgggggcgcttaagttaggagcaacgaatttgaggaagttaaccatggaatatgctttcctgatgagagatggtaggcaaaagcagtgcgccaaaaaaaattacatatcaaagctaatttggtgctgccatgtactccctccagttccatattaattgaacttttaaattccatattaattgatcttttaaattctatattaattgatcttttaaacaagtttgaggttaaacttttataactttaaccataagtaactttaaaaatatttagttccaaaaaattagaacaacatatatagatttgtctttcaaaacataaacatatatttatttattatatatattataatagaaaaataatgtcaaggatatattttataaatcatgtcattgtctaaatcgttaattaaaatgaaacgggagagagtaaacagatagagcgtgttggttgatggctcgatggctga

SEQ ID NO: 452 - DNA, 1501 bp, Oryza sativa
ttaaaaaacgaccttgtttcttactaactgagaaccagaaccttgtcttttcgcgatgcaaaaaaaacctttgcacgttaatatattagaaaaaaataactagcgcaactgtgatacaccgaggcaatcactggtcaacagaagggcataccccattacataagaaactggtttaaaccaagcaaagcttctaagctaagactaagagattaagaagttgcgataaactaagctaagttgtgtttcgctaagcatagtcttgtctggtggtcccatgcacaaaccaggcacataagaccattcacagtgcatctacgtggctttcatccctactgcgccccacgaggattttcgtctctacgtttgcaaccctcgtacctaacatgcaaaattatagacaccacttgagctatttcttccagaaatacggctgacagtatctttcacggcaaatatcccgagggactatctatacatttgtcgataaattttaaaaatttatcaaatataaatacaatataattatactgtaattacactgtaagtatagaataattacactataacttatatgtaattatactgtaactatagtataactacactgtaactttagtataactacactgtaactataataattacattgttacttatatgtaattacattgtaactataatataacttgcatgtaagtgagatgtacctttataaaacttatgtttggcactgctcacgtaaaagagggattacgaactcgcaatgtctgtttgtacgatgcgtgtggaggccatcattcatgcatgcatgttcgggtatgccctgccgctttatctctgcccttcgtctgacatctacgcgtgcatgagccgcgccagtgccggtagccagcggccgtcgaaagaaacaaatcaaaacgtcgacgcaaaagcacgaatcttgaggttcatcaagcggttcgaaaatcgacaaattctaaggaagaaatttgtcaacagatttatagcaaaatcgataccgaaataccaccccaagctaataaatctcaacatgcggcagccagccaggttttggtgaaacagtactgtataaaagcatcgcgtttcctttctcgttccccctctctttttcttccgtttccagtgcgagtacacggcaatgatcacccctttgctacttttcatatccatgcaacatgcatacaaaaagatggaacaaactccatccttttttctagtccacaaacgctagcttcgcccgcccctcgtcacgcaacgccggacaaaggccgagcttgctgttgcgcggagcagctgcagggtccacgtgatgccgcgccgtggcgccgcatgcacacacgcgcgcgtcgctacgtggtcacgcgaacacctgcactgcagtacacaccaccctacctatatcatctctcgcctctgtacatctgtgcaaaactgcgaaatccaaacatataattagctagcaagcgaaagtacaaaacta

SEQ ID NO: 453 - DNA, 1501 bp, Oryza sativa
cgatgctgacgcccgagactctgaccgaatcgcagccggacctcggcacgatcgagacgacgatcgtcttgtggccgtcggcgccgatatcttcgagcaagtcggagatgccgaacctcgccaccgtctttctcggagaacgcttcctctcctcgcggtggaccccgtgtggcgtcagcgcgacgcgacgtcggcgttctcgggcgcgttcacgaacacgtcgaacttaacgtacgcggagtggtcggggacctcgatcccctcgatgacaggcgcctcctcctcggcgtccttctccttgcggctcctcgacgtcttgggcctcgtcaaggccacccgcacggtcttgtccagggtccccggcagggcgccggcgggtcccgtggacggcttggcgttcagccacggcagggggccaacgtcctggtacgtgtaccgcagcgcggcctcgtcgagggagtcgcggacgcgaacgcggactaggcgggcctcctcgtcgtagaacaggaaggtcgcgtcgagccagtcggggtcggtgaagtcggtgtcgcgggggaagaggccgtggcgaatgtaccacatgcggtcgacgttgccgtggtgcgcgaagaacaccgggtcgcgcgccgccgagtagaacatgcccatgtcctcgccgttcggctgcctcgggtcgccggtccagttgtggacggtgttgtgcagcacgaactcgacggtgcccgcccccggtttcggctggtcgccggcgctgtacggatgtcccatgaacagctctttcttcctagcccccgaaatcatctgatacatcataaattatactgttcatattagacacgcgatccaatttaaagtcgactaattaatttggagtttgctatctacggttttcagtagctacttcaattaattcctagtttgtgtcaaactgtgtatgtgattactggcctggcggtacatgatcttgaggttctgatcgatcagctgatcttccgggatggttgggtcgtgtggagattatggatatcccatatctacacggcgatgatatttggactgaatataggataccgaatatagatagaatatcttatgtgtatcctgggtttgtttcttaacttgtacatcaaggaaacaccttgagacttagtcggtcacgactgtattttatctgtatttacatattccgttagggatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaa

SEQ ID NO: 454 - DNA, 1501 bp, Oryza sativa
cagcttgcccagtatcctctcatggaagtacaggtacatcctgcacgtacgttcacacgcatgcgtccagcgttcacagaatctcatgagccactcaaataatcctctcatttttacatgtcaagtaaaaagtcatcaaaaaaattaaaaaaatatagcagtatagatcaatattacatcaatatataatatgttatttcacaaacatacaaattcaaattcaacttatacaagtagaaacaaaaataacaaatttaactgcgtaaatcacggtcaaatttgttgtttttgtttcgaattgtataagtcgaattttaactcgtatgtttgcgaaaaagatataccgtatattgatctatcttgacaaattttttaaattttttgataactttttgaatgacatgtacaaaataagaggaagtcgtaaaaaatccactccccatatatatcatgcatgcaactgtacacgaacaacgcgagacgtgaacgtgatgcagccatgttgtcacaatgtcacgtacctgtgccatgggaagaagagccagcagctgtgtatctggatctccaagccggggaagccgacctggtcgtacgcgccgtcgcagtaggcgcagtggacgcgccactgctgctcgaagctgcgggggtcgtcggcggggagcttcttcatgagcgacacggccctctcgtacttggccaggtacgccctgtccgccaggtgagccgccggccgcacgcggagcggcgaggacgccggcggcggcgcgaagtcgacggcgacggtgccggcgctgtacgtcgggcagcagttgatcgccggcgccgtggcggggacgtccacgggctggtggcagtcgccgaggtccggggcctggatgggcgccgcgagcgcgccgccgccgccctgcgtggccaccatggcggccgcgccgctgatgccgaggagcacgtcgcggcggtcgaccctgcaggacacgttccgcggcttccaccccttcgtcttgcggtgcaagagcaggttgttgtagcgaagggtactctggaggttggtgatgcacggcggcggcggcggcggcgccatgcgaggcgtagcggttgttcctggtgctacgttgatgctctccatggcggcactgcgctgtgaacttgcacttgcaaagttgcaatagcgtgtgtatttatagggcaatgtgtatactactatactgtagtagcccactggttgtttggtactttggtgtgaccgtttgcagggccgcgcactaacaatttgggagactgactattataaaataggatcttattcataaaaaatactaatcacacatattccctccatcccaaaatataagtatttttagactctaacaagatttccgagatgttactttaactaacaatatctataaaagtaggatgttttaaataaaaaggttatatattataataatttgtttaatgatacatctagtaacatcaattttatatgagtgatattttt

SEQ ID NO: 455 - DNA, 1501 bp, Oryza sativa
ggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctg

SEQ ID NO: 456 - DNA, 1501 bp, Oryza sativa
gttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaacttatcatgccaagacctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgctcctccgatacccttaacaagaaatcccgagatccaagcaacgcttcgtctcccccgccggaactctcgccattttccccactccttgctacagtgcagaactgcgccggcgaactagggttcaccactccactcaaatccaccttcgaaaaaatgcatcaaaatccttcccgtgatccaccgcctcaattcctcacctctcccaagccatccctcgaatcaaatcagcgcattcggggaaaatcga

SEQ ID NO: 457 - DNA, 1501 bp, Oryza sativa
ccgctcgtcgtgacccctgctcctgcgattggatcccgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtgatcggattgattgagctcgttttggttgaggagggtgtcgagaagggtgatcgcggcaaccgcattctgttgaggggtgcggaaaaccggtgtcccttcgacatcttgctggtcgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccaggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgttgtcgtggtggaaacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacgaaacccattgcactgatcggcgaaaagcttgacgctacccctacctggcgcgccaactgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatatccctaacggaatatgtaaatacagataaaatacagtcgtgaccgactaagtctcaaggtgtttccttgatgtacaagttaagaaacaaacccaggatacacataagatattctatc

SEQ ID NO: 458 - DNA, 1501 bp, Oryza sativa
ctccggccgttttaggcaagggttagttgacctgggatgaactgcctccatcatccatgcatatccgtgattccgtagcggagttggccggatgaattgcgtgtatattcagacgattcacgcacaggatgatggagtgtttcgcccaacgctctcgtaggtcaggtcgtttgggagctttccgatttgcgtaacgacagtgaaactgttgttgacgggtgcatagttattaactggttcacttgacaatttcgagccgctgggtgaaaggttaatctctgaactacttcgagctgacatgatatctctcaacgggattgcttaagtgacggatatatgtttgacttggtatatgtggtgctaatgtgcactaggtagagatgtagcaaagtgacagtgtgacacgacaccagtagaaggtgatcggtgtgtgttcctattttaattaatatatttcgatgtgatcttttaatttcacttcgttttttcaaatttcctctttctgttccactgaatcgagtagaaagaattattttctctctgctccaataaatgttcgatgataagatgaactgtattccgtgactatgataagaatgtgttttccaggtaataagaatcatatctcaattttctatttagtgagaaacttaattactacaacaatagctaagcattagattgatactagttttcctaatgtatagttggagggccactagttgtcatgaagattaatcaaagagcagtggtagtgtagagacccattccaatatattaaaaaattatacagtcttggtacattactcccttcgtcttagaatataagcatttttagtatagtgatagatcaaacattttcaactctaactattaatagaaaaaaatatcactcatataaaattgatgttactagatgtatcattaaacaaattattataatatataacctttttatttaaaacatcctacttttatagatattgttagttaaagtaacatctcggaaatcttgttagagtctaaaaatacttatattttgggatggagggaatatgtgtgattagtattttttatgaataagatcctattttataatagtcagtctcccaaattgttagtgcgcggccctgcaaacggtcacaccaaagtaccaaacaaccagtgggctactacagtatagtagtatacacattgccctataaatacacacgctattgcaactttgcaagtgcaagttcacagcgcagtgccgccatggagagcatcaacgtagcaccaggaacaaccgctacgcctcgcatggcgccgccgccgccgccgccgtgcatcaccaacctccagagtacccttcgctacaacaacctgctcttgcaccgcaagacgaaggggtggaagccgcggaacgtgtcctgcagggtcgaccgccgcgacgtgctcctcggcatcagcggcgcggccgccatggtggccacgcagggcggcggcggcgcgctcgcgg

SEQ ID NO: 459 - DNA, 1501 bp, Oryza sativa
gctcctctttactttcacacggcaatgaaaaatacaacatgctatacccatagaaaaatcaagaacaaaatagcttcaattcacagagcattcaatagatcacagtaagagcatccagtcatattgcaactcttttctgtcactttcgtatttttttagcaaatcaaagcataagtattcttttttgtctttgttttcacatatcagtacaaccaaacaaggaaaaaaaaaatcataaaccacaaaactatcgaaacaagggagagctagatccccaaatctacaggtctatcgcagcaaatacatcacgatccgccctcctagtgagcggcgaccaccatgtccggcgagccgaggaactccatggccacctcgacgggcaggtccgggctcggcggcggcggcgcgaagagcatcaccctcttcgccgccgcgagcttcttccgctgggggcaccgcgggccgaggagcctcgatacgggcacgaagtacggcatcaccgcgccgccctcgccgtccccggccgcagcaggagggggagacgacgagggcgcggcgggggaaggcgaaggcgacgagggaggggcggggcgggagacggcggggttccggcgccggagcctggcgtcgcggaggcgggcgagggcgccggggcggaggaagcggtggtggtcgacgacgcccgcggcggcggcggccgacgaggaggagcggggcttgcgtgtggctgccatgtgggcccgaggtgtcagtgagagccggatgcgggaggcgcggattggtgggaggcggagggagcgggtgggggtatttgaaggggttagggttgggcggggacgcgcgagccttaggagggaaaaaggtttgtgccaaaaatgggatcgcgccttcgttgctggtgacgcgtttacactatgacgagtgggtcccgtatgtatgtgggtcccacatggcggtgggatagatggcgcgtgacgtggagggagtaaattggggggaccggttgctcacgttttgaaacgagcgggcggcggatggcgcgcgtgccgcgtgatcgatcgcgcgcctatcacggtaacccgaccgatcgtatgggccgggttcgttgaaagcgttggatcgcgagaagaaaaaagtccactttacatcccttacaaatggatcgagttttaataatataacttgaacgtaaaatcaggtatactgtgcaactcgagtaaaagtgcatcataggaattggatgcaagccttgtccacaattcaacagttcgactagaaatccatccacaattcaacagttcaaggaattggatgcaagccttgtccacaagtcaacagttcgactagaaatccatccacaattcaacagttcaagtagaagtgcatgatgttccataggccatatttgcataggaattgccgaattggatacaaagtgtgtctgcagcaatagtctaggataagaaaaacatttgagcgggcaacaaacagacggcatact

SEQ ID NO: 460 - DNA, 1501 bp, Oryza sativa
taaatataatgatgagatgtgagggaggaaggaactccctcttttttaatacctgggtagggtggctttactttgcctacgtaaatcccaaccatctgtcttcatttaagatctaatctccaattaaatttcctatcaattcccaccacctctaccaatcaacgtaaatctcaaccatctctttttatttaagatataatctcccattaaacttcctatcaattcccaccacctctaccaatcaagagattgagagtaaaaaatcaaattcttatgttaatctcataatcaattctctcatctaaacctccaatcctttctcttaaattgccaaacagaattctctcatctaaccctccaatcttttctcttaaattgccaaacagaccgtcaactcctccgaacggagactaaatattgttttttttcttccgaacaagatgtacaccttttatgtccccttttttctcgatggtgcatccagatggcaataaatagcgtcccatgctgttcaaaacttcagaggatgcaacctgaaccacaccccattttttctctgaacattcagactgcctctgttcgtacccctgtactactgagcaggctaggctgtatgaaaggcatcgacatggactcatggtcaccaccatagcgttcgcggagcagcagtgtagcaccggagctcgtgtctctgggcagcctgcgacacaagagtggcgccatgatcagttggattaagctcagattgtcaccttgtcacacgtatcgtctcgttcgcatgatcaggacttcttttgactcccgagttgtgatttggaggttgaaacggatcaggactatagtatccaataccataaattatctcttcttggatcaactcgtcgagagagattaaacggcaacgcgtggtatccaataccataaaagcatcttgcagtctatcgacgaggctctctcttcggcagggtaccggtggctgcatcgtctggtatgcggtatttcaaactctcgttgctcttaattgaatttgttataaatattagtcgatatagcggaacgataactaatcttcccgatcgcttcagtcattgaccacacaagacatgctaggtgacgacataggaacacacaatatttgttaacaaactttagctaaagtctacatctctagggttctgattatgggcaatcctccacaaccaatatagcacctagccgctacgagttcatggcctcgccgccatcctctccctgtgtgtctacactacattgcagtcctcataattacattatggtacccctctctatttaagagagttgccggttacagagccagagtccgactttaactctacccctaccatctattataactctaagtccaactataaccatatacacctattctaacataatcgatttgatttaaacatgcgcttgtttcatccaataaaagaagtgtctttgttgctagattagatttgacaaacaaaatagcaca

SEQ ID NO: 461 - DNA, 1171 bp, Oryza sativa
cgcgctcggcccaatggccggccaagccttgagaatccctcgggccgcgcctaagtcgcccgaggaagtctaaatccgatccctccttccttttcttttccaagggaattaataattccttttccttgtccaggaaatccatttagacctccaaaattcatatccctcgatccgtagctccgatcgcctccgttccacttccagtaattccgtaaaattgagatctatttaatggcactactaataggtctaaataggatatttcttttggtcttttgtttaggttttcgattgtttgcgtatagttgcggttatcggttttcgttgatcgcgggttctctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaattcctataggttgtactaccctgattccttgtcgctccactcttgtggtacctcggtatccgtgctctctgagcgcgtataccaaatatcccacatacaccgtgattgtcgaaaaattgggaaatgggtttgagaagccttgaaaacccgacatgtggtgtcggtgtgtttaaaaataaaatgaattgtgaaaactcacgatgcggaggtggtgcctgcgtggcgctgtcccgtattcgcatataaggaccgattcctgtgggaaactcatcaatcataacaaagtgcaaccacaaggtggaatgggacaccctagctaagtaactagtcggttcagggaaacctcgcatgccaatagttggggaacgccggggcggggtcggttggagccaacccgggttcctggtaatgcaagaacgcgaagcttgttgaattaccgatcgaggtggttggagtttgatttgtgaaaactaaaatggcctatgtttatgtgaggatttgatccttctatgtggcatgaggtatccctgggtcggcttgggaaaggctttgtctgcgaacctctgacaccggccagtgtctggagtaagttcgtgtcttgtgggtaaagtgtacccctctgcagaggttaactaactgttcgaacag

SEQ ID NO: 462 - DNA, 1501 bp, Oryza sativa; identical to SEQ ID NO: 414

SEQ ID NO: 463 - DNA, 1501 bp, Oryza sativa
ttgccgggcgactccgacgacgccgtggtggtgctcttcgcctgcttgccgccgttgtcagctaccatgccatcgtatccagcggccagagccgacgaccaggcggtgtacccggcgagctccgtcgtcgtcgagcacgtcgccgccgccggtacccccaccgcgttgctccaccacacgccatgagagctcgtcgtaccaccgccgccgttgtacatcgccgccggagctgcgtgcatcatctgatgatcccccatgatcgacgaccacgacgatgtaataatctctatcctgaacctcgatcgatcctccgtttcttggctagctagtttcttcttgtggtggagagagctagcaagagagagtgagtgcttgcttggtgtgtgggtgatgagcaagttgcagtggtgaaggggaaagcgagctgaggagaagtagtggaaagatgtatagcttgtgtatatatatataaaccgtttggaaagaggggagatgagatcgaggaggagaattttggctgtctgaccacaccggagatgaggcgccggataaaccggccgggggtcgttgccggtcgtccggcattgcgtcaggttattctggtgcaactgatcatgatccagcggttgttcaacaacccacagagagttcagtactactactgcactaatggatgttagaagagcttaattccccttgggatatgtgtacttaatttagttatgtcagtagtatatgcatgcatgcataaatgtagtctatgcatggtagtcttagggttttgacatgccctagctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgtgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaatggatccgaactttc

SEQ ID NO: 464 - DNA, 516 bp, Oryza sativa
cgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcagacaaagcctttcccaagccgacccagggatacctcatgccacatagaaggatcaaatcctcacataaacataggccattttagttttcacaaatcaaactccaaccacctcgatcggtaattcaacaagcttcgcgttcttgcattaccaggaacccgggttggctccaaccgaccccgccccggcgttccccaactattggcatgcgaggtttccctgaaccgactagttacttagctagggtgtcccattccaccttgtggttgcactttgtta

SEQ ID NO: 465 - DNA, 1501 bp, Oryza sativa
tgtccgctcccgcaccaggacaagggagagagcgaggcggccttgcccgtaagggataaagcgaaaggaggaggaggaaagggagccttgctccttccgttttgggggggaagaaagatgagagcacgagcccagcctcacgtctttggacgcatgcggcatggagtggcgagggccatggatgacgtcggcgatgacggcggcgggcggtttgtcatggagtaggggcaaggcggcagcacgtggcgtcggtggcgcaagggctgatggcggcggcggccagtcggtcggccacctcgcgagcgagcgcgcgcgcgacgcgggggtgcggccggatttcgaacagcggtggcgggaaatcggcgccggggagagggagttcgacgagggagagagtgagagatacagagagagagagagcgagcaccctcgctcagagcggcgcacgagcgaggcacgcgagggaggaaggagcggctgagggagagagatgggccgagaggaggggatgggccgggagagagaggaatcagcccatcgacaagggaggcaaaatagacttttgctgaaagattttgatttggagagatttggagtttgggctttgaatctaaatttgatactttgtacacaagggttcaaggagtcaaggaaggaaacaaaatgggagtttggatattttgggattcggaaatgtatttggcgaggattcaaaggaagggattgactttcggaattagatttcggagacttgaattggtagaggaaatttgaggcgggggattttgatttcgatgagagggaacaacgggatttgaattgagatccacggcacgacttagactcgcactcaaaggacaaaatttttcacaattaggatttgccgaattagtttttaacatctcacgagaagtggagcgttacaatgtatctacgaaattagtagattaattaataagtcaatccactaattaccttttagccaaattgaattgtactccacaattagcacgtctagatggcacctatgtacgcatgcaagcatacctatggctaaaaaagccttcggtacacgccgtgcattactgtacatggttcccaccgcatacatgcttaatacatgtgtagatgcagtcggccagctgattgattggcgggtagacgacgtgtagttgaccctggtccggcggtaattcgtcaaggtcttccgcgacggcgacgtcttgaagcttggtcgatctcgcctgatcgaatagtcgatggtgatgattctgatctcgtcggaagatgtatttggacaggttggatctcccagagccgaagttgtcgagtaacttgttgtcggagaatccatcgtttgaacccatctcgtcgaaatcctagagcaccaaaatccccctacctggcgtgccactgtcgacgtttgatgtctcgactacggtatttggacagtatggggatcgttggtgctaggatatatgcgagactgaggtaaaagaga

SEQ ID NO: 466 - DNA, 1501 bp, Oryza sativa
atacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggcttt

SEQ ID NO: 467 - DNA, 1501 bp, Oryza sativa
caccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaag

SEQ ID NO: 468 - DNA, 623 bp, Oryza sativa
gataaatggaggaaaaacaaaggaattgaaatcctacactattcatacctttgatttgtaggaatgagaaaaggaaaaacgtaggaaactttccttttcctacgattctagaggaaaaacgtaggaaatttaacatccactccaatttcttggaaaacttctcttgagtctatctctctcatctgaatcctgcgtttttcctgtggtccaatcaaacggccattcctgtgtttttcctgtgttttgcaatcctctgttttatacttgcattcttatcagaatcctatatttttcctattcctccgttttttcaatcctacgattcaaaggggcccttatatcctctaatatatattaccatgtgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcatgccccccatcctatataaggtgggcaggaggccctctagggggcaga

SEQ ID NO: 469 - DNA, 1501 bp, Oryza sativa
cctaggagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatga

SEQ ID NO: 470 - DNA, 1501 bp, Oryza sativa
ttcccctacggtatctccggataccgtcaggagatacgaaagcgctatctctgatctcgccgggcacggattcgaggaggaagactaccctgttgttgactacgagtcagactttcagaccaacatgttgataacagttagataggctgcccacatattgtactggtgtgattatggtgaataagagcaataccggctttggccaacaggatgtagggttattacctgacaactcaggggcccgaaccatgtataaaaatccctgtctccatctcttttacctcagtctcgcatatatcctagcaccaacgatccccatactgtccaaataccgtagtcgagacatcaaacgtcgacaaatgtataaggactactttagaggcttaagacccccctcctattgctacattgtggctgccctaaggagttgtttagattgacgtcattataagatataccatttttttaaagtaaagttgccaaacatgagcaaccatttagctttttaccatattttggtaaataaaaaaaatcttaccaattgataatgttaccaaattgggagtacctatacatctttcgaaagatttgttatcaaattttaaaaagatttattttagctataatctgaacaagaacaacctctgatgcccgagccatcttaataggccacgggtactcgagatgggccgatccatgcgcgatgagccgtgaattttttttatttataatttttttatttataattttttttattaaaagttttacaaaaataattttccattttgaaaattgacggaagtagtcgcctaccgccctctgggagggcgatttttaaaaatcgccctctcagagggcggcaaatatgacgtggcagacggccgttcgctctcgggcgacggccggcatggaattttgcaggcggcccccttgccgccctccgcgagggcgattttgcactgtgcggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 471 - DNA, 1501 bp, Oryza sativa
ctccgcaggggcgttcgccacctcttcgggcgcgttcgccagctcttcctctcacggagcgtcgatccctcgcccacacggtactttactttttattaatactattaaatacctgtatgaaactgatagtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgagttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacgcactttcggcgcttcatggtagtgtcagatccagtagcgcgtacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacataatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaactatgccctaaaaaataataaaattgtattttaccagtcttggagattttaatcttgtatagttttcaatataaaaagatttgataactattgatatttataaaaaaaaatatagcacagtataaaatcgccctcccccagggcagcaagggggccgcctgcaaaattccatgccccctcgccgcccatttgcaggcggccccccgcacagtacaaaatcgccctagcggagggcggcaagggggccgcatgcaaatttcgttgacggccgtcgcccgagagcgaacggccgtctgccacgtcattttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaatt

SEQ ID NO: 472 - DNA, 1501 bp, Oryza sativa
agagagatctatctaacagtgatcacaacgaaaagatgcaaatcttagcgtacattaccaccggtagcagcaacagcgagaacagtttcaagttcaaaaattaattgtatgagatgcatatatactacttcatacaataattttttaaactgatttttaggtgctctttaaaactgatattcaaaaccttgatcagaaccaaatggctcgttagaacataatgccctatttgaatgggagagactgatttcacagaaatataagtgcctcctattcaagcagcccctaagtctatagggtgggtggggagaggagcaacgatgttggttagatggcttaattgctgttcccggattttttttttaaaaaaaaagacacgttgaacgaatactctcgacctcctttttctactggagtactttgagtcaccaacatatagatccttcttacttccaaaatataaacatttttagaatagtgtcaagttattttttttaactttaactattagtagaaaaaagatcaatcatgtaaaattgatgttactaaatttatcattaaacaaactatcataatatgcaactcttttttatttaaaacattatatatatatatattattgatcaaaatagcatctcgaaaactgtgtcgaagtttaaaaatatttatattttggaacgaatagagtatgtatccacatgttagtgatcctaaaatcacttgatttaaatcaaaggatctcagtctaggataaatcagggtacctacgtttgctactaatcaaagacccacacaagacacgttctccctccgttccgaaaaaaataaatctagtaatggatgtatacgaatctaaacatgaacaaaggtatctccagattatagttatagatatgtcacatccagtgctaaattgtttttttataggacagagggtgtaagcattgagcatgctatgtatatattcctactcctttggtcccaatataaatacacttaatgcataatataaatgcacttagtatatgatgtgatatattctaatacacatactccctctatccaaaaaaaaggcaaaccctggatttccgtgttcaactttgactgtccgtcttatatgaaatttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagacatgacaacaccaacaatgaccccgaccaaaagcaacctcagtacgctctgctcagtgcttggggtcctagctgctcctatttggtgcgtgaagcaattctcactctttcttcgtctactaggagaggcgaagtagccaactaaccgcggcgatgt

SEQ ID NO: 473 - DNA, 997 bp, Oryza sativa
ttgcatgtgtcgtatggttttagactaaaaaatttctataatgtcgcaaacgaacaaaagtaagcttcagcaaatctcgaagacaaaaattcctaatctcggaataataaactatttatctatatattaggtggatggatgcatttggatacctggagacacccaaaacccatgttccctaagcaagcgaaaccgaagagcaatctcatagagactagagcttctgaattcactgccatggatgcttgttagagcatcttctatctcctcttggaagaggtgatcaattccgagatgttggacggaatccactaagttcatcctcgccgacatgtcgtggcaggtcccaaatagtgtctggatttgccctctcagcttctcagccctctcctgcatccacctctctgatctctgcatgaaattatagcatagatccatcgaattagctagctattagctagttagcatggcattaattaaaattagaagggcagatgtacacataggaatgagtagtggtgatgcctgcaatggttgtggttcgtagttgataaagaagtcgccccatatcgagggctcaaaactgagtgcctcctcatgggtaggagtatcactcgaggccataatatggtatgtgtttatgtatttatgcaggtacagtaagtactagtaaatctcagcgattgccgattggcttgatatttatgaatgcgaatgcatagcaccatgcctctaatatatagatgaaccagaacacagtactccttctagattggagtacttatccttttggataaggatacgcatgatgttcaaaaaataactatgacaactattttatattatgatatatatagtaatatcaacgaatatatgaatttattgaagtgctttttaagacaaatctatacatatggtctcaatacttataagtgaaatattttagaaattattcttagttaaagattttaaagtttgatatcagttttatccaaaa

SEQ ID NO: 474 - DNA, 1501 bp, Oryza sativa
caagcgggccccactggcagcggcacaaggggagagggaggggtggtccaccggctggtgggccccaccgggcagcggcacagggcgggagaggggcgtggccgctggcttggcacggctcaagccggccggccatggcgaggcgacgacggcgcacgaccgccggcggtgaccggcggcgcggggagacggcggcagccggcgcgaaggcggcggcggcagccgaagacgacggcggacgcgcggagggcggcggcgctcacgggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggaggggaaaaactcaccggctcgcgaggggagaggtgctccggtgggattccggcgacgcgaggcggcggccgggaaagctcttgcagcggcgaagctaacggcggcggcggtttggcgcggcggcgactctagcggcggcggctcgcggccgaaggcggcggcaagcggcggagctcgggtgcgacggcgcgagggcggtagacggcacgggagagcgcggcgagtgcgaaaaacgagagaggaagacgcggggagcgatttataggtgcgggagggggcggacgtggccggggaggtggccgatttggccggcgatgtgggggagtggggaggaagagagagagagagggggattcaaatccgaatcccgcacatttgcgaggcgcgcgagggcgggagacgcgggggcgaggcggcgacgtgggggggggagacgcgggagcggcgcggcgtgggcgcgggaagagcggaggaggcggcgacgtggcggattcggcggcggctgccgtcggaggcgggtggctggaggaaggggacgacctgacaggtgggccccacctgtcagcgtcccggagagaggaggaaggagaacgggccggcccacaaggggaggccgagcgcgggcgacgggtggagtggactgggccgacggcccaatagagaaaaaggagggaaaagaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaatattgtagagaatgtaacttagggcgtagtacagaaatgcgaggttaacgcagttattgttttcatcaggcacaa

SEQ ID NO: 475 - DNA, 844 bp, Oryza sativa
  unsure (1)..(844): unsure at all n locations
ttgatgtggcatgccacacggaatgacgtggcatcattttgactgacaaatgggtcccgttaaaaatttttcctttttctttttttcttctctttttttccctttcttctcctttctctatgancccgagcacgaagaaaggggaaaaaaaaaagaaagaaattaaggaaanggggaaaacgaagaaaaataaaaagaaaagaagaaaaaaaaagaaaatggcacgtcatccatgtggcatgccacatcagcgccacgtaggatcctagaggggatgtgtcgatttgggacctagatgatacacttttacaagttctgggacctggatatgcattttgagagtttagggacctatatgagacaaccatacaagtttaaggaccgccaatgcactttactcttcattttttgccggatgaaactgtggattccgttaaacttaaatttctggtaatggaatcgggggaggggtctcctcccttgctcaaaagaaaagaaggcatagtgagataagacgtgctaaatcgtattagacaatgccctttactagcgtgtcattcaaaagaaaatgtgtataaaattgtacgacctgttattatctaggaaattggggtttgttttgtgctttatgaaaaaaaatcatgattaactgctggtgccttatcgacatgtaatggaagcttgagtgatacacagtaagataatatgttctgaggtagataatatgttctatctagtataagagaatcaaagtgggtggaattgtgcaccatctgtatctgctagatagaaaaaaaaatttaacttacattattctttcccttttcttgtctgtcatgtaagc

SEQ ID NO: 476 - DNA, 1501 bp, Oryza sativa
gagtagtactagtgctatcttgattgaatcgatactacagtgccgactaaccaatgaaatcataaaattaaactatttaataccctgaacagtaaagtctttttttagaaaagaacaggttctgttttggtaaagtaggatttagaaaattttgtacctaacttgcatgtgctgccaacttaattaatttagaagataatagagaagagcagtcctatttttcaaaatattttgaaggctacttaagatttaccatttgacttgtcctaaggtcaaggtggctctgataccaatttgtcacgcccagaatttctatcaaaaattccaaaagcttacatgtgtgttaaatcctcgtccaggaatcagccgaggcacacaataacaaattgataatagagtactatcaaacagctaattaatattcgcaaaataataaattattacagaggtggatagttcctctcaaaagaataaaattctacgcagcggaaaataaacaaaagactaaacagctatggcgactccactccacaagcaacttgacccgaacaaagcctaatcctcctgatcatcaccttcactgaagtactccttctctgatgaatgaatattgcaagaatgatcatatgacatactcaacaagccacacagcaaatatgcaagtgcacaagataacaaaggatggcacaatatagcttatttgcataaacaacatttaataaacatttgagagaatagtaaaacagttgagtaattaagcaatattaaataaacactatacaacaaagccaggagtacaaatcaaccaaccccggctgtacaaatcaaacctccataccaggaatataccattccaaaccaggagtcaaattaattatcacattattatcaccaatgataagtagtgtgagactaatcatgaaaaacattgttagacctgcccataaccacgggcacggctatttgaatagttttactctagccagagatgtaccactgtacccacaagacacagctccacaacatgtcaccatgcacctcaataccaccacggtacctcggaaaggaactgtgacagtacccctcgtacaatacaactcaccatagtgcaccatacctgaatcataataaccccctctacaaccaaaggcatggactccccagcgacccccatggatttcttgccgcttctcagtctggcaccccgtaatgaaccatgctacacaaaaggtaaagccgttgcccacgctggcttgaggttggtacggttaatgttgcacaacagtagctcacgactgagcatgaccatcaaaaccatgtactcacaacccatcattcattaaattttaattatcaattaattttcataacacgattaaccatcgtgagctaccattaaatatatccatgtgtaataatgtagtgtaatcatcccattaatgagctaatgtttctaagcatggctaagcaattatatatatatagcatttagctgaaccaa

SEQ ID NO: 477 - DNA, 1501 bp, Oryza sativa
gagtttatttctccaaactaaccatcggattttccggctcaaatcctctcgtatggagtccgatctccctcacccatgcctatataaagcatcccctagtcgtcctcttccgtttgcctcaagtcttagccgcagccgttgcctgtagcgccgccgccacgtgagccctagcgtcgctgccgccgtcgctgcttcagccgcgccgcagctgtggtcgccgctgccgccttccgtcgccaccgtcgggttcgccaggtggaggagcatcccgtccgccccttcgccgctgctgcatctcgcgtgagcgccgccgccgacatcaagccgagccgtgccgctgtcggagctcgtcgccggtcgtcgttcgtcgtatttctttgcaccggtgagttcgcgtcgttgtcctcttcgtgtaggtgccttcggtttagccgcccgagctctctatcgtcggcggagtcgtggtccagtgccatggctgcgatgatgtcatcgatgacatcataattcccttctaaatctctaaaagcttttctgtattagatgaaatctgattaaaacttcggaaattcataactaaatcatcgtaactcggattcaggtggttcaaattgctaatttcacctaaaatcgagatctacatgataaaaatatccacatgtactgtttatgcttgtttttttactgttttattgattttattcatttgctttagtttccgacgttccggaggagagcgtttacgttgaggaatgttcagaagcgtttgaagaagatcaaggcaagtcacacagatcccaaacaaccctttgagcatgttgaacatgtttaaagctaatgctttatttcaacttatgcattatttttcgaatgtcatcgggtagtgagactttcccagttaattatggccgaagatgactttattttcctatgggtaataaattgattagcttgaaccttatatattggtttggttcagctaaatgctatatatatataattgcttagccatgcttagaaacattagctcattaatgggatgattacactacattattacacatggatatatttaatggtagctcacgatggttaatcgtgttatgaaaattaattgataattaaaatttaatgaatgatgggttgtgagtacatggttttgatggtcatgctcagtcgtgagctactgttgtgcaacattaaccgtaccaacctcaagccagcgtgggcaacggctttaccttttgtgtagcatggttcattacggggtgccagactgagaagcggcaagaaatccatgggggtcgctggggagtccatgcctttggttgtagagggggttattatgattcaggtatggtgcactatggtgagttgtattgtacgaggggtactgtcacagttcctttccgaggtaccgtggtggtattgaggtgcatggtgacatgttgtggagctgtgtcttgtgggtacagtggtacatctctggctagagtaaaac

SEQ ID NO: 478 - DNA, 1501 bp, Oryza sativa
tcatataaacatatttgttccacatatgatatttgatcagggatcctttagaaatagtaacaaacaacataaagagtctcatgaaagaatcacatattcattaaccaataaggagctatctatttcaaggaacaatgtcggataaatatgtaaacatagtatgtgatataatcatctctatgattgcctctagagcatatcactaacagtcgtcaatcagccggggtccctctccacgcgaggtcgccgccggccgctaggtctctctccatgtgccgctggtgggaggccaacgaagatgaagaatcgcccgtgggccctccccgcgcgaggtcgctgctggccgctatgtccctctccgcatgccgccggtgccaggctgatggagagggagaatcgctcgtgagccctctcctcgcaaggtcgatgccagccgccgggtccctctccacgcgccacccatggggaggccgccgattgcgcgtggcggaggggaagagggaggggagggtggcggaggaggcaaggggggagggggcggaggggaggcggaggggaggcagagtaggtagaggagggtgcagcagaggagggggcccgaggtgaggcggaggggaggcagaggggtagaggagggtgcagcgagggggagggcgctgcgacagagtaggagcgagctagggatggcaatttcccccgtggggccggggacccgcaagggatccgcccctacgggggcggggacgggtggaattttcaacccgcgaggagtcggggttggggccccggccataggcggggatgggggcgggggaggacaaccacccacgggtgacccgcggagccccgagggtgtatattagactattgatactaccatattgcaagcccaaaaagcccatctaacctatcatatataaaccaaaccctaatatttccaccaccatctacccatcctcttttcctcaccacccatttacccagccgtcactctccagtttcctccaccaccagcgcttcctccggcggccaggctcgggcgatggcgtcggctgccaggcgcgagcggcggcggcggtggccaggctctggcgacggcatccaggctcgagcggcgacggccaggcgcgggcggcggcggcggccaaggcgcgtgcgacggcatcggcggccaggctccggcgacggcgtccaggctagagcggcggcggccaggcgcgggcggcggcgtcgccggccatagcgcgggcggcggcggctgccaagcgccgtcatctgcgtcggcgttgatggccatggagcttgtagcggcgggagtggcgacggcaaggggcgcggccaaccgcgtcggcgtcggcgtcgacgtcaagggcaagcatgtgcagcggcggcgccggcattcctcatctcgcgaccacctcgtcgccgtctgccatgggtggtgcgggaccccgctcacccgcgggtcccctacgggggcgaggacgggtgatgtttccca

SEQ ID NO: 479 - DNA, 1501 bp, Oryza sativa
ggcagatgactttttcaccctttccgtcattcccgtcgatgtctggaacgaaacagaggaaggcatagcagccgcctcactggcgatagtctccccactggatgcacgtgactgaccattggcttcagggatttggaccaaatgcaatatatatatacagcgtttttgaaagatatatatggtagtactccttccgtttctactccctcctttttttaaaaaatctgttatccattttttatattactgtaccgtgcatttgcgacgggatcagaagaaatatggtgtgggaggtgcgggccggtttgattttcacgggcgctgcgcatggtagggaaggaaggaggatgactggatttctaaagatgtagagatagtgtacgacacagttgacttttaatcattcatcaatttaatttagtgtaatatgtaaaaacacaggccaatgataaacaaatgcaggtatatatagttttataatacgaagatataacgtccaaacccaaaagtaaacaaatgtaataaagtagtatttttggtcatcatttattagtgttaacttaattttgatcgtcaataatttaaaattatttatcgtgtgagtaaatttcacaaaactacagatactataaccaaattatcacaaaactacagatttaactcggtgtatcacaaaactacacatttaacaccaaatttatcacaaaactacacgttaaagatgaagtgtcacaaaactacgtatttactaactaaattatcacaaaactataggtttagaatcaatttaatcacaaagtaatgatgtttatagctccacgataacaatggtgctagggatttaaacttcaaaagttatagttttgtgataagttcaatattaaatatgcatttttatgatacttaatctaaaatctgtagttttgtgataaatttggtgctaaatatgtagttttatgatacaactccttaaatctgtagttttgtgataatttggtcaaaatacccgtagttttgtgaaatttactcttatcgtatttacttggctgaacagaaattgtacggtcatgtttaatatatagtaatatactttatctgtcctaaaatatagctatttgtagagttcaaatttatattaaaatttagctatttttcatctaaccttttatctcaaccaatcgtaaccatctcccgtttaattgttctacctaatttattttcttaaccgatcataacattttaccattcaattctacctgctttcttaattcacattaaaaacttttaaatatttaagtattttaaaaaatgcttactttctttagatatttataaattcatagtcaaactaatggtcatatcagaatttaaatatgactaatccccacttgacaagtagtatttggtaggggggtactactcctatataaagggctgggtacggtgctcactagcatctgaggtctgagcttgaaacattctatcgagcccaagtacacag

SEQ ID NO: 480 - DNA, 1501 bp, Oryza sativa
gattaatattgatgattaattactctattgttttacaattctcaaatgtttgctaaatgctgcttttgtaaatgagcctatattatgccatcctttggtatcctgtgcacttgcatatttgctgtgtgccttgctgaggatgttatatgctcaccttgcaataatcaatcaacctcagttgaagaaaaaggatccaaaaggagaagacgtttggcttatatcatagttgagctgcctgtgggagctgtggagccggagcttcgctagaccgtaattccgctgctgtttttcttttcttttgtaagtatgtacgttattattatgatgaatctatatattaaattgtcagtttgtgtacctcggctgatttttggatgaggatttcatgcacaaattagttcagaaattactagtgaatttctgggcgtgacacctgactccgacggaaaagctgaggcgcaatggccacatctcacatccgttaacgccgcctcacaagccgccgttctggtactgtgtgcgggaccacgcttccggtgcacggaacatgacccgggatcaggactcgcgcatacgaacggagccttactccagccatatacaagacacaaacctaagaaaatgaggaacacaaaatggacttatcccaaccatgtagaaagacggcccaaatagttgagagatgcaatatagacttatttcaaaacgatcacgatagaccggtcatgctttcggatcggcacagcatcttaatgggccgtgcttgggccacaggtttagcctgtgtgcttggccgacacgacacgaggagtatgccgggcgtgctggcctgacatgccttgggccacgccctagtcgtgtccggttcaggccgtgccgagcggcccattgaccatccatactgatggggtcttttctcggtgctttggggtggtcctatcgacggtgattgtgtaggtcgggtcggcggcgtgcggtgggtacggtgtcttgcacggttgcaccgctgatatcctccttcgaggagtcgttgaaggcttggcttcatatagatatatatatatatgtggtccgatatgtggatggatcagtcacttcaggcttcttaagaccgcctcactgcatttgtttttctgcatgagagggcttgtcaggccaggcagcagatgattaatctttggtaggaaaattctgacataagtttgtaagcagacgagcgagtctttatttcttgtttgttattttcagattattcaccattttatcgaaacggattatcctacttgattataaagtgaactggaaaatatttattaaccatattaaatgatcgaaaggaaaaagtacgaattacctcccccaactatcgcggtcgaccgaattaccccctgaacccgaaaaccggacattctttacccccaactatgaaaaccggacgaattaccctcctcgatccaatccgcagtggttttggtctacatgatagtccaatcaacaattc

SEQ ID NO: 481 - DNA, 1501 bp, Oryza sativa
gcgcatccacgcgcggcgcccgtgctggtacggtcggagcaatgggtatcactggccactgggtagtggctgaagacatcgttgctgataggtctgaaagggagcagtacactaggatgtgcaagaacctatcaaacaacacttcgaggctatgaggtaacatgtatgtattgtagaatttcctaagtaaatgaccgcaatcaagcaggggtctttagcagcatgatttgatctaaaacaactgagccttttcaattagcactatatattggtttctgacagtaatatctgattgcattgctggtttcaacttcagagtttacaacccacactctgctccacatttcatttctatcatgggagatgtcaaataattgttgtaatgatttgagaagacaagtagagaataaataaatgagcagccggacattattcatgtactctgtagttgaatccattaggagagaaagatatttttctcataaaaaaggttgatcggaagttaaaaatcaataatgacaaagaacatgagcatctatgtttaccttttgggtttctgctggatcatttagtttagtttgacaaactaattattaatactcatctgcattcgggcaatccatctcagccgtacaaactaattattcgatggctgtgctatttttgccatattaatccaactaaactaaactggttggccaggggatcccaacccgtcgctgcctcccgtctcttgcgagacatcgacggaaacgtcggcaaagctagggccgaccagccggtcgaagaaaagtaggaggggatgaaaattaagtcatccagctttatttatagtccaatatccaacccaggcaacttgtgtcttatgtatatttattatgcactcgaatatggagtatatatgaaaagacttttctcaagattgtgacgcaaaagattgttataccgcggttgtccgtgcaagtgtgggacaaggatccaaatttcggctcttgccgataggggtgggcagaattagaccaaaccgaaatgaccgggaccgagaccgaaaaattcgggtagctatacagtcctagctagcaaaagaccgaatttatttcaggtatttcggttattgggctcggttaaccgaaatacccaagatgaccgaattggcccaatagacctagaggcccaattaagcccagtaaaaaaaccctagaatccctaccccaactccctctgtcccttaggcgtcgtactccctcctcacattcaccgcgccggcgccccctccgcctcctccctccaccaagctcgccgcctccgcccagcgccgagcgccggcgccacctgctgcctccaccgcgcagcgccccatccgcctcctccctccaccgagctcgccacctccgcccggcgccgagctcgcctcctccctccaccgagcgccggcgccgcctgctgcctccaccgtgccggcgccccctccgcctcctcccttcaccgagctcgccgcctc

SEQ ID NO: 482 - DNA, 1501 bp, Oryza sativa
gcctgggttggatattggactataaataaagctggatgacttaattttcatcccctcctacttttcttcgaccggctggtcggccctagctttgccgacgtttccgtcgatgtctcgcaagagacgggaggcagcgacgggttgggatcccctggccaaccagtttagtttagttggattaatatggcaaaaatagcacagccatcgaataattagtttgtacggctgagatggattgcccgaatgcagatgagtattaataattagtttgtcaaactaaactaaatgatccagcagaaacccaaaaggtaaacatagatgctcatgttctttgtcattattgatttttaacttccgatcaaccttttttatgagaaaaatatctttctctcctaatggattcaactacagagtacatgaataatgtccggctgctcatttatttattctctacttgtcttctcaaatcattacaacaattatttgacatctcccatgatagaaatgaaatgtggagcagagtgtgggttgtaaactctgaagttgaaaccagcaatgcaatcagatattactgtcagaaaccaatatatagtgctaattgaaaaggctcagttgttttagatcaaatcatgctgctaaagacccctgcttgattgcggtcatttacttaggaaattctacaatacatacatgttacctcatagcctcgaagtgttgtttgataggttcttgcacatcctagtgtactgctccctttcagacctatcagcaacgatgtcttcagccactacccagtggccagtgatacccattgctccgaccgtaccagcacgggcgccgcgcgtggatgcgccaccactcgtcgctccgcagcttcctctgcccccaccacgccggctctgctcactggtttctggtcgccggcagccggctacccttcgccactgctgccacaggataaagaaatctaaaagaggaagtagctggaagcggtggagtgttaaatgccgattttttttttcggtttgatggaacaggattctctgaatctttctcctggttgtgggctaaggggaaaaaaaaacaagaaaacgctaggattgtgccacgtatacgatcggagcacgtggggagcaggcaagcccgtcgctgcctcccgtctcttgcgagacatcgacggaaacgtgggcaattacgatgagtttgaggaatttggacccaatgcagatgcttttccttttcatgtttttggtcgatctgaagatatttgttcgttcaagcatggtggtagtcgatccggtatataaaggagggtgctggagtataaaaaactaagcctgaaaccgcaattcagccagagccccagtgatatcgatagtacagtactgatcaaagaacagcattatgcaaatagtatcaaatatgggttccgccggcaagtgcgcgccaagccttgcaccaacacatataggacttggcatgatggggaagatcgctgtga

SEQ ID NO: 483 - DNA, 1501 bp, Oryza sativa
ccatccaccatccaactacacaagtcccagccgactatgaagttcctacaggtagtgtcaagttcctgcaccaaaaaaattccacctagcagccactactaagttttggcgtgcatcttgccagcagccaggaaaaaaattccaccaagcagccactgcactttcggcctgcatcctaccagcagccaacaactagtgccaaaaaatcctgtgttctagcaaccaacgcaaaaaaaactccagccaccaaaagtgccaacccgcaagcaaccagcagctagcaccaagttctagcagccacatacaccatacaatagcagccacatacaccaccaagttctgaagtaccaaaagcgatcacagcctcgaagttcaactacactaacacgagccatcaaattccaagctcagccacctcattcctgccatcaaaaggtgcatgttttcagttgatggtgaataaaaagtccattttgtttggacttggaggcaaacaaatgaacaaatagtgtttagagtaataatccagcaggtaaattgagtaataacaatatattgatatggctcttttccgtaaagtccaaacaaatggctcttttctagtcacaactaaatccaaacaaatggctcttttgcagctaataatccagaaaaaaatagagtatctagatcgatcaatcaaatggctcttttccagtcacaactaaacaatatctagtttcatagtaacaacaactataaacaatccagcaagtaaattgaaataggcagagtaataggcaattttgatacacaccatgaacaaaaaattcagccaccaatgaaacagtacaataggcttgatatggatgcaaaagcacaagagacaagttaaagctgtgcacctgagcatacaactagcttagggaggactgatcagaccctgtccaaatgctatcatttgtcgaaggaggccctgatgatgaagtgagggtttcccgggcatgcatatcctcctagcaatgaaagcaaggtttcagttttgcattattatataaataaaggttcattgcataaggtacttaataaaagaaggaaagaagatgtaatagttcagtacttactatagctttctttacaggttcactaaaacctttagtttgctgcaatgcaactcattgaagagatcaattacagtgggctcactgtcaattgcagtgcccatgctcttcccccttggctccacttgtctactgccaatgagggtgcctaacataaaacatttacaagtgtcaataaaaagatcctgcacttgatatgaaggcataacacatgtaaggacaaaagaaccaagaatccaagttacttgccttgttcagtagagctcaatcccattggctccagttctgtacttaaagtgaggtcgctcaatcccattgccgccacccaatatggccacccagggcaaaggccccatctgcggcgcaagaaggaagggttgaggatgatggccagctgcggc

SEQ ID NO: 484 - DNA, 1501 bp, Oryza sativa
aatccttatatttaaggacgaaatacagttctcacataaaaccggccccaaaattatcaacttcaatcgtccactcgtatacgtagaaccaagtcgctagtctttttctggaaatgtaaaacaatactgttctctcacaaggtccaaccgacctttcttaaatgaagggcccagatttgcgctaattcacagatggctcctctgcagcagcaagaactagagctggggtgtgtttagtccacgctaaaattaaaaatttggttgaaattaaaactatgtgacggaaaagttagaagtttatgtgtgtaggaaagtttttgatgtgatggaaaagttggaattttgaagaaaaattttagaactaaactcggccctaatgcagagtttccgcttctactaccttcaacttcaagtcattaacaaatccacaactgggccacttaagcagtaatttaaatcctcatcccgacatatgattgatttcccaccggccaaaaccactgcacgcgccgatgcaatcagaatcaatttctattaacattgacctctcgcagctcgcgcatgctcatctcgtcaactaatgatgaatgaatcgtgaattctctctctctataaatggctactaattcgatcatcccaaggcaataatccacagacagcaaaggatgatgcaagccaagaagccaagatcaccattgatgatgctcatcgccaagaagccgctgctgctgcttcttcttctgctcgttctcctggtgttggagccaagatcatcagcagaagctaacctcgtcggcgtcaatggcggagagacggatgagaggcggcttgagagcttggtttacgacgagctgcccttctcccagctcggcttgggattccctaccaccgtcgtcgccggtggctccgaggtacgttaattacgtacttaattagcgcaaattcaattgctgtaagaaagaaaaatcactcaaatgagaggttaaatttttttttggggaaaatgagaggttaaattaggttccaattgactgaaaatgcagcaaagttttttttaattgttcgagcaaagggatttcttcgggtttttgtgctcttagatgacattggtgagcgcgcccatgcacgacacaatggcatgttcagggagtttccccgcacgcactacgatttctttaggaatctttcgcatctcaaataatctagatttttacatggattctgaagattgaaaacctaacattttgagattcttattggatagttattcgataggataatagttgcttcgcagaatctcaagcaatccaaatgggacctatatatacatacatataacggctcaattttccgttatacaaatacgtttgtgattaaaaaaattagtttaaaccaaaatgggctcgcaagttgtcttttgagaaatttcaaaccctgtttgtcgctaccaaactctaagggctctggtgatctgttgcgcgaatatcatcctaaaattttg

SEQ ID NO: 485 - DNA, 1501 bp, Oryza sativa
ccgacataaaacaagctgaaacaaatcaaccggcacgcaatcacaattagggttcttcgtcgccggatccgacccaagaaatcccttcccacccccaaaattcagaatcgccgactccccccgaatccagttacttgtcgttcgctcggtcgtacctgttgtcctgattgaaggaggcgcaacgaatctgcggcggcggcggcggcgacgagctgctcgccatcgcccgcgaagcgacttcttcctcttcttcttgatctcgtggaattgattcctgcttggagttttttctttctttttttttactataatttatttttatattcggaacagtcaaaagcagaaaagaagtcgacctgggctatctacttgcagcccatgcagacaggacggcccagtatgacccaagaattcacaaacttgcaacaaaagagaataagttcatgttgggtcccttaatttgtcgcccagtaatattcgcccttaactgaaaaaccagataacatgtcccccagtttataaaaccggtgcaaacaaggtccctcggcagtattgtctccagttttagctgatgtggcacctacgtagctcatttgactagtttttgtcccacgtggtgttgacttgatgcttacgttgtaatttgaagtggaaaataataaaaactatgggcccacatgctagttataaaaaggaataagttcactttaggtccctctatttgtcggtcagtttgattttcgtcccttgaccgcaaaaccgggtatgactcgtcccccaacttacgaaaaccgggcaaacaatgtccctcggcagtatggagggcggttttggccgacgtggcgcctacgtggctcctttgactaggtcttcgacccacgtggcactgacgtggcgattacgtggcattgacgtggcgctttcgtgacaattttatccgaaaaaatagtaaaaatcatgggacccatatgtcagctaaaaaaaataattaaaaaaggtgtggcctatttggtcccacctgtcagccttcctcctctctctcccctctatactacaagaaggcgagcggcggcagcacagagggggtgacgggtggtgggctgttgacggagcgacggcgggcggtgggcggagcggtggcgggtggcgcgtggagcagaggagcgctgcacagcaggcggagcagaggggcggcgggagcggcggcgagcggtgggcggagcggtggcgggtggcgggcggagcagagggacggcagacggcgggcggagtggtggcaggcgtgctcaccggccgaggtcgccgcctcactcgctcgttcgttctcgacatgaagtcgagggggatcgacgttgaggcagcggaagaggggcggagcaagcgtccgctgttagtggtcggcgaggacgggcggagtggtggcaggcgtgctcaccggccaaggtcgccgcctcgctcgctcgttcgttctcgacatgaactcgagagggatcgacgtcga

SEQ ID NO: 486 - DNA, 1501 bp, Oryza sativa
tgcccaaccatttggtgggggtcgccaagggtttgttattcttagtatagttgaatcaaaaggactccctgcctggcagatacttttgccctttgggtcttcagtttttggtcattggcgaaacagatgttgcattggtaattaaacaatgtgacatcttcctttgttttatgttcggtgtctcctttttcttctctcacccacttttttttcctactcaaaatataaagctaaacattgtgcaccatatatggctgtgttcagccgtctctcttctcaactcatttccctcatttttcacgcgcacgcttttcgaactactaaatggtgcgttttttttgtaaaaagtttctatacgaaagttgcttaaaaaaatcaaattaatccatttttttaaaaaaataacaaatacttaattaatcacctgctaatcgttgctccgttttccgtgcgggcacttagtgttgggaaccagggttccgaacacacccatagttgtaacaggtaaatatggagatttaaatgctgacttttatgtgcaaaataacttggtaataccacgtggcatttttaatggtgttcgagaactgttttaagccacacgagaatcttttaaagcttgttcagaatatgtgaaacatcaagaactaatttaacacgtaacaaaagtttaatgaccgaattagctattcaccgtaaaataatctgctcctgaagacctggaaataataagatgaatcacactgtccacgctattgccattgcatgaccacgttaaacaccgcttccagataaactaaaacacacaaatctgaccccccatgtgacacgatttctacgggcagaattattgtcccccccccccccccccaataaataaattccaaaaacaacttatccaaaaataaataaaatcccagtcaatggaagcttcctccattaaactcgtcgaattctccacacgcgtgaattcatttcaccaccattattaccgcacgacgcaatgccattcacagcagattaattcacacactcttcacgcggaaacacaaatcactacacaaaaccagccattcccaatcgatcaatatatgataaaataaatccatcaaaaatagcaacaaactactataaataaatactcccttccacacaacaaagagaggaaggaaagaaaaggaaggaaaggaaacggaaaccgatcaccctcccctcaaccaaccaaccacccacccaaccagccaggcggccggccgccaccgtcagcgagcagctgccgcggcggcgctcacgcgtctcctccccccctatttatatccggcctcgtcccatctccaccctttcctcaggcaggcgcacatctagcccctgcccccctcctttccccaccctaataataatatttttttccaatccccgaattccccccccaagaactccctcgatccaaaaggcaccgccgattttggtaatctagaaggttctagacgggcgaggagga

SEQ ID NO: 487 - DNA, 1501 bp, Oryza sativa
ggtcgtagtaggagttgaagttgtcgatgccgacgacgccgtcgccgcgcttgcggagcgcgagggagcagtgcgtgccgacgaacccggcggcgcccgtcacgagcaccgacatccccgcgcccgccgccgacccgggcggccgcctcggcgcggcggacgcgcggatctggcgctcccagtgcagcccgccccaggaggcggcgaagtacttggacgaggtgtcgacgaaggactggaagctgaggtacgacgcggtcatggcgacgaggaagagcgcccagaggaacatggtgctggtcgacgcgaagcagcggtggagctggcggttcatcgccgtcgccctctcgatcttcaccttccccggcgtcgacgggaacatgtcgtcctccagcacccgcatcctcctcgcccgtctagaaccttctagattaccaaaatcggcggtgccttttggatcgagggagttcttggggggggaattcggggattggaaaaaaatattattattagggtggggaaaggaggggggcaggggctagatgtgcgcctgcctgaggaaagggtggagatgggacgaggccggatataaatagggggggaggagacgcgtgagcgccgccgcggcagctgctcgctgacggtggcggccggccgcctggctggttgggtgggtggttggttggttgaggggagggtgatcggtttccgtttcctttccttccttttctttccttcctctctttgttgtgtggaagggagtatttatttatagtagtttgttgctatttttgatggatttattttatcatatattgatcgattgggaatggctggttttgtgtagtgatttgtgtttccgcgtgaagagtgtgtgaattaatctgctgtgaatggcattgcgtcgtgcggtaataatggtggtgaaatgaattcacgcgtgtggagaattcgacgagtttaatggaggaagcttccattgactgggattttatttatttttggataagttgtttttggaatttatttattgggggggggggggggggacaataattctgcccgtagaaatcgtgtcacatggggggtcagatttgtgtgttttagtttatctggaagcggtgtttaacgtggtcatgcaatggcaatagcgtggacagtgtgattcatcttattatttccaggtcttcaggagcagattattttacggtgaatagctaattcggtcattaaacttttgttacgtgttaaattagttcttgatgtttcacatattctgaacaagctttaaaagattctcgtgtggcttaaaacagttctcgaacaccattaaaaatgccacgtggtattaccaagttattttgcacataaaagtcagcatttaaatctccatatttacctgttacaactatgggtgtgttcggaaccctggttcccaacactaagtgcccgcacggaaaacggagcaacgattagcaggtgattaattaagtatttgtta

SEQ ID NO: 488 - DNA, 1501 bp, Oryza sativa
aaactaacaacagcatcgagttcgcgacccttgagaacgtgttttgctcatgatgtccttacctatcacccatcacagcctagcatccaccttcctactttttccctgttctctattcccttgcccctaggttcgtctcactgaagaagatgaacagtagtacgtggtactgtgccatcatggttgaatccaaccataagacaggaaacagagctaaacaaatctggctaaggctctgtttaatggttcaataatttttcgttcggttcacctttggttcggccacctctagacacaatttcttccggtttccagtacccaaacctctgcatcatgtccattcttgtatacaccataaacccctgctttacagtgatattttgttatttgaaaccatagaacttctagtgcatctttccacagttctggctccaaccttcaccatttattttaattcttatttatagtatttttcttataggcttatttggtcgtttcttcttgtgcgtacgttagatcgcgttgaagatcccactggactcgcaggaactgaagtggaccaagaaggctacgttgaagcttccgaaggacacgttccacaaggcaagccacagttccaatctttgatcatattgaaacctagtagagaaccacttagttattttatgcattgagtatttataaaattattttgcatatgaattattttttaataaacttgttagtttagttattacccattattacattgttattattagccaaatccatggattgttatatcacgtcctttgataacctaggtgtagatttatatacttcacgataatattctagtggataagaccaccaaatatatatactcatatacatggtttacccgtcgtcatgtggtggcgtgtcaggtgatataaaatatgttatttgatatgagtcactcacctggagtgatatggaagattaattccgggtgaagatggatgttgtggtgtgtgaggccgtgcatattgttataattattttgtggaaagtgtatatttacacttaaagtatgcacgggcctgtgctagttttggtggctttccccggatataaggactacccccttatgccatggaaaatgatgtaatttgcgcccatccacaggactgagtaatcagacttagcctagtacattgtcccactatatgaaagactgtagggtggctctatgagcaggtttggggtggacatgtggaaggggcttcggccaggttgacatgatccgcaatggtggaacccgtgaaagcaacgaccgtctagccttgcttaggcccaacaagtgcccgactgctaggatggatcaatatcccactaggcagtaactagtagtaagtgggactctcgaacggctatgttgtcctcagcttagctagctattgacatcaggtgggtaaagctgggcagtctctgcagagatgagtcttaaatcattcgaatgtgccatgcttccggttgagaa

SEQ ID NO: 489 - DNA, 1501 bp, Oryza sativa
cttggttaaaagcttgagtgtgtgtgatttttgagctgccactacctactagttaataggaacgcgcatatttttgtgtatgtttcttgtttgctactaaccatggcaggattgcgcacggggaaatgagatggtcatgctcaacgtcaacatcttcaccatcaacgagatatagcgacttcttcacgcatcacatatgaggtacctgataatgatcttgcaagggtagaatctaaattgccagtttttgatggtaagtatgattctgccgcttatgttaattgggagctagcagtagaaaaacaatttgatgagtatgatttttctaatgctcaaatgattaaggctgttagtaataagtgtatcggttctgcatctttttggtggcatactgtgggaaataagcttgaaacttgggatgaatgcaaaatactgatgagaaaaagatttgtgttttcatactatagacgtgctctctttgagaaatttgaacatataaaacaaggtgacaaaactgttagggagtactttcatgattttaaaatttgtatcacttatagtggtttacaagaatctaatgagaacacaatgactagatttttcagagggcttaattccaatattcaggttgggcttgttaatgtgacatataatcatataggccaattgttcatgcttgcttgcaatattgagcgcaaaattttggagaacccaatggagcaacaagctatgcttgtgcctcctatcgctgatattttgcaggaagttcagaacagtccccaaaatgagaagaacgatatgtttgagatgtcacttccatcactcgcgaatgaggagaaggctgatgcacctacattatctgaagagggcataaaaggtaaattaaatggtgcagaaattactcaagatgagtatgcttctgatgaattacatttttccacttgtcatgctagtgaagagcaactattagtggaaccaattgctgagatgcctttgtcacaagttgatttacttgctgttccttgtgatagagaagagttgtgtgataatgcttcacttatatccatgccacaactagtgaatgaacatgctatttctagtgttttattgtgtgctgattttaagcatgttgttcacattgctaatgatattgaggaacgtaaattgataacttctttcaatactttgggctatgttcagtttgatgatttttgtgagctcaataatttggaggagaatttatttgctaagtttgatttgccatgtccaactaatgttatttttcatatctttggcgaatataatgatagaggaatatatttggtgcatagcattttcatttgttcgcatttacagaaacatgtttttgctaatcacactacttcgagtttgtctagttttgattggatgaaacaggttattttgaatggactatatgaagagcaccatatggaaaaaacgacgacgattttccgtgaagaaggggaggatgatgtgacca

SEQ ID NO: 490 - DNA, 1501 bp, Oryza sativa
tccccccatttttccctctctctctcgcgttcaaacaggcggatttgcccccgcaaatctcgccggcgccattgatggcggccggacctcccggccggtttccttcctctcccggcaccctctcccccttccaaccctatttaaaccctacccgcacctccttcgcccatttccaccctttgccgcgccttctcctcgctggaatcgagctcgcgccgtcgccctctctctcctccgtcgccgacgacctccggccggccttctccgctcgccgggaccgtctccagccccggcgtcgcctcctccggcttcgccgcaccgccatcgaccccgtctaccccgtcgccgagcccgccgaccgccggaacgccgtcgaccccgtcgacccgagccgcgctccgccttcctccgctccggccgcctttttcgtcgtcgccgtcgacctagggtgagccgtggaccgccgcctcttttcccccttcccttcccctctctcggccgctgctccgctgtgcctatggccgccgccagcgaccataggggcgcgggcgctgcctcccgccgaccgtgccggcgtggccgccttcgagcgcaccgagtggccgccgcgtggggcccggccgtcagccgcccacgtccttaggtgcggctgacgcttggggcccacggcgccgaccggtgctagccgggtgcgcccggtccaccgtggaccgtgaggatgccgcgtgggccccaccccccgtggacccggtccgcgcgccctctcccctcggctgacgcaataaaccccttcttaaattaaaatttaaatgaagaaattcgcaaatattcacttaaagagcatataaacttcaaatggccataacttggccatttgaactcggaattgaaccgttcaagtctctaatttttccttaagaagtcaagaacccatttttatgttttgttcctgctttttccattccgttggtcgtgtagacgctgcagcttcagaagatccgctcttcgtggaggttgaagccgacgtttgggaaagcgagcaaggcaagtcacatcatccttgagcatattaaatcccagtttataaaattattttgatttaaattattgtattatcgctttatttaaattcccgcgttatcactgttttatttagccatgcctatttatctttgttacgaccttattattattgctattgttattattaccttgttcaccctaggataaacaaaaccccaactagtgggtactctattcatggttccactagtatgaatttaggtagatgcttcgctgattaattatgcaacattaggtggttttataactttagactttgggaattctcatatcatttggacagtatggaatggctggcttatgttggaattggacacacacctccccctcttttcaaaaccaccaaaacggttttaggctgggctcaaggtgcgtggttgggttttgttagtcgtacctcgggtactatcaggattaa

SEQ ID NO: 491 - DNA, 1370 bp, Oryza sativa
aaacaaagtccatagaaatatctgtccaaggaatagaaggtacaggaagaggcatatacaaaccatgtggattcaaacgagacttagctttctgacaagaggtgcaacgtgccacgaacctctcaacatcttttctcatccttggccaaaagaaatgcatggccaaaacatctaccgtcttcttagctccaaaatgtcccatcaaccctcctccatgcgcttcctgtatcaacaaaagacgaagggaaccaactggaatgcatagacggttagctctataaacaaatccaccattgataacaaatttgttccaagtacgtccctctttgcaatttaacatcacttcattaaaatcaggatcaagcgcatattgttctttaattgattcaagtctaaaaatccgacaatcaagttgggacaagaaagtatagcgcctagacaaagcatttgcaatcacattatctttccctttcttgtgtttgataacataaggaaaagattcaataaattcaacccatttagcatgtctacgattcaaattattttgagagcgaaaatatttaagcgattcgtgatcggagtgaatacaaaattctttaggccacaaataatgacgccacgtctctaaagaacgtacaagagcatacaattccttatcatacgtggaataattcaaaacaggaccatgcaacttctcgctaaagtatgcaacaggcttaccatcttgcatcaacacacctccaatgccaactccactagcatcatgtcacgtcccaaaacgaccctaaaatatatcccttaaaattatacctagaataattaaaatccttgtgaaagcctccaaaaattaaaatgtgcaaactaaaagtcaaataaggcttggaggatttttgtataattcctaaaagcctaaaatgtgtaaataaattttagtggaattttcagagtacaaataataattaagaagaaataaacaaagttaaaaaggttttataaaaagaaaaaccctaaaaacccctctcccctctaatgggccggctcggcccatctccctccccctctctctcctctcccccgcggcccattcggcccctccccccgcgcgcgtcgctgacaggcgggcccgcccgccaccctcgctgacgggtggggcccacccgtcatccccttcctcccgccgctcccgccgcctcccccgcgccctatcgccgccgccgccgcgaatcccgccgcctcccgccgtccccgcgtgcaataaagtgggggaaaatattccccatgatcccctctccctttccccccatttttccctctctctctcgcgttcaaacaggcggatttgcccccgcaaatctcgccggcgccattga

SEQ ID NO: 492 - DNA, 1501 bp, Oryza sativa
tatatttttaattgaaggagtataacaaatggacagtgaaaggtatacgtgaaggaaagcaataagccaataaataaaaaaattgtacatcgtaagtttaggatcgaataagaccaaaaaaaacctaccagatttgggggggggggttgaatggtaggataaaccaaaaacctaaaatcttttgcggaataaaagatttacctcgaatggagtagatgacgaagctcgtcgccaccggtcaaaacacccacctgccgccggtcaaaccaccgaaaccttgccggtcagaccgcccaaacacctgcggtcagactgctacactcccacctgtcaaaccgcgcgcacactgcagctagaccgtcgggacctagaaaacaccggtagataataaactcaaagatgtacattgaaacttttaactttgttgcatcaactagtatttacaaagtgcatcaacagcagccctcacaaaatctcgaactaaactcgaaaccctaacttttctctcaactcaagtctctctaaaaccgataccaggaggccacaccctccccctctatttatacatgaggtaggctgtgcaaagcccacgaatctaacacaacttagaactcctaaccatgtaggaaacactctcttgcaagtatccaacttattcctttccttatctctattaatcttcccgaattcggatcctaaatttgactcctctttccatacgtacacaatccctcttgtatatgttggtatttaatacggttacagataaaatccacaagcgcacggatataccgatgtagcacttcccctacgaagtattccaagggtatcgaatcctagggaacgtgtgtggtcagatcttcctccggtttatccaaggacaccaagcaaatgataggccaagatagagaggatttactagtgagaaacagtgtctagggaaagcttaactttaatcctaacacaatatttcaggcactggcaacccgctgttcccagatgtcgttctactacgtacccggattgggaggatttaagtgatctcgagggctgtcaccacctctacacctacttcaaacgtactgtgggatacgcagcaattactggataataattacctaaacaccacgtctaagcagttagaatctactttagtgtttataactaaccaaagcaatcactatattttagttgattatagtgaacaataatcccgtatgctatttaggaactaaccaagagataattctcacaagataatattatattgaattcagagtaataaacagaggagaagattaccgataactccggaattcttccgacttcttctactatactctcttcctattctagtatacaatatagtacaatagagcctcttataattcagctcaatcttggaagtgtgtgtgagagtgaatgaagtgaggtccttttatagggcagttatgacggttgtgagaaggggaaatgtccgaactgccccgcaactgtgagt

SEQ ID NO: 493 - DNA, 1501 bp, Oryza sativa
aaaagaagagaggaaagctattaaagccatacccgaaatctcctgaaaactcgaggactatgaagacaattctatttcctactccactatctgtagaactactaaacaatacttgagagagctcttgatcttcttcttgaggtgtgtgagggaatgaatgagaggaggggtatttataggtggagaggtgccttgggagtgtggagatgctccaagcatcctaggagcatttttgctctcctcttgacatgtggcatggtgaagcatccaaagagcatctttctccctccttgtgaaaagtgtccacggcggttgcttcaggtagaaacggtcataaccgccattggatgtcgataactatcggcctgtggaatttctgggccatggttcggcagaacctaggggttcggccgaaccctagtctggtccatctggcccagaacttggcaagtgtactcctcgtttattcctcagcctagtgatgtgaattatgggcttgtttactcatgttaattctgtattatcagcccatctatccacaaggctacttctcgacagcgtctgattgatcattcttctattttctgtcgattctcctccatttatatgtgcttctcctgcatacatgttagtagcatagtatatagtggaagtagatattttatttggaatttatgcattgcaagaatagctagtcttcacacattgggtaatattgatggtcgaaactggtcgataacggccgtcaacaggctccttcactaaatgagtcatagatggctacttgggctagacttgtttagcttgtgagcagctcgcgagctagctcgagctggctcattatagctaacgagctaaaaccttaggttggctcggtagcaaattcaaacgagccgagccgagccaagccagacaagagccacgagcttttcgtccagccctactcctttttagccaagtcgggcagtcccctctcgtgcctaggtaaatccggaaacaacagagaccaaagccaggtccgaacggcaccatcgcatctatcactgccgtagtatgttagctaagttaagttatactctagatttagcctggagcccatgctagcctgtggtaagtatgattatatctttcagggattctcgagaaccggtccttaattgtcatgggcaagactagcaaaaccatgcacccacaacccaccttctaagcatatttagtttaattaaacaataaccatggtggtacatcatcatataattaaggactaaattattatgaatcccattgtgaactaattgatctaagcatggttaagcattcctaaaccaatcatctaatcaattatatcccaagttatcaatggcatgagatatcaacaggctgagtacgatagacatccatcccacatgacgttcaaaaatactgctatttaatagaaagcaggggattttataaaataggttcaacatgatcagtgctgtatgtatgacttgccttgctc

SEQ ID NO: 494 - DNA, 1501 bp, Oryza sativa
ccattagtggaaccaattgctgagatgcctttatcacaagttgatttacttgctgttccttgtgataaagaagagttgtgtgataatgcttcacttatatccatgccacaactggtgaaagaagatgctatttctattgtttctttgtgtgttgattttaagcatgttgttcacattgctaatgaaatagaggaatgtgaattgctatcttctttaaatactttgggtatgttcggtttgatgatttttgtgagcttgaaaatttgaaggagaaattatttgctaaatctaatttgccatgtccaactaatgctatttttcatatctttggtgaatataatgatgttggaatatatttggtgcatagagtttacatatgttcggatttagaaacctcttgtacatgtggataaaacatacaagctagagaggaatgttaatgctaaccaaattatctcgagtttgccttgttttgattggaagaaacaggttgttttaaatggactacgtgaagagcaccacatggaaaaaccgaggacgtttttccatgaagaaggggaggataatgtgaccatggctactatggatacaaccattgctcacatcatggatctacaagaagacatcaagatcaagttctctaaaagctggaattcgattcggccacctgctacattgctgacttcaaatggccgccaaatatgcatacgagctccgttttgggtccacgagtacttaataaaaagctctcggagttgtctttaaaacggatccaacctcattgcgaaattccatcttagtgagccgcaattgaagaaacaaggtgttgcatcacttgtaataggcctatgggcttgtaacttcgtctgggaccccggcccaagtggggcccatgtggagtgcaccccaacctggtggagaacgaccctacggcaccgttggtcatcttcccacacctataaatagctaggtacccttcagggtttcttgggttttgtttagatgaaagtttagccattgctacttccttacagcgtgcgtgtcagctagaccgtccgtctgcttgtattcaaaaccccaacttatcgtgtgtattcattcctatttgcaatatcatattgcttttatcttgttcttacttgtttcttcgatttgcttgtaggaatagggttgatctgcaccggcaagatcaacaaccctctgagaggtgtatctgtaatgccccgagtttcaaaatagtatatttcggggaatattagcacaaacgtgcaaaagtttaatttttaaaccattgttcgaataggcgatcaggaaccgtggatgcgtagaactcgctgagtagtgaaaaatagactatgagtttataataatcggagtccgaacgaagtttatcccaatatttttcccgtagaatttccagggatgccacctgagcgtgatgtagagttctgtattgatcttgttcctggtacacgaccgatctctagagccccgtaccggt

SEQ ID NO: 495 - DNA, 1501 bp, Oryza sativa
aaggaagtagcaatggctaaactttcatctaaacaaaacccaagaaaccctgaagggtacctagctatttataggtgtgggaagatgaccaacggtgccgtagggtcgttctccaccaggttggggtgcactccacatgggccccacttgggccggggtcccagacgaagttacaagcccataggcctattacaagtgatgcaacaccttgtttcttcaattgcggctcactaagatggaatttcgcaatgaggttggatccgttttaaagacaactccgagagctttttattaagtactcgtggacccaaaacggagctcgtatgcatatttggcggccatttgaagtcagcaatgtagcaggtggccgaatcgaattccagcttttagagaacttgatcttgatgtcttcttgtagatccatgatgtgagcaatggttgtatccatagtagccatggtcacattatcctccccttcttcatggaaaaacgtcctcggtttttccatgtggtgctcttcacgtagtccatttaaaacaacctgtttcttccaatcaaaacaaggcaaactcgagataatttggttagcattaacattcctctctagcttgtatgttttatccacatgtacaagaggtttctaaatccgaacatatgtaaactctatgcaccaaatatattccaacatcattatattcaccaaagatatgaaaaatagcattagttggacatggcaaattagatttagcaaataatttctccttcaaattttcaagctcacaaaaatcatcaaaccgaacatacccaaagtatttaaagaagatagcaattcacattcctctatttcattagcaatgtgaacaacatgcttaaaatcaacacacaaagaaacaatagaaatagcatcttctttcaccagttgtggcatggatataagtgaagcattatcacacaactcttctttatcacaaggaacagcaagtaaatcaacttgtgataaaggcatctcagcaattggttccactaatggttgctcttctctagtatgaaaagtggacatgttcaattaattaacggcacagtcaccttgattaattgcagcaccattaagtttaccttttatgccacttcagataatgtaggtgcatcagtcttctcttctgtcttcgtgagcgatggagatggcatctcgatcatattgctcttctcctcatggtgaatgttctgagctccctgcaaaatgtcagtaataggaggcacaagcatagcttgtttctcccttgggttctttaaaatattgctctcaacactgcaagcaagcatgaacaagtggcctatatgattatatgtcacattaataagcctagcttgaatatcggaattaagccctctaaaaaatctagtcattgtgttctcattgctttcttttaaaccactaaaagtgatacaaattttaaagttatgaaagtactcctgcacggttttgtcaccttgttttaga

SEQ ID NO: 496 - DNA, 1501 bp, Oryza sativa
ggcagagatgtcaaagccgatgaagtagaggtgctgatgatgatgtcaatgataataatccatcaaactgttgagaagatatcgaagctcgagtaatttccttgatgcgagcgtgtgcataacgaagactgatgcaacgatccttgatttataaagatgtcagtagaacttggtgttatagttgttgcacatgctctacttggaggaaagtagatgttgttgtccaactcgtcgaaactgagctgattggttaataactctgaactcccggacatgtaaattatatctcaaacttgatatttgagaaatttgaagtagatcgtggcgatgacggagaagccaaaattgccggtgaaataattggagttgatgaagtaaaaagcttgctcttaagcgaagatgaagataatgactcattggctggttaattgattccttcatgttgacataatatctgtcgaattttgagtcttgtatttatgtagcccccgactctttggttagttgagaaacaactgaacatagagtcgggacaccatgggcggcggcaaaggcaaactggtaatgacgatgactccagtcaatgttgacgaagacacgtagctgtggaggcgaataagccagtcggcgtctgacaaggcggccagcaatgaagacgatgacgtctatcagtagtggtagcagtataaaccagccgtagaggcgacggcactagtcaggagcagacgagatgaccagcggtgaagacgataaggccaatcaacactggcagaatcatgcagccatggaagtgaagatgatagcgccagctggcgtcatacgcgttgaagatgctgatgcctattagcggtggcggcgacatggccagccgtgaagacgatagcgccagctggcatcatacgaggtggccggtcggtgaagatgtaggcatccaacaacggcgtcataataggccagcggtgcaggcggagataccagtcgtcgacagcgaaggcagctggcggtgacgacatagacgcccaataacgacggcataataggccagccgtgtaggcgaagacaccagtcggcggcggcgaaggcaagccggtcggtgaagacgaagacgcccaacaacggcggcataataggccagccgtgtaggcggagacaccagtcggcggcggcgaaggcaagccggtcgatgaagacgaagacgcccaacaacggcggcagaataggccagccgtgtaggcggagacaccagtcggcggcagcgaaggcaagccggtcgtgaagacgtagatgcccaacaacggcggcataataggccagccgtgtaggtgaagacacgagtcatcggcggcaaagacaagccggtggtgaagacgtagacgctcaacaacgacggcataatacgctagccgtgcaggcggagacaccagtcgtcggcggggaaggcaagccggtggttgagatgaagacgcccatcaacggcggcataataagccagccgtgcagg

SEQ ID NO: 497 - DNA, 1501 bp, Oryza sativa
gattaatcggctcccagagcctttttcattttctcggactcccagagtccagctgcctagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaatacaccgacaccacatgtcgggttttgaaggcttcacaaacccatttcccaagttttcgacaaacaatggtgtatgtgggatatttggtatacgtgctcagagaacacgaataccgaggtaccacaagggtggagcgacaaggaatcagggtagtatgacctacggaaattagtgcgactactgggtaggtccgtcggttttggcacgcaaaccgaggccaagcaagttaagtgtgtgattctaataatgcaagttgcaaacaaaataataatgaattttcaattataggggcaattgatcaaagggtgacttgccttgctcaaggtcttcacgaagcttcacgaatcttcgaggaaacccgcgatcgacgaaaatccgataaccgcaactatacgcaaacaatcgaaaacctaaacaaaggaccaaaagaaagatcctatttagactaattagtagtgccaataaatagatctcaattttacggaattactggaagtggaacggagtcaatcggagttgcgaattaggtgatatgaattttggaagtttaattggagtttctggaataggagaaatggtttatggaatttatagaaataatattctcaagaatattattgacagtcactgacgcgcgggaccaaaggaaatgatttgtggaattttgggaataaggaattgatttatgggacaaaggaaggaaaaaaaaaggatttattaatcctttggataagaaatggaaggaggga

SEQ ID NO: 498 - DNA, 1501 bp, Oryza sativa
ctgtgccgtcggacacccttcccggcgatctcccgacgtggtagcctccgttctccctccccactcttccttccccctagcttgcgcgattgctagcctagaccttcccaaatgcgcgaggacgctgcctcgagccccgccgccgcccggcatggcctcgccgccaatgccgtccgctcccggaggccgccgctcgtcgccagctgtcctcggtgctcctctgtcccatccggcgccgaaaacggattccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatcttggccgccccttcttcctcctcccgccggcccgcgtggctgccacgtaggcgccacgtcggcgccacctcggctttgaccgagccgagccggtcagccgcctccttcctccccccctctcgcgcgcggtccacggtgcaccaaccggctgcgcgtgggcccgccgcatccctggtccatccagtgcacgcccgtgaaccgcgctcacccgaaaccctagcgctgccctcatgcgccgctcccacggagagccgcgccactgacaagcgggccccacccgggaccccgcaaggtggatacggtccacccggacccatccccctctctcctcccgcgcgccccgcccgcttgggccgcgccttgcccggccatgggccgcctccccgcgcccgcgcccggcccattggctcggccgcgccgtgcttatcccttgggccgtacccgagccgcccaaagaagtctaaatcccatccctccttccatttcttatccaaaggattaataaatcctttttttttccttcctttgtcccataaatcaattccttattcccaaaattccacaaatcatttcctttggtcccgcgcgtcagtgactgtcaataatattcttgagaatattatttctataaattccataaaccatttctcctattccagaaactccaattaaacttccaaaattcatatcacctaattcgcaactccgattgactccgttccacttccagtaattccgtaaaattgagatctatttattggcactactaattagtctaaataggatctttcttttggtcctttgtttaggttttcgattgtttgcgtatagttgcggttatcggattttcgtcgatcgcgggtttcctcgaagattcgtgaagcttcgtgaagaccttgagcaaggcaagtcaccctttgatcaattgcccctataattgaaaattcattattattttgtttgcaacttgcattattagaatcacacacttaacttgcttggcctcggtttgcgt

SEQ ID NO: 499 - DNA, 1501 bp, Oryza sativa
caatgattcatcggcccaacattccaacaaaatcatcgatataattcgctcatcgtcgtgttacattaacagtgaacaaattgaatcgtacacgcagcatgcgtacgaattaaacagcaacatcaacatcaattccagttaattattaatcatatcgctgagattaataatcttatctagtttcatattataagacgactgactaagtcaaactgtttcaaatttaatcaaatttataaaaaacatagtcatatttttttacctaagataaatttattataaaaatatatttaattattaatttaataaaactaattttgtaacataaatattactatatttatatataaatttaattaaatttaaagcaatttaaaagtcaaagcatcttacgaattgaaatagagggattacttaattagtataaaattggcgatgattaaccttgttctgtggaggcgagcatggcaagaaccttcttgaaccagccgacctggacggcgagggagtagggcgtgatgccggcgacgctgaggtgcttcttcttgaacagcagctggttcagcgccgtcccgctcgccaccgcgaagttggcgccgtaccggaagtcctccctgctcttcccggccaagtacggcgtccagtacgggaaccccagcctctccactgcatcaatccatcacatcgtcgtcatcgtcatcgtctccggcggcggcggcggcgctaggtagagatagctaagctaagctcatgggtggtttgcgttaccgatgaagtcgacgatgaggcggccgtcggaccagcggccggtggggcggcggaagaaggtctcgccgtagggggagcgggcgacggggcccggcgaggtggagtagtggatgaagttgccggtgtcgatcagcgagttgccgaaggtgaacaggtggctgtagcacccgccgctcggcgccgtcgccgtcgtcgtcgtgacgttcgccgccgacgccgtggctgcgcacaaggctaaggcggcgacaagtatagccgccactgcgggagcagacaaccgcgccggcctcgtcgccatggttggagcttggatatgcaaaatggcttctccagtggcgcctctcctttctcgatttgagcctatatatagagagattattatgactcggctcactgcaaaaaaatgcttacgccaaattaattaccaaaatgtttcggttagaatgtggctttcatcgggaagaagacaattttttaaaaaaaatattacaaaatttcgaaattagcttttcgatcgagctggattcattggttatgatattttttaagattgcggttgactttctactgcgtttaaaattttccatttgttttgcaccgtatttcgtcaactcatgcacagtgatcaccctttaaagtaatgctaagaaggatttggcagttggggggtcagcataaacaagaatctcagacggattaaaaatataaaatttgtactataagttgtaattga

SEQ ID NO: 500 - DNA, 1501 bp, Oryza sativa
tttagatgtccaaatattcgttacaaaattcaaaacaaattttaacaaaatctcaaatctacatttcaaacgacatcggatggagatcaacttggcaatctgtatcattatcatcgtattactgagagcaagaacagtagtgtcaaagaactctgttccggtaagctaagaactaaacatgacttgcacagttgcacttggcaaaaatgtggtttaggatatgtcaaacatttttttttggtaatatacatggactaattaaaatgaacttccactcaatagtttgtttgcaagcaacaagactgtctggtagggagttttctgcacgacaacacaacccaatggaaacgttggttagagttgtggatggtatgcagtttcttggcctcttgggcattggaaagtaaattttattgtaccaaatctctgtataaataatgagaaactctgaatattaaacatttcattcatgtggttactgaatcgacaccgccacaccggcttcatcaagcggttgagattattagctgttgccaaggggatgatcagtttcagtttcagttaagtcggtgcggtacaaacagctaagcacgtataatgattgaaatgtatcttagcccaattcatctggagtagatactttagaggatgcatgttcttgacttcttggtgaggaaacctcatttcggctgaagaaaacctagttggcacttggcattgtcagagctgacttttgttcttctcttctgcattttgcctggagttcatggctaatcagcaatgacacggtttgtaatcacaagttaatgtcttccccggtcgctgttgttcacaaggtgagagacctttcctgaaaccagcagagggagctttgccgctgtctgaagcaaaaatgttaagcaagaaatttaatactgttcaatttgattaaactcaccgctctgcataaatcacggagtacatgcattatattaggcaatcaccattttgtaaacaaatcatgcatcctgccggtggccatgttgaatgacgcgttgctctccctactctacggatgtgattattgccagcgaatctccaactctgaaactctcaagttcagtttatcagagggttcgcccactgaaactctgaatttccggagacacacatgcagacttatccaagcaacattcgctacaaacacctcaaattgaactcccatatataatttcatcagtccaataatatgttaacgcgttgttaattaaaccccggacagattgcataatcactggaaaagcaaaagtcgcaagtcaacctctgaattattggctcccatgttaccgttcatgctggcttagcttaagctaatcctacattaccacgcatccaaccaacgaactaaccatacaaaatcttctaaccaccgtacgttctcctcgcactataaatacacaagcttcccaagcaactgaagcaaaaaagcacacacaacttcagttcagtactcgtagctgct

SEQ ID NO: 501 - DNA, 1501 bp, Oryza sativa
aaatataataatcgtatacaataaatttatacactctattaatatacttcataaatttatattttcttgataccaaagggtaaaatggactttatgatatgaatttaacggtcaactaatggtcaactaacggaaggggtatagaagggatctaaattgaaattttggggtatggaagggaatgagcaaatcttaggggtatagaagggattggatgaatttttaggggtacagagagaattttctcaaacatttaagcttaacacaggctaaacatagactcttagtatttatagaagaaatttttactatagggtagggaacatgagaaaatagaaaaactataaactatactcttataatatttgagaaattgagtatagtttataatcttaagtgacgtgtattgcctactagtatataccaggctccagccgtgaacatgcccttatatatgacataagaacatgtctaagtaaagtttagttagtcgtattagtaaaactagcggaggttggccgtgtaattttataaccgattaaatttgttgtgggatcaatggagaccatataaaaagagtgaattttaggaaatctcacgttttataatcgaagttgcataagatcctaaatattatcgcaggtgacacataatctagataattattgttctaaattaagttcactggctcggcttgaggcatgcatgtaaagcgtcgtgattagtactaggacatgtttagaggagcttctaactgctgcagcttctctcagaattagaagctcccgaaacagtctagcttttggtttagattctaagaagctgtagttgtagaatccagctaatgaactacaagacagaagctggaaaacccagctttgattcttagaagctggctaccaactagctgcttctcagaattttaagctccccaaacaggcccctggttggtgaaccgacactgcttccttatctcgccggcggcggtcttgacggtgacgctgcccatcttcaccatcgcctatgcgaacttggcgttccaccaccccgggaagtaggcgctggcgtggacgagtcccatcaaaaccaatgccaaactgccaattcaacggccgcaagaacataaatctgggtgataaatttgattcagaaacaataaacaacccatccatggaacatacgctgcaagacgaaaaacctctgaaattaaaccaaccagaccgtcgacttgttcagtgcagctgcagctttaccggcaaaaattaatcaaagaaacctccatgtcaactggtctagctagctgctcgattcccatgttcccctgcttgacttagggtgcatttgtcaccgcgacgtgctcaccaaattgtttgttctctgcttcggctggggactgactataaatggagatgcagaagcagctgcatttcaccacaaagttcagagtcttgagagtttcagaacactgtaacctgcttcagagttcagtgcagagaatcag

SEQ ID NO: 502 - DNA, 1083 bp, Oryza sativa
agataaaacaaaaaaataatattgtttttgccattaaaaacttcatattttgttagagtagtacgaaattttttataagataaatctttttatgcgagataaaaattatttttgttaaataatatctcacaaaataaactcataaatataataatcgtatacaataaatttatacactctattaatatacttcataaatttatattttcttgataccaaagggtaaaatggactttatgatatgaatttaacggtcaactaatggtcaactaacggaaggggtatagaagggatctaaattgaaattttggggtatggaagggaatgagcaaatcttaggggtatagaagggattggatgaatttttaggggtacagagagaattttctcaaacatttaagcttaacacaggctaaacatagactcttagtatttatagaagaaatttttactatagggtagggaacatgagaaaatagaaaaactataaactatactcttataatatttgagaaattgagtatagtttataatcttaagtgacgtgtattgcctactagtatataccaggctccagccgtgaacatgcccttatatatgacataagaacatgtctaagtaaagtttagttagtcgtattagtaaaactagcggaggttggccgtgtaattttataaccgattaaatttgttgtgggatcaatggagaccatataaaaagagtgaattttaggaaatctcacgttttataatcgaagttgcataagatcctaaatattatcgcaggtgacacataatctagataattattgttctaaattaagttcactggctcggcttgaggcatgcatgtaaagcgtcgtgattagtactaggacatgtttagaggagcttctaactgctgcagcttctctcagaattagaagctcccgaaacagtctagcttttggtttagattctaagaagctgtagttgtagaatccagctaatgaactacaagacagaagctggaaaacccagctttgattcttagaagctggctaccaactagctgcttctcagaattttaagctccccaaacagg

SEQ ID NO: 503 - DNA, 1501 bp, Oryza sativa
atgcgccgcccctttgtaccgctgacgtgcggggcccgcgtgtcggcgccggcctcccctttgatgacgtcagcacggccttttcctttgtaaaaataaataataattgcgcaataaatcgagtttaattctagaaattcattaaaatggctcaaaacttctaaaatccatatctaattcattcgaactccgaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcaactgaatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaactgttttactgttttgctcaataaaatgttttacaaccgcctttatgcaaatagccacaaacccctccttgtatccccttgcacgttcgcatcgttggtgtggcttgctgagtacggtggttgtactcagtcttgctattattcccccttttcagaagtgtagtgcttctgagctgaa

SEQ ID NO: 504 - DNA, 1501 bp, Oryza sativa
ctttggccgacaggtgggacccgcggccccacctgtcagctcctcctccttcctctggctggccggctgcaaccaccatggccgcccgagccgccccacgacgccgcagtttccgcccacctcctccaccccacgcgcgcgcgctcgtccgtgggacctcgccgcccacgaccccgctctcctcccccactttccccctccataaccggcgccgaaccaccccactcgcccacgtcgccggcgcctcttcccccttcaaatccgcctctcccggccacgttctccccctccgggacctatataaacgactcacgtgcctcccttcatccgttttcccctctccccgagcaccccgcgctccctagacacctccccaccgtgctcccgtgcaccaccgctttccggcgagctccggccggccgattccgccgctccacccaccgccgcgccaatccgccaccactgtcggcttcgcggcgccgtgccgcagcccggcctctaccccatttcccctctccgcctctggaacaccgccgcctcgtgcaccacctctctcccccaccgccgccgtcttcagccggccgctgctgccgcgttagtcgtcgccgcacctcgtcgtttgcgtcggcggcaacgctgtgccaagctctacctcggcctctgctccgtttccccatttcatcgccgcaaccacctttccgccgtcgacccgagctccgctaccgccgttgtcgtctcaaaccaccgctcctcaccgctccggtcgcctatttctctccctaaccgctccaatattttccttaggtcttgccggccctcggccgcggctccaccgtggtcgggcgtcgtcggaacgccgttcccgtcgcctcccgtgccggtcgccgccatcttttccgccgccggccatctccccgtggtcgtctcgccgtcgccgtcctcggtgagaatccccaccgccccctctcctttttccccatccgccgctccccatgcccgccaccgcgacgcgctgccgtcgccggtggtcgtctggccgcgtgcgcgtagccgccgtgccatggccggccgggtcagtctcggccgcgcccgtgccccagccgcgccgcctcgtggccgtccgatcggctcgggccgatctgggccgtccacgtggtggacgcgcacccgaggccacgtgtggacttggtccaccatgcgccgcccctttgtaccgctgacgtgcggggcccgcgtgtcggcgccggcctcccctttgatgacgtcagcacggccttttcctttgtaaaaataaataataattgcgcaataaatcgagtttaattctagaaattcattaaaatggctcaaaacttctaaaatccatatctaattcattcgaactccgaattgagccgttcaacttgcaaaattcatctaaaattgagctctacatgtttgtttactttttatgtactgtttccttggtttttattagagtttttcctcgttttgcgtgcca

SEQ ID NO: 505 - DNA, 1501 bp, Oryza sativa
agtgatgtgagctctctgaattctgatagactcctggaatggaggattggtcaggagcaaggtgaaaagcacacgaatgatgtgagctctctgaatctgatagaggctttccattgattttgttggtcatcatcaatcatatagttttcatattattgattaaataatctggagttatgagctaatggctccttttttctttccatagatgaattgttgtgcaagattgagccttaattagcagaagtccggtaatgtaacaatgttggttttctttcgaacttcgaagtataccaaacctcttgtccttgacaatgaagttttatgggagcatgctgaaatgtatttagatgtcgccttagtggtatactggcagtttgtacgtgatatctctactattttaaaaacgaagccgttcttcttccttccgttccctccctcccgctgcacgtaggaggtcgtccgttccttcgcgtgcgcgcaaccacctaggatctagtctcattaacattgtggtttttgcccctcttttattcagcatatactgggatcactgcctattatcccaaaaaaatagaggggctaacattttcgttgttcagctactccctccgtctaaaaaaaatccaacctaagtggggatggaatatcagattcgttgttctaggtggtatttcatccccatctagattggtttttttggaccaagggagaatattgttgagaagaactcgtacggataatgtccaacgccaagatttgttgtatcagtgatggtagtcactactcactagtcagtctgcctaattcaggtgcggcatgattcgacatctatccaaaaaagcaccctattttctcttgccaagtttttcctggtctgtggcatataaagaaaccgtagcacgactatacttcaacatttgcattgcagcaaataactcttacacgtaatcacataattaaatagtaatattttatctttagtttcttctctaagaaaaaaaacttaaagtttctgttcaggaaaaaaaggactatctatatatctgtagtcaaatataaatacagtataattgtagtttttttaacaaaaaaattgacaaatgtataccaaaatcggggaaagaaatatttgagtagagtagcagaagcagatgactgacggttgggctctggttcagacaaaactcggcccaattactcaaataccaaataagcccaattcctccgtaaaaaagttcagcccaaaatccctgaaggcccaccaaaaccactcaagcccttgcctactcgggttccaactcatcggcccaacaaaacgacgcgccggcctggccaagccaagccaagccagcctctccgtctcgactcgatctctctctctctctccggcgcaaatcctcctcgccgcggcggagcactaaaccctagcgagagatgccgtcgcctgcggggggtccggtggccgtggcggcggcgtctgcggcggcggcggaggcgc

SEQ ID NO: 506 - DNA, 1501 bp, Oryza sativa
ttccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatgg

SEQ ID NO: 507 - DNA, 1501 bp, Oryza sativa
catctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttca

SEQ ID NO: 508 - DNA, 1501 bp, Oryza sativa
agtgatgtgagctctctgaattctgatagactcctggaatggaggattggtcaggagcaaggtgaaaagcacacgaatgatgtgagctctctgaatctgatagaggctttccattgattttgttggtcatcatcaatcatatagttttcatattattgattaaataatctggagttatgagctaatggctccttttttctttccatagatgaattgttgtgcaagattgagccttaattagcagaagtccggtaatgtaacaatgttggttttctttcgaacttcgaagtataccaaacctcttgtccttgacaatgaagttttatgggagcatgctgaaatgtatttagatgtcgccttagtggtatactggcagtttgtacgtgatatctctactattttaaaaacgaagccgttcttcttccttccgttccctccctcccgctgcacgtaggaggtcgtccgttccttcgcgtgcgcgcaaccacctaggatctagtctcattaacattgtggtttttgcccctcttttattcagcatatactgggatcactgcctattatcccaaaaaaatagaggggctaacattttcgttgttcagctactccctccgtctaaaaaaaatccaacctaagtggggatggaatatcagattcgttgttctaggtggtatttcatccccatctagattggtttttttggaccaagggagaatattgttgagaagaactcgtacggataatgtccaacgccaagatttgttgtatcagtgatggtagtcactactcactagtcagtctgcctaattcaggtgcggcatgattcgacatctatccaaaaaagcaccctattttctcttgccaagtttttcctggtctgtggcatataaagaaaccgtagcacgactatacttcaacatttgcattgcagcaaataactcttacacgtaatcacataattaaatagtaatattttatctttagtttcttctctaagaaaaaaaacttaaagtttctgttcaggaaaaaaaggactatctatatatctgtagtcaaatataaatacagtataattgtagtttttttaacaaaaaaattgacaaatgtataccaaaatcggggaaagaaatatttgagtagagtagcagaagcagatgactgacggttgggctctggttcagacaaaactcggcccaattactcaaataccaaataagcccaattcctccgtaaaaaagttcagcccaaaatccttgaaggcccaccaaaaccactcaagcccttgcctactcgggttccaactcatcggcccaacaaaacgacgcgccggcctggccaagccaagccaagccagcctctccgtctcgactcgatctctctctctctctccggcgcaaatcctcctcgccgcggcggagcactaaaccctagcgagagatgccgtcgcctgcggggggtccggtggccgtggcggcggcgtctgcggcggcggcggaggcgc

SEQ ID NO: 509 - DNA, 1251 bp, Oryza sativa
gctctagtctccgaccttgtcggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccaga

SEQ ID NO: 510 - DNA, 1501 bp, Oryza sativa; identical to SEQ ID NO: 506

SEQ ID NO: 511 - DNA, 1501 bp, Oryza sativa; identical to SEQ ID NO: 507

SEQ ID NO: 512 - DNA, 1501 bp, Oryza sativa
atcatccatcgcaaatagaaccacccgactagatctaaacctaggtgatccaatagacaacactaacaatggtatcagagcaatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgatggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccaactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtattttttcatgcaaattacaatagaattttgaattgtcttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctact

SEQ ID NO: 513 - DNA, 1501 bp, Oryza sativa
tcttgggcggcggcggcggcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcctgaagaactcgttggcgaactcccacctgtcagctactatcttcctgaaaccctgcaattaacatcatcataagttcataacaccaattaattaatgcccaaagttaaacatacatacttagtattagctattagggaaaggattatgaacactcgagaggatatctcctaatcgtttgcatgtcatctaaatggttataaaattttagaaaaaaaatcaacaagatgattaatatgtgattgtattagtagctaataactaaaaaaactaagcaatcacacaaccaatggagctagcaatcacaaaaaaaagagagagagagagagaaaagaagaattggcaaatggcaaaatatactactacctccataaaaaaaagataggcagagatgaaatctttgtaaaatgaaggcagtactatgtaggagtatatggtaactgatgttcaatattgttgctagtcatgtcaagtggtgctaatatgaatggtggagtatatacttggcacagaataccaaggtacatatatgcatctctgtttattgtgtcaaacttttcccaatgattgggagtggatagtgcactgctaattctctaaagatgaggaggatagaacaaactataaatacatgtaaatggattattcatggagctagaattaactactactacggcgactacgtactaataaatactaatccactgcttactgtgcttgcacatttaatttgtgcactttgattttggtcaagactcaagaggcaaagggaagattagaggaagtactagcgaagtacattaattagggaaggtagaacagtggtgctggagcaagtagggtaagaagtgaatgtacaacacagtcatcaacttatagtggttcagaagaagaaagagaagatcagcaaacagtcagcacgtactctcatgctgctcctcacttcaccattgagagaaactaattaatgtgcatcagataatgttcagtaaaagaggcacaaaaaaaatttaaatctcc

SEQ ID NO: 514 - DNA, 1501 bp, Oryza sativa
taagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagtagcaacaactataacaccaaattattttcatcaaatctaacattgaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccctcagaccaacccacctcgtcgactacctacagcaaatgcgactcctcccccacaacgactactcgccggatcccggaggcatcctcccaggaaggaagcgacgatacaggaaggggggggagtgggaggaggaagatcgattaccagttggatcggagcctcggagccggaggagatcgccggtgaaggagagcttcgcgcgcgctaggtttggcggtgggggagagcgcgtggggggaggcgagaggagaggccgtggacttcggccgcataacatgggaaatgatgggccatagactaggcctgtttgattggaccaaatttcggcccattgacgcatacccgatgtttccaactttgtgatatttacgcatactctgttta

SEQ ID NO: 515 - DNA, 1501 bp, Oryza sativa
gactactaaagcatctaatgcctgcagtcgactctagggataattatttttcacatgaggaacaaaactatttctagaccttctttaggcactatttatttataaatatataaaaaatgtaatgaaggtgacttggatatataataaataaaaactgttatacagttcctttcagaatttattgaagttatgtgaccacaataatttttaagcaaattaactacaactgctaaagctaggctgtaacccaaaaagttaccacttgccagtgaaaaatggcccagaaggtacaagatacaaaagtaatcgaattatcttgccagtgtaaatatacaataaggaccctaataaaaacatttatcaccactttttactaaaaagtttttaggacagaccggaaggaagagtaaagattaatcaagattcaataaagagtaaaattaaaaagaagtggttggtgacagcaactcgcctccttcctcctcactcctctcctacttcttgcctgcctcgcacctcactcttcttcctccccggccgaggcaacagtaacaccgctgcagcagcgaggaattgtgtcggcgagaatggattccaggatctccctcgtctgcttcctcgtcctcgcttcctccttgctgcattgcgccagatctgatggtaaaaatggcttattggctctcgctgctcttcctgcaatctgattcgggcttcgatggttagaattgttgtagttttgttttgattatttgtttgttgtagtgtgtctggatctgattcgctggagtgcgtgttcttggctgctgtgtagtagtgcaatgatttagctgccctgttgctcaaattcaattgagaattactctgggagttttaattggttcatgggatctgggagtctgcagaagatgattcttgtttcaatccgtacgaattagtttgtctctgttcgatcgcttagaaaacgctcaagcggttgcactgggcatttgtgctggtcagagatctggtcactggtgttctatacattttgatgtaactagtcacatggtcatgatttgtgagccactttcgaggtttgcttggtcctcttttttgagttaaaatcttgtttgggaagctgttttcgtacaaatccagcttttgatgtgcaagatctgatgtttaggactcagtggtagattttttattttattttattttattttttgcggggaggactcagtggtagtctgctaaggagaaaatttttcagtaacttaagtcacaattgctatgtattggagttgatgtgtttaggtacatatggcacagtttttatgcatatggtttcgaatgaaaattctttcaagtgaaaatttttggtgacatatgaagtatcatagtttattgagatgcatttattcatacacttgtcatttgttaacagtacttattacgattatcatttgctgaagatcgaacgataaaattctaccttttgctggtcgagatctgatatgca

SEQ ID NO: 516 - DNA, 1501 bp, Oryza sativa
cccacgtgaagcgtaaaaagtcatcaacaataacaagaccatatttgttacctccaatgcttagataagcaattggtccgaagaggtccatgtggagaagctccaatggtcttgtagtggtcatcacattcttgacggggtgatgtgctccaatttgtttgccggcttgacatgcgctatacaccctatctttctcaaattgaacatttgttagtccaaggatgtgattgtgctttagaagcttgtgaagattcctcataccaacatgggctagcctccgatgccaaagccaccccgtgttggacttagccactaagcatgtctcatgtttggctttacttgaggaaaattcacaaggtaaagctttcccttgagaacacacttaaagactaccgaggaatcattccttctatagacggtcacatcaacatcggtaaaaagacaattgtaacccatagaacataattgagaaacggacaaaagattgtagtttagagattttaccaagagaacgttggcaatagaaagatcattagagattgcaatcttacccaatcccataacgtttccctttccatcgtccccgaagactatgttatcttgtgaagtgccatttggatcaagagatgaaaacattgattcttctccggtcatgtgattggtgcatccactatcaatcacccaacttcttccaccagtgacatattcctacaagggatcaatttctagttttaggtacccatacttgcttgggtcctctcatgttagtaacaagtgccttaggcacccaaagaactctcttgatagaaatattcttgccccttgggcctacatacttagcaacaacacgaccactagcattcttcctaagaacataagatgcatcaaaagaacaatgtgaagcacaatcattaggaaggatacttttggccctaacaaagttgctaagaccttggggcctcttgatcatcacactcttgtccacctttccttttggtggaggaacatacccaagaccctcatggttgaagttgtccctttgatagcctaggtactcttttagggccttactacccatatggcacttaagtaggccattgtgaaggagtcccataagcttctcattttgcttttgcaaagcactcaaggaaatagagttagtagcacaagcttcaatatcaatatctttgcatcttgcacaaggttcattgcttggggcaattttggagcatgatgccttgctagggagagagacactattctttaaggtttcaaacttctcttcaagagagaggtaagctttatccaagccatccactctctcttgaagttgagcgtttgccacctcaagattagcatgagactctttggtttgcttgtaaagccgtaccaaagcctcatttttctctctccttagcaagttcgcacttgagttcatgagatcgctctttctcatgaatgagcaattcctcttgcctctcaagtgttgcatattgatcct

SEQ ID NO: 517 - DNA, 1501 bp, Oryza sativa
gcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagaatccataccacacttgagtgagttgcttgggagaattgaggatcaatatgcaacacttgagaggcaagaggaattgctcattcatgagaaagagcgatctcatgaactcaagtgcgaacttgctaaggagagagaaaaatgaggctttggtacggctttacaagcaaaccaaagagtctcatgctaatcttgaggtggcaaacgctcaacttcaagagagagtggatggcttggataaagcttacctctctcttgaagagaagtttgaaaccttaaagaatagtgtctctctccctagcaaggcatcatgctccaaaattgccccaagcaatgaaccttgtgcaagatgcaaagatattgatattgaagcttgtgctactaactctatttccttgagtgctttgcaaaagcaaaatgagaagcttatgggactccttcacaatggcctacttaagtgccatatgggtagtaaggccctaaaagagtacctaggctatcaaagggacaacttcaaccatgagggtcttgggtatgttcctccaccaaaaggaaaggtggacaagagtgtgatgatcaagaggccccaaggtcttagcaactttgttagggccaaaagtatccttcctaatgattgtgcttcacattgttcttttgatgcatcttatgttcttaggaagaatgctagtggtcgtgttgttgctaagtatgtaggcccaaggggcaagaatatttctatcaagagagttctttgggtgcctaaggcacttgttactaacatgagaggacccaagcaagtatgggtacctaaaactagaaattgatcccttgtaggaatatgtcactggtggaagaagttgggtgattgatagtggatgcaccaatcacatgaccggagaagaatcaa

SEQ ID NO: 518 - DNA, 583 bp, Oryza sativa
ctgcagcccgcaccgacgtggccgcctccgggcgcgcctagcggctgccgcgtggggcccggccgtcagccgcccgcgccctcgggtgcggctgacgcgtggggcccacggcgccggccggtgtgagcccgggtgcgcccggtccaccgtggaccgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcgtaattggaccgttgaagtctctaatttttccttaacaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgca

SEQ ID NO: 519 - DNA, 1501 bp, Oryza sativa
ttttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagttttttttaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagcta

SEQ ID NO: 520 - DNA, 1501 bp, Oryza sativa
ttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagtttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagcta

SEQ ID NO: 521 - DNA, 1501 bp, Oryza sativa
agttggtccaaatatttctgttgagcaccagtgaaatatcctaagaactggaatagacataaaaaataaaacacgtgaaacacatcgctctcacgcatgaaacatcgaattttaacggttgaaacatttatattcctcaaaagataatcataggagatcattttttaatgatttatcttcaataaatacaatggtgaaatcagatcttaaataaagatacatagtttagggaaaacatcatttgaggctcgtgtgtttggtctggagccttctccttgttaaatgcgtgcatgcttgcatgcagacttgcagtggacgaaaacgttggttttgcatgggaggcgcgggcgaccaaatgagcttgcatgcaaacttgcagatgggtggtgttggttttgcatggtagacgcggggtccgatttttttgcttgcatccaacgtccagatggaagcattatcgtaaaaaaataataatccagcaaaaaattcgagtcagaagcggaagcgaaattctttccggccaaatttcatcggcgcattggggtggagtttgatctcttgcaagacagatttgctacgaaagtgtgttggttggtggcattgtgctgcgcatggaggttgttcctagaagaaggaaggaagggtgccggtcataggcttggccgccagagacggcggtggcaacggcagggagggcatggcgctgttgcggaggctattctataggaagccaccggatcgactcctcgagatcgccgaccgcgtctatggtaaacccatgcttcttcttcctcctgcaatgttgttgcttttcaaatgctgaggaggatctggggaaacgctgcagcaacatggaagggttaggttgcgtggaattggtggaattgtgtaatgtgtcattgattctagctttggaaatggggctgctttgtacattcactcaattaatagatacggtaatattacttatcaacctagataatacaatttcatggattatataggtttttaatatgttgttgaaaagtctacgaaatgcatatcggttttttctctgaattaattatgtaaataaaacaactacttccttatgtgatagcttcacagatattacatccattcttaaatacaagaacgtctggagttcggcacaagtattaagaaagtatgtagaaataaatagcaaaaaaattatgattggttcacaagggaaagtaggtgctgaaattaattgagaaatgtctctgattggttgagaagaggaagcaggtgtacaagttgctatattttgagatattttttaatgctagaagctattatattttggtaaggagggagtagcttgctaatgtttctttcacaggggaaaagtagcttgctaacattctgcagtgttactaaaatgttagctaagatgccttctagaatccaatttgacttgaagagaaattgattgaaatatttatgcttgcagtattcgactgttgcttctctacagaaa

SEQ ID NO: 522 - DNA, 1501 bp, Oryza sativa
gaaaatagactctagggtctcgaatggagaaatagccatcactccctcaattggctcaggaacaggaagagactccatcaaagaattggttgattgcaacatagggacggaggtggcaattcttcctattttcaggttaaggacaccggtttcgggcacatctaagagtttttctatgggatgccctatgagtatgtcgaaatcatatatttcaaacacatgaaaatctaatatgacctcaacactgttgtgccgtgtgggcactccagagataatccctaaaccttcggtagtagagtttgtggaaattcggaaggttctgacggttggttccaacgatctgtcccctaagcaatcgaatgcaaaggttgcggacataatattggcaccaacagagggattatacagagcacggaccgaattacctccaatgtgacacataatggttgaggaggggcatcggatctgaatcgattcagataagagctctccttctcttaaccatttgttactcatgatgatggtcaacctcttcaccgtctctttaagcatagatttatcaagaggttcattagaattgaccttggtcggtggtctcttctctcaggaataattcaaggtgttctaataatcttcgaaaagatcctcctcgaattggaatgaaatttccggaggatgaatttcttcttcctccggctcctgcgaccgggatgaggattcgacagttgagtcgggttccaactccacgtgcagaggttcctcatgaataatctcgaccttcgggacggcttcgcttcggccgaaagaatcgttctctaagatcaaatctaagagttctcttccttcggcggttgtcttgtgtgcgaacgatcctccggcagaaatattgagattttcggcaaactccttgtctaacccgtaccgaaaatgttgcaacaacacgtggtcgggtaacgacaagtctgggccagattgagttaacagtgagaaactggcctaggctgcaccgagatattccttctcattctgtcgaaaagaaaggatgtctactcaaagattgattacacgggttaatggaaagaaagtaaggcagaaattgcacttaagctcctcccattcacagtggaatttcttgacagatagagtgtaccattgcttagcttcatctctacgagaaaaaggaaacaatttccacttaagagtatcatgtgtcatgccgacgatagataggcacgaacacactagctcaaagtcctgaagatggaggtatggattttcaccgatactaccagagaaggttttctctcgaaccatggctataaagccaagactgatttcgtagccatctaggaagctactcggccagtactccagtactcaccgatactccagtactccttcagaattcctcctaggaagctacactcgtcgaggcagaagtcggatgagcgccaaacttccgggcactccttcagagcttcccctcgctttctacctattt

SEQ ID NO: 523 - DNA, 1501 bp, Oryza sativa
tcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagtgaggggaagctctagaggagtgcccggaagtttggcgctcatccgacttctgcctcgacgagtgtagcttcgtagtaggaattctggaggagtactggagctgttggtacactttgctctaggttcagagaacttcttctattaagtaagcattcgtgttcctttcttatgttatttaattacttagtctgagtaagatatatttccatctttgcaggttcattatttagtatttatactaagtgctctagtactaggactccggatagagaaggaatttcctgcgcaagtattagagaagtaattaataacttaggcctggtgtctaggttagagattacctttgtttgttgtgtatcccacggatttgtcagaggtagacggcaggtggtgacagccctgaattccgtcctagtaatcctccatgttcgggtacatcatagagctatagccggaaccacactgacagaccagcaggggtcggtgcccgtagcaacagataggaaattacctttgcttagcttagataattaaaacacagagaaagtcctctctagcctgcctacctatagttgttgtccttggatcgtcttagccctaggtagattacacacattccctgagtttgatatccttttggggtcacccgaaggtgaagtgctacagcggtattccgtgcgcttgtggatttatctttggtcgtaagaaataccaacattcacccatgacctcccttacaatatgttctctaagatgatcttctgtctgttccttagtttgtttaacctcccttacaatctattctctaagacgaccctctctttgttccttagtttgtttgcgcttcctgtgttgtgcgttgtacttggccatcccaatgttccaaggaatgttgcatcctgtccctctagtccggccagcctgttgttggtatttcttaacgatattactagaaatatgaattcccagcaatggcgctagaaatggtcctggtatatatatggtttacagaaagaatccgcaagcgcacggatttaccattgtagcatttcacccgggagtattctaaggtatcgtatttatttaatcgcaagggaagattgtaagagagaactatgctaataatatatatacatgccacttacataatcaaagtctaagcatgggttaaa

SEQ ID NO: 524 - DNA, 1501 bp, Oryza sativa
  unsure (1)..(1501): unsure at all n locations
agcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggaggggggcgtgcatgcgcggctttcggcgggcaggactttgtttaaccgggcccaaaggggggtaaaaatcccaacaacacaaggggggcgctttacaacgtgctgcgggaagatagttggggacagcttctttctcgagctcacatacactgggcgcgctggggctcttaaagctaaactggaccgccattaagcggagtagttgcgcttctctttcctttctttttcccctgtttttagaggattgcgctattttttttggttaccagtgcttccaatgttccaagaatccaagttccagctcatctagggttccattcatggaattaaatgtagtagtatcatattatagaaaatngatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacctaatttctcttttcaaccaatcacccacatttttcaatcattctcacctactttcttaatacccgtgccaatcttaaaaatgcttacattttgggacggagtaatatttcatacacgaggtatcgatcatcatatgatctt

SEQ ID NO: 525 - DNA, 1501 bp, Oryza sativa
atttacagaaataatctatcgaccaaaaaaattgcagaaatagcccctaccgccctaatggtgggcggcaagctgacgtggcagacggtgggtcgaccgcgccgtctgctgccgtcggccaaaattgcgattaggcccttgccgcccgtacagagggcggcaaggggctaattgcaattttggccgcccataaagagcttgcggccgtacttttttcatctgggtccctgggcggcaaaggacccagatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcttatcgcagtctgggtcgtagaaacattatatggacttaaactaggagaattatgtaacatgaagaaatagtagtacaatttgaacatgatacaactatttgcattgcggttacatagattgtcacatcctgattttcgtttcaggatttataaattgtttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaattctcgcctccccgttgctctttttctccaattttgttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctctgccgtgctccgtagctccgtcgccaccgccgccaagcaaaccgccgccgccggccatctccggtgc

SEQ ID NO: 526 - DNA, 1501 bp, Oryza sativa
  unsure (1)..(1501): unsure at all n locations
acacggaaaccttgtcgtcgccatccttgccgaatgcctcgaacaccaacgacgctgatgatggcatggcactgacagtgattatatgatactccatccgtcccattttaagtgcaaccataagtttccgtgcccaactttgatcgtccatcttatttaaaatttttttataattagtattttcgttgttatgagatgataaaacatgaatagtactttactcataacttatgttttaaattttttttcaatttttttcaaataagacggacgattagagttggatgaaaaaaccatggttgcacttaaaatggaacggagggagtattaattggtttctcttggaccgataattagaatacatatcgtagtgactctaacttgtgacttgtatgctgcaacttagggctgtttggttgagtgccaacctttgccaaacttgtggcaatgaagcttgaccaattaggtctgtgtttggttcatgccacaagtgagttatgctacaattttttagcaagttggtccacttgtcattgagcgttttttttttgccataacttgccacaattgtggccaacaaatttttagccataaaatgtgtggcatgccacactttgctaaatattttgtggtatactatggaattcatccaaacaacctctttttactatcggagtcgatcgatctgatgatagctataatatgtgcgtaataagatgagagagatgatccagtcaataagtcagggctcatggcctgtcaactgcatgagccgcatgtcagcaatgactccacggaatgcgctgcctgagcttgaggaggaagtgctcgtagtcctccttggcggcacggacaaggtgctcaagggctcaagtaggtgcatccgctcctggaactcgagcccggtgacgtccacgacatcatgctggggatcatgacctgtggcttgcgattgaacgctagcaccgatgacgacacccccgtgcggccgtgcccgcctagcccgtgccgtcttgcacgagagagcaggcgtcacccgccccccccccccccttcccgccgatggcgtnncccccnnatngcnccgnggcgcccgngcnnctctgntgtacaacctacatcgtcctgcacgaggtgcgcctccaccgactactggccctcgtccactgtggggcacaccgcacaccggccaccacctctggcccccctattgcccgtgcacctccaccacatctaccgccgccaagggtaaaagatgaggatagagataaagaagaatatattgttttactgaaatgcgggtcgaatgtaagattagagctgtattttatctgatattccagttcagagacgattttaaaacttgatgacaaagataaggaacgttaacgttaagtgaacttgtttcaatgaagaatgcaaggggcggtagactgagcagcccatcattattcgatagcccattattttgtacttttagactgagcagcccatgattaga

SEQ ID NO: 527 - DNA, 1501 bp, Oryza sativa
  unsure (1)..(1501): unsure at all n locations
cgtctgccacgtcagcttgccgcccaccattagggcggtaggggctatttctgcaatttttttggtcgatagattatttctgtaaatattaaaaaaaaatctaaaaacgaaaaaaattctaatcatgggctgctcagtctaaaagtacaaaataatgggctatcgaataatgatgggctgctcagtctaccgccccttgcattcttcattgaaacaagttcacttaacgttaacgttccttatctttgtcatcaagttttaaaatcgtctctgaactggaatatcagataaaatacagctctaatcttacattcgacccgcatttcagtaaaacaatatattcttctttatctctatcctcatcttttacccttggcggcggtagatgtggtggaggtgcacgggcaataggggggccagaggtggtggccggtgtgcggtgtgccccacagtggacgagggccagtagtcggtggaggcgcacctcgtgcaggacgatgtaggttgtacancagagnngcncgggcgccncggngcnatnngggggnnacgccatcggcgggaaggggggggggggggcgggtgacgcctgctctctcgtgcaagacggcacgggctaggcgggcacggccgcacgggggtgtcgtcatcggtgctagcgttcaatcgcaagccacaggtcatgatccccagcatgatgtcgtggacgtcaccgggctcgagttccaggagcggatgcacctacttgagcccttgagcaccttgtccgtgccgccaaggaggactacgagcacttcctcctcaagctcaggcagcgcattccgtggagtcattgctgacatgcggctcatgcagttgacaggccatgagccctgacttattgactggatcatctctctcatcttattacgcacatattatagctatcatcagatcgatcgactccgatagtaaaaagaggttgtttggatgaattccatagtataccacaaaatatttagcaaagtgtggcatgccacacattttatggctaaaaatttgttggccacaattgtggcaagttatggcaaaaaaaaaacgctcaatgacaagtggaccaacttgctaaaaaattgtagcataactcacttgtggcatgaaccaaacacagacctaattggtcaagcttcattgccacaagtttggcaaaggttggcactcaaccaaacagccctaagttgcagcatacaagtcacaagttagagtcactacgatatgtattctaattatcggtccaagagaaaccaattaatactccctccgttccattttaagtgcaaccatggttttttcatccaactctaatcgtccgtcttatttgaaaaaaattgaaaaaaaatttaaaacataagttatgagtaaagtactattcatgttttatcatctcataacaacgaaaatactaattataaaaaaattttaaataagatggacgatcaaagttgggcacggaaacttatgg

SEQ ID NO: 528 - DNA, 1501 bp, Oryza sativa
atgtagatcgaaatgctatacaagctaggacgtgtgtgattttagtgcgaccgtgtgttaaccgtgtattggaggtcgatctgcggctatccaattttcttaccgtggagcacgtgtgctatgaaacgactggctgtacacgtttcaacattttgtcttctaccctgaaaatgtcccaagtattacagtatttgatattgatttttttgtgggaagtgcgtgttatggactaatgattgcattgtggagacaacaagcaccatccgtcgtccccgtccatggctgatcagataggacacacctacgtgacacgtatggttccaatgatagacggcagcagcaagtcaggaacgtttgatcctctgcacgcagagggtcttacgaatggtacggtgtacgtgtgtgtgggagaaacagagaggagacgaggacagactggagcaatggagtggatgaatggagggtagacaagtgtgtatttatgtggaacacacgatttgtcaatatccacgttagctagcaaaagcaccacgaaataaacaccttaaaatctgtcatcgtcgtatcatgcatgtcgaatgttttggttgcaaccgattgaagtaaatgaatttaggaatttgtacgtgaaaacggtaggaataatcttgttaagtatatctccatgaaacattctttatgtccactatctcgaaaataagtatatttttcattcgtgctatacatatcaaataaaaaatattatcatcattttatcaaatttcaatataattatttcatattttatctactcccaatgctttgccccatgcttttataaactctaatacaacgattgtttaaaaataaacttattttagaataaacaggagcgaataaaaataatcttatttcgaaacagtgatgtactagtttttaggaatttggtcagtatttcagttcacagtttatccacaattaaaataagtggttactgtggctgggcctgcgtgagctgggctgactagagagagggagagaccgcaacacagaagatggcgatatttttgggagcaaaccgctgattccacagatccgggagcccatgtggaaagcgcccgttggcggttcggcgatggttacgggccatcacggggtccgctcgccgcagacgatcgcggcggcgggcgggatctcgccacacacgtaatccgacgcccgcgcgacgggacgggacgcggctacgggctaccaccacccatccccaccaccaccaccacctcccttcctctcccccttttaaagccgtcgcaccctggcggtgtgtaagcctccgcccctccccgtatctctcgcgtttctggtctaagttccacgccacttgttgccgcattccttctccctccctgcaaatccaatccaatccaatcccaccccaagctcgcggaggaggaggaggaggagatggggagaggagggatcggcggcgcggggctggtggcggcggtcgcgaaggcggacg

SEQ ID NO: 529 - DNA, 1501 bp, Oryza sativa
tcgtcacatggttattctttaaatatatcgtctctgtgccccagctgttttactttattttgttggagtcgatccgtggaaataactgtggcttgaagttatagtaaacctttaccctcgtgcatggttcatgattgaagtctcaccgaacgttttgtcacaacgttatagaaatcgaccccagaacggctcagcaggaaagaggcacgtccaaatgcgcacgaccgagacagaaacaccatagttctgccaccgaacccaaacagtgcgtctgtgcgtgcagcgacaccagtgttgccaccgtatgcggaatcgcagttacctgtaccgtggaaatcccttcgtgtagcctggcataggtacgtaattccagtactaggctcccatcggttgcccatttggcctaaaatggcttatttggcttattagaaatttcaaattaatttataagtaaaacttttatagatttgttcgtagcgacttaaaagccaatattaacaaaaaaaatacgttaaaagcattttaaaatcaacttcaaaatcaagttcaaaaatttaaattttggcttattttttgcttgtctaggccaaacgatggggctactagtgtttccggcccgatctgctctgactttctggagcgagccatcgtgcttgtgatcacgtcgtctccggcgagtcacctcactcgtggttagtactgccactatctgaggtaaccaccagcacagtacatccactgatcgagagaacggaaagggcctattcattcatccccagcggtcggcgccgcggaagtccgtgccaaattctcccccacgctgatcgagatctgaacggtggtgacgactcacgcctcgtcagtcgtcagtgcccgcctcggcgcctcggctgcccgcagtttcggcgcgtgcgtacgccggcgcagacgccagatgcaattcacctctccgggtccgggcggcaacgcagcgtgcgcgggcgtgacgagcccgagggggggcggcggcggccgatctcgtctcggcatggtgccacggcgccacgcaccctcgtctttccgcatagcttttctccaggttcacctccccttgctgcccccaccaacgtggccacgccagcgcccaaccaccgcccccgcccgcccgccccgttcggccgcctgcccccacggccccacccacgcaagcgccccttccacgcgtcacgccgtgcggcgaccgaccaccctcccactgattgcgaccgccccctcaccacgtgtccctcccacgtcgtccccacgcccgccctcacacaccccgcgccactgtagacactgtcgtgtggagcccattggctctgtccccaccggtcagtgaggggttggtggacgactatccagtcgtgactcgtaagggcccagggtaaataggtaggcctgatatttgtgggtcgcccatgagagagaccccatgtggggtgggccccaccaggcatcaataaataacctgtctgaaggc

SEQ ID NO: 530 - DNA, 1501 bp, Oryza sativa
tgggggccggcgggcacaagtagtgggggagcagctgggcgcgggtagtgggtcccatttcctctgcccatggcgaggggatagcgcggcgagccgctgcccttggtgaggacgccgtcgaggtcagagggcggtgcggaggacggcggagacggggtgcagaggacagcaagcaggttggagggcgccaagaagggcggggacgacgcgacgagcaacgctcccgagaaggagtcgaggtcgacgaagtggcagaggccgcgccgggaggggtgtggcggttggaaggggggaggggagggtgaggagcttggcgtgcggcgggagtgaggagaagaggaggggcccgcatgatacggtagcgacagatgtggcgagaggacagtggcatgaagatggaggagacatgaaagaggaagaagtggtgcacatcctcttcctcgtcgaacccgtcgttgtcgtctggcggcggcaggaagcaggtgggaaagcgggaacggcagccgcagcgagagtggagctcggtggaggaggcacgatgatgacgacagagggagttgggggggggggggggcgccgaagctgtggagatcggcaccggcgacagattgctccacttcgcctgcctgcttcgcccaccgtcaccctgtcagctttgtgtgccgttgtcccacttcgcctggctgctccgcttgccgccatcccgctccgccccaccccgcctgccgtcaccctatttcacctgccttcttcgcccgtcgccgcctcgttggcttcacgcaccaccgtcgccccactccgcccgccggcttcgtgcgtcgctgctccacctactccgctcccctctgctcggctgctcccatgggacagagtggatagatacagagaagagagagtatgaggagaggagaggaagcgagttggagaggaggggaagaagagaccgatgtgggtcccacaccgagtcagcgcacgtcggacaacacacagagtcaaaactaccgagggatctagtttgcactggttttgtaagttgagggatgcgttagggaccttcagtttactttttccaaattcttgctcattgcccagcccaacatttctaggcctgctcacccatttcaggagcaatactctctctcgcagaaaacgagaatttcatagcccagatccaaaaatacccattttcccatccttcaccgacgaggcgacgatcgacggcggcgaggtcggtagaagcgacggcaaagccgacttcaattcgccggtgtcccgggcgtccactgacaaagaggacccacttggaagaattattattatacagtagtactccaagaaggggatagatttttcaagtgaaaaataacagagcagtgcccctcagttcagttcagtccccggcagtgcacgatcccatccctcccgcatcggcaaggcaccgccgcgccgaccgctctccgcaccgcgacgcgacgcgacgcgaggcgaggcgaggcgagca

SEQ ID NO: 531 - DNA, 1501 bp, Oryza sativa
tgatctcttcctcgttgtcgaggcagggtatgtactccctcatgctctcaggacaaaccgggaacctcccaatccgaaccctgctcccgacggcggggcccgcgtcggtcggctcctgcggcagggcctcgtcggtggcggccagatcggtgtcgttggcgccgccgacgacgacgtcgaagtcgtcgcgcatcgcgccgtcctcgccgacgatgccgaggcgggcgggagggggaggggggcggaggggaggaggaggcggcggcagcgaaggtgggggcgaggcattggcagtaggagaagcaggcggcgtggaggcggcaggggtggggatcagggaggggtcgaaggagaggttggcgttgggggagacggcgacggaaggggagccggtggagaggagcggcgaggaggaggaggaggcggtggaggagaagaagagcaggcgcggggaggagtcggaccagtggtagccgacgaggaaggcggcggcgcaggcgaaggcgagggccgcagcgcggaggacgcgcgggccgcagagcaggtcggcgccgtgcgcgcccaggggcttcatgctcgcctcgcctcgcctcgcgtcgcgtcgcgtcgcggtgcggagagcggtcggcgcggcggtgccttgccgatgcgggagggatgggatcgtgcactgccggggactgaactgaactgaggggcactgctctgttatttttcacttgaaaaatctatccccttcttggagtactactgtataataataattcttccaagtgggtcctctttgtcagtggacgcccgggacaccggcgaattgaagtcggctttgccgtcgcttctaccgacctcgccgccgtcgatcgtcgcctcgtcggtgaaggatgggaaaatgggtatttttggatctgggctatgaaattctcgttttctgcgagagagagtattgctcctgaaatgggtgagcaggcctagaaatgttgggctgggcaatgagcaagaatttggaaaaagtaaactgaaggtccctaacgcatccctcaacttacaaaaccagtgcaaactagatccctcggtagttttgactctgtgtgttgtccgacgtgcgctgactcggtgtgggacccacatcggtctcttcttcccctcctctccaactcgcttcctctcctctcctcatactctctcttctctgtatctatccactctgtcccatgggagcagccgagcagaggggagcggagtaggtggagcagcgacgcacgaagccggcgggcggagtggggcgacggtggtgcgtgaagccaacgaggcggcgacgggcgaagaaggcaggtgaaatagggtgacggcaggcggggtggggcggagcgggatggcggcaagcggagcagccaggcgaagtgggacaacggcacacaaagctgacagggtgacggtgggcgaagcaggcaggcgaagtggagcaatctgtcgccggtgccgatctccacagcttcggcgc

SEQ ID NO: 532 - DNA, 1501 bp, Oryza sativa
ttaaaaactgcgaaataaaactccctactaaaactatccttataattattttcaacatttattctatcatatactcaaccaatcacaataattttgtatttgatttatgtatataacttttaacctcaaattaatcactattatttattatttataattttttacctcaaacaatcacaactactcgtatgtttttcttattttattttttttgaaaattgataaaagtagctagtataatatactcccaccgtttcacagtgtaagtcattctagcatttcccacattcatattgatggaagtagacatacagttgtactccatcatataggaaaacaaattgccattccatcgggaaaaggcggtttagagcatgtacaatagtcggctataagccagctataaacatatttaaaagagacaaaggaagagagagaagagcagcgggctgcagtacggactccaaatcgtacaatgtgtatgacaggtaggaccatgtattaatagtgtagtaagcaactattgtatgaattggctataaatgatatggagctagttgttggctatactattaaacttgctcttagagcaggtacaatagcaggctataagctagctataaacatattttaaagagataaaggaagagacagaaaagtagcgggctacagatctgtagctggctgtagcacggactccaagacgtaatgtgtgtatgacacaggtgggaccagatattaatattatagtaagcaactattatatgaattggctattacattggctatatatgatttgaagatagtagtggcctgtactattaaacttgagcaattctacggttcttaagaaggtaccatgaggtatcatttttttctattgtaaatttagtacctcttggtacctagatactatgagataccaaaaatttagtataaaatctgatatctcatattacctcctcaaaaactgtagaattgctcattaaacttactcttaggaaggctaccagcaaatttaattggtggatgcggcgccggggagtcaaattgcagccggccacgttttccctggccgcgtctcctggctccgacccgcacgacgtggcctctcccacgggccgacacgtagcccctccaagccctgggcctcaaacctttccagaagcttccggccgtttcctggccaggaattcgccgtcccgatccagcggcccgccgagcgccacgtgtctggggcccagccacgtcggcatccgacgtggcgcccccggccccggagaaactgatacgcccaaatctcgcagctcacagcctcacgctcggaaagcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggaga

SEQ ID NO: 533 - DNA, 1501 bp, Oryza sativa
atcgtcattaggattctatttggtgttttattaacaatttttatatctcatatcaaccgccaccactctacttctttataggcatgttacttaatttatctcgtcatgtgttttagatggtcttttctttcaatgatctttatttttatcacaaattttagttatttataaattgtattcctaattgatatcttatttttatttttctaatttcagaattttttaaaaaattttagttaatatcgtattgtgttattttaatgtttttattttttattttcaatttcagttgtttcaaaattgtattcctatttgaactctcttttaatttttctagttttagatattattttattttttattctaatttttaattaatctcgtattggattcttctttcaatatttcttatttttaattttgaatttcagttatttttaaattatacttctacttggactctcctttttcttttttttctttttctccaattaatgtgggaattatttttattctgaattttaattaatcttgtattgggttattatatagactcttattttaatattccttatttttaattccgaattcagatatttttatattgtattcctacttggactcttattttcttttctaattttagattttattttattattattttgatttttgattaatctcgtattgggttcttatatggaaacttattttaatattccttatttttaatttcgaatttcagctatttttaaattgtatttctacttggactctcctttccttttttgattttggatttttttatttttatttcgaattttgattaatctcatattgggttcttatatagaaacttctttcaatattgcttatttttaatttcgaatttcagctatttttaaattgtacttctacttggactctcctttttctttttttttatttttctccgattaatgtgaaaatttctagcccccacagtgaacatggtgtctcctttcaaagctgttttaataatataatagatatatgatcagagccgaactttgtcacatgctcatataacttggtcgaaagcgtcgagcccattatttactggccgtctggccctcatttggtcctgttattttggtaaagcccaaagtccagcccatgaactccagaaagcagcaaaataccgtgcgccagcggctctagacctctagtcaaagcgaaagccaacggaggacgtatcgaggttgttgcagagtgctggacttgcccgccaagccgaagacaaaacgcaccgcggacgtggagcaacacgcgccgcgattcaggctccccacttcgtccacacatcccgcctcctcgccgcttctttaaactccaagcggccaagcccaccgccaatcactcatccaagtatccaacaaagaacaaacccacccccgccgctgagatcgaatccgaccttaattttcacctgctcgctgatctcgccggccgtcgaccgcca

SEQ ID NO: 534 - DNA, 1501 bp, Oryza sativa
cttgggttgaaaatgttactacttttttctacaaacttgatcaaacttaaagcagtttgactttgactaaagtcaaaacgtcttataacctgaacggagggagtagtaatcaacaatacatacagagttaaaagaaaaaaaataaaaacaatacattgtttgtaaatgtctcatgcaaaaattgcttatataaattcctgaagaaacttctgaagagaattcaagtcgagactctagtctagctcaaactagctctgcaacttgcaagtgacagcgaacacaaatgagctcctggtgcttgtttaaactgaacgcgtgcaaatattatttgataaatatttacagcatataggaaaaatccactaggtggctgaatggttgcttcacctagtcttgaccagtcggcaaggggttagaaatcagactctgtagttggtattctgtagaaatgtcttgtattctctcaacatcacgtactagctgtaaagtttcaagggtagtagcaatcactgcataaatatataaattttcaataaactttgtcttgttttgttttgtctatttcgcatgtcaattagtagtcctcttttgaacttcgaagtgggttcctccttgaaagcaaaactgtaacttccactgtaaggttagtaaatactgttcaattaaaataaaatataagtcgtgatgagtacagaagaaatgtagtatggataaaaattaaaaagtcgctctaaaaagaagttcttctagatagaacttgaatcagatgcccaagcatacaagctattcctagtttctagtaaaggtacgctggagaccttgatatatggccagccatcaatcattgaaaattccttttgttttgagttattctactctcagcaaacaaggtatcagtcgttacaataagcccaggtccatgtctaggaagttgttagcagagtagttgatagaaattgtaaaaatataatgctatggtcatcatttggatatgtatgatcctagttagttgttaaagccataactaaaacacataagttatacttttaaaccttttctttttaaattttgatcagtgaaaagtaaacaatatgagtcagtctatatctgagccttgacttgggaaaccgttctaactgataataaataggaagtactctgcaataagcatccataaacttcatgttccatgagaaggattcaacaagttgcagttgaactaacaaaatgacacgcaagtcagcattattcaccccaatacttgattgatcaagtcaaccaggggcatcgggcagctatatatatagcggcattccggctgcattttgtcatccccttaacttcgacaatcactgctggtaagtgttatttctggtccccccccccccaaaaaaaaaaaaaagtccttttttcagattttgagtaaggtccagatcaatttttctgttcaccatatcattgagagttgctagctagctttggccttggaatcaaacatacg

SEQ ID NO: 535 - DNA, 1501 bp, Oryza sativa
tactccatctgttctagaatataagaagttttagaggtagacacggttattaagaaagtaggtaaaattatatatgaagagtttgtgattggttgagaagcggaggtagatgagaaaagtgagggttggagggctgtaattggttgggaagggaatgttgatgaagaagttgttatattttaagacaaatattgagtactaaaagtggttatattttaatatagagggagtagatacacacgttgtaacaagcctacaagacatgcctattagctagtcacttttctgaagttccccggtcactacggcatttcttttgtccatttcgacgggtgagactgagaatcaatgggcaaattagagaaattcctcacgactaagagggcagaggctacgaagacgtagcattcatagcgcacgcgtgtagccgtaagcctgtcctgcttgcgagccactgcatcaggctgataataacttctcaacatgtttctttgaatgactcgcacgaaacgatacgaaattctattaataaagtaggaaaaaattataatattataattctggagggtcataaccagtaaaaaatgaaaaaatataccgtcacccgtacaccgacaacaccaacacacagatccgggagaaggctagcaccgaaccacttttcaacatgttggcagtgccgttgttataaaaacgtttctgcagtcaggcactgccatatccacggaaacgaatggaagaaaaaaaaaactttgtgatttgtcagcagaccacttgctaaaagaccagttaaaatcagcagtatggcactaaatgggcaggaccatctccactaaattgaaagacgaggattaatgaaaggatttcgctgactggtgccggataggctcatcctcacgtcctcaccaaccaaccatgcaagcccgctcgaccccggataggagggctacttcaacgtccgcatcgtctgcgtcgctctaccccttcggacgcatgtgccctccggtggtggcatggtgcattgcaattcatgtcaggctaaatcgatcaaccaaccacacgggcctacggaagccgccgatccaatgtaatctacacgcgtcgcgcccgcgcgcaaaagaaaggcgagaaaaacgacctatatatgcgacgtgctcggccacgacccacacgacagcgaacgtgcgcgcgtgcgtgtgcaacggcggcccaaggcgcaaacgcgaacgcctcaatctttccacttcgttccacctctcctccgtgcaaaatccccagcgcgcacgcctcgtccccctacgtgccgcgggcgtggttgcacgtcgtacgtacgcaggcgtcctcgcgagggcgcgcacgcaggtgcgagctcgtggcgggtgacgaagcggtgaaggcaaggcatcgcggcggctgtttgatccggggcctctttttgctccccgtgatcaggtattcgggtgctatacttaggtctggcaaaagtcagccgggccgcgcg

SEQ ID NO: 536 - DNA, 1501 bp, Oryza sativa
cctatttgctgtcccggccggtgtgtcagtgtgtggcaaagaacaacactactatttgctacgaacatctttatcaacccagccatatgtataggccatatgccaattttttcttttttgggggacaagttgatccaacaacggcttgaaaacgatttcttttaattttgagggaggaaacggtttcttatttttctgagagttgaaaaatgaaaaacgcccacgctacatgaatgggagaagtagtcaacactagaatcaaatatgttcatactattttttaactgaacagccatagtttaacattaacccaaaatatagcttcacacgctgtagtacaccaaatagtcatgaggtttggtttatatcggatagataaaacataaaaaatatataaataaatataaacaacactaaacaagatcatggaagatgcaatactttaaatgatcatcaagtgcaatatacgaattggctgtgtgcatccgtctcaggatgtagaggccggttctcccattatcttaaaaaaaaaatgcaatatacaaaagattattccgatgattaaaaaagcatatgattaattgttaaagaaacaaaaatattcctcatttttttctaattaagatgcaaattttaccttggtttttgtcactcccttcatttcaggttataagacgttttaactttggtcaaagtcaaactgctttaagtttgaccaggtttgtagaaaaaagtaataacatttttaatccaagacaaatttattatgaaaatatattcaattattgatttgatgccactaattcagtattctaaatattattatatttgtttataaatttagtcaaacttaaaataatttatctttgaccaaagtcaaaacgtcttacaacccgaaacagagggagtagtatgcttttcaaaccgctaaatggtacatttcatgcaaaaattttctatatataagctgctttaaaatatcatataaatctatttcaaatttaaaataattgtacttaatttttcatattcatcaaattaaatggctggtaccgtggtacgccgttttccacaacgctgcaaatctgcaatggattgcctgagacctcgtttggatgggctgaaatcctggtccatctaaagggacctcgatgggctccaaaaagcccatttaataatcgaagggccgagaggcccacgcgaagatgactgacaatatgggacccggaagtcagtcaacggaggatagaaaatgaaagggcacgtctccggaacactcgccacaacgaacgaactagcaccaaccccacagcaccagccaccaccatgtcgtccgaaaccgccgcttcgccgccgccgccgccgccgaatccaccggccgccgactccacccattccagccccgcctccatgaccgacgagacgcacggcgcaggagcccatcccgacgagtcccaaccgcatcgctcctcatcgtcgtcctcctcccctcccgtggccg

SEQ ID NO: 537 - DNA, 1501 bp, Oryza sativa
atgaaataaacgatcctatagagattttagaggaaatttaataagaactaacatcttggaaaatatccttggagtctatctttcttatatgaatcctgcgtttttatacgatccaatcaaacgatcattgatgtgtttttcttgcgttctcgttttggatttacaatcctatcagaatcttatattttttctattgctttgtttttccattcgcgtgattcaaaggggtccttagattctaccatcagtttagtagatttttaaccagatttaaaatttgtagttatagaatctaggagatgaaataaaaaccagaacttaggaaacatagctaccaaacaactatttctcaaaatcttgagctctttgtatcgttgttccttttaccgttgacatgctggtacttaacgctcctacaactggggatagactgcacggcatcatactaccggggatgaagtattgatcagaaccgaccggttttataaagtcgactggttttataaagtatatatataatcgcttggttttctctatattttcaaactaaccggtgatggttgtgcacttaattactatgcttttaggttatatagatattttagtgtcttgttgtttgcttgttgcctactccatccgtctcttgataagggattttgatattttacttgcactgtttaaccatttgtcttattcaaaaaaaatttagaattattatttttttgacttactttattatccaaagtactttaagcacaaatttttgttttttatatttgcacagatttttttaataagacgagtgcttaaacagtgtaagcaaattattaaaatacatatattataggacggagggagtactaaattttgtaggggggggggtatcctgatttgtttcaacattggtttttaaaccacaaaaggtttttctgacaaattatttattgttgctccattcctatttctaggatatatagctcaaccaatacgagtcttggtctatttattttttgcaaattttcctctagaggtttactccaagttcaaataatgatgtgcatttgtagtttagaggccagggttataattcctttaaaaagatagtaaaaagtatatatttttcatccttaatttctacatggggatatattaacagtgacggtgaacgtagaataatatagtgcgtaacatgacaagactaaatataagaaaaaaacaaacattattatatttttatacaactacctatttaaaaaagaagtaaaagtaattacctttcaattattcatcgtttttcttctatcaaactagtgcttttttcctctattaactcaacattttataaagggtttagccaacggaacagggactcaggcccacctagcccaaaactgttgggatcaccctgtagattaactttggtacgagagttcagcgtaaagtttagattttggttgaaatttgagatgatgtgactaaaaagttgtgtgtgtatgacagg

SEQ ID NO: 538 - DNA, 1501 bp, Oryza sativa
ctttagccatatatattgttgttgccctaataactaattcatactccatctgtcccaaaatataagaacctataaccggatgagacatttactagtacatccagtcttagattcttatattttgggacggattgagtacaataattacctataaatatatactagactattaatacatggtctcacctgtcatatatacattgtgtcttggagtccatgatacacctagctacaaatctgtagcccgttgcttttctctctcttcttttatctcctcgatatgtgtttaagctggcttatagtttgctattgtatctgctctaagccagctataaacacattttgaaaagataacagaagctctcctaagcagtccagattttcaccaagattttaaaaaactgtagatgtagaatctagaaaatggcttgtcagcttctctagattttcacttctcacaatctaagctatgcaaactggaccttaattatgattgttagggacggatcggtcgtgctattgatcaatactccttttcctgatccattaccttttccttactttctttctgtgcttatagcgacacaaagcgtgcaacggaaagtcgccaacaaggggaaggcgagagaacgagaacggcagcaccgcaggagcagcaaggagggagcgtttccatcacgccgatccagcctctttattatctgcacgccttccacctcactcgctaaccgttactgcgcgccgctgccgccccgcccgttccattccatgattccatttccatcccaccctccccgatcaaaagaaaaacaaagggaaaacctctctccttctctctctccgcctctaaaaagtaaactcgccaaggcctcccagacaactcaaaacccaacggtcactcttccccatcgaccagccaagcccaacttttttaagcgcctagccttccgttcgcccaccgcaccgcgccacgaccgagaccgaaacgccaaaacgccgcgcaaatcaccacgccacgccccgcccgcgcgcgtctcgtcgcgcacgcggagctgaactcggccgcgccggccgaggaacggagcagcgaagcgcgtactacacccgcgcccgcgaaagcaagcgcgcacgtacggagaggtgtaactagttagatagaccccgtcacgcgcgcgtggttgggaccgatcggatggggagcggggaggaggagagggaggcgcggagcgaggcggcgttcacggactccgccgacgggagcagctccagctccgacgcggcctcggccgacgagtggcccgtgacgctggcggcgccgcccaggaagacggcggcgtgcggccgcgtccccggcgcggaggtggtggacagcagcaagccgcacgcgcagaagcgcagagctcccagctcaggtaccggcactaccgagcaatgcgcgcgctcttcttctccttggtcaggttgtgcagcgtactgatgatacttgtgcatggtgatgagc

SEQ ID NO: 539 - DNA, 1470 bp, Oryza sativa
  unsure (1)..(1470): unsure at all n locations
ggggtgcctgcgtgttctggccaccaccggcccccgccggatccgggtgcaccaccgccggatccgcggcctccaccattgctaccccaacgccgtcgccattccggcngcatcaacccacaacaccacngggcgcaactcacctcaaccgccacngtcgccggtcnccgccgcaagcccatcccgcaagatcgggccggaacggcgcggatctggcggacaccgcngtcgccactccggcgggctccccaggccacccgagcgcgaggagacaaggagcgccccaccgccaccgtccttgcggccgcgcggcttcaccggcgcccgctcgggtgacggcaagncgnaaaagggggtgggggtggggaagaggnacgnccgggtccgcccctcgggagagcgacgcgagagggtttttctacaagcagtcgcttttgctccgtgtcgatcgatctagcaagccggctgacccgcctctgcaaatgcaaagcttccgtgagcagcccggagtgatttgccccgggatcgcgtggtttgtgtcgtgtctttgcatacggcgacatgctatgaatccccgctttacacctgtcagatggaccaaatcaccaaacgtgattggcggtccaactgcagagcagtagcaaagatttgaggaacaacaggcaagacatcggcacggcacctgcagactgcggatgaaggcgttcgccgtagaatttgagctttcgtttactgtaacagggctagttggttgtacttgtaccttacggttgaaagataatgacacctagtagatgatttgccggagaaatattataggacaggaacttaatactcattttcttcgaaaagtcatacggaataaatacatgtgctaaagtgttctcctttaagcaggaacatcagagctttcaattgagtagaacaatgcaggtacacattgccgggtttcaaaccgctgctatttttctcccttgggatcatggcaagcatttttcgtcaacaagactgttagctgcctgtttagcacgcgtcaccaacaaatgtacagagtatgtaaccaagatataatcgaagcaaaccgcctggggtagtgtttttttctctctttttgttcgtaatagcctttataagatgtagaattgtaattttttaactgatccattaatacgaaacatcgcactaactcgtagtggttgcttaaagaaaaaatcatagcaaacaaaacaacggccaattccatccttaccaatttatcttgatgtgttggcacggtaaaaagaccaaaatcggcccaacgtttttccatcgaatggacggagaccaaaacaagcaagcaacttggccttcaatcttcttctccttcgcgctctcgccacgcgccgctgctcgccacagagcaccaatccaagattccagagcgggcggtataagagaggggtaggaggctacacccccgccgcctccaca

SEQ ID NO: 540 - DNA, 1501 bp, Oryza sativa
tcatcatctccatctctgctcatcaccatgcacaagtatcatcagtacgctgcacaacctgaccaaggagaagaagagcgcgcgcattgctcggtagtgccggtacctgagctgggagctctgcgcttctgcgcgtgcggcttgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagtttactttttagaggcggagagagagaaggagagaggttttccctttgtttttcttttgatcggggagggtgggatggaaatggaatcatggaatggaacgggcggggcggcagcggcgcgcagtaacggttagcgagtgaggtggaaggcgtgcagataataaagaggctggatcggcgtgatggaaacgctccctccttgctgctcctgcggtgctgccgttctcgttctctcgccttccccttgttggcgactttccgttgcacgctttgtgtcgctataagcacagaaagaaagtaaggaaaaggtaatggatcaggaaaaggagtattgatcaatagcacgaccgatccgtccctaacaatcataattaaggtccagtttgcatagcttagattgtgagaagtgaaaatctagagaagctgacaagccattttctagattctacatctacagttttttaaaatcttggtgaaaatctggactgcttaggagagcttctgttatcttttcaaaatgtgtttatagctggcttagagcagatacaatagcaaactataagccagcttaaacacatatcgaggagataaaagaagagagagaaaagcaacgggctacagatttgtagctaggtgtatcatggactccaagacacaatgtatatatgacaggtgagaccatgtattaatagtctagtatatatttataggtaattattgtactcaatccgtcccaaaatataagaatctaagactggatgtactagtaaatgtctcatccggttataggttcttatattttgggacagatggagtatgaattagttattagggcaacaac

SEQ ID NO: 541 - DNA, 1501 bp, Oryza sativa
caaaaatatctccgggaaggcgagtaggagtacagtgcgcggaggcccaagaaacgaccgtgaccgaccaggctccgtgacaatagccggggctcggttcgtctactctcatactacaaggctacggcgtaacgacggagaggagggaggacgtgcacagcgagaggcctgtcccatcaatcacgagccccgcccccaagaccccggtgtacgccacgaaacagccggccgatggcttccccgattcaaaagagagacgccgtagcccgtaggacgacgttaggtcactgtcgcgataacaatcgtcctgataggataatatatatctacatgtcccgatagattgttctatgataggcctcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatgacagatcatttatagttttgttgtgtttttagaactcagtatataagcaatgtcaaatcattatctccagatcattttcacattatatatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtaatgggcggtgaggaatggtatttatatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtg

SEQ ID NO: 542 - DNA, 1501 bp, Oryza sativa
tagtacaatagtatggatgagggaacaaactaaaactatatgataatatggatgcacgagcggccagggcctagtggaaaacatgaagaactttgccgggcatccatgttgaacctcacaaatcacaaattttgctgttttatttgaagacagttgaatgtatcagttaaggtgggatggaacaaagcaaacaaatggtgctgaaatgcaatgcacatggagtagaataaaaaaagtcaacaacgtcatgtgtttaaatacggaggtatgagttatttttatccaaaaatgatctataagagatatctgcattgtcccaacatattctataagaaacaccattttgttacagggtcaaatgaaactgtaacagtatagtactacagtttgtggaattcgttagatagtaatcagcttaccatcagcatttgctgggctattttgtcacaatcaaaacgactcaatttcctcctgtaagggtatatatatacaaatgagtgagcagtagtataactaagcaggaggaaggaagcacacggattaggcgagtagctgacctcacctcacctgtgattgctgtagtgcatcgcagccagcccagccagggcggccagaggaaacagccggccggagcaggaggagcgggtgcccggccgcagcgcgtacgctgcccgcttacccgccatcggagcgcgaggggatgaatcgaagagggcaagggggaccttgttggcgatggttcctggtggacagctgctcccgccgccgccgcccgccggcatttgtggtggcgccaagatagggtgatgggggaaacggcggggcggcggcaagcgggaggggagcgagagacggagagagctcggtttgcgggcggcgcacctttgccaccggccggcggcggcggcggccgtcagtgggtgggtggtcgcaccgcctcccgttgcagatcgggctcacatgtcagcccaaaagtgagcgtaaattcggcccaaaagtacgggtcaatttggtgaattttttttatttttaattttttttattaaaagttttacaaaaataatttttcattttgaaaattgacagaagtggtcacctaccgccctctgggagggcgatttttaaaaatcgccatcccagagggcggcgaaagtgacgtggcagacggaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattatttttagggcctatttggaatgttaccgtacaaatattttgttagtgccaaaatataagcaagttttggcactaccaaatatttggt

SEQ ID NO: 543 - DNA, 1501 bp, Oryza sativa
cgcgcatcactgctgggatcacggcatctcgtcgcagccaggacctcgccacctcctcgggaccgccgcgagatcgccgcccgccgagcggaggaggatccccccaagcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggagggggagggtgggttcgaggaacaaaagggtcagcggagtgggcgttttggtaaaatgcggtgggtttaagtaactgaccgcattaagcggagtagttgcgcttctctttcctttctttttcccctgtttttagaggattgcgctattttttttggttaccagtgcttccaatgttccaagaatccaagttccagctcatctagggttccattcatggaattaaatgtagtagtatcatattatagaaaattgatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacctaatttctcttttcaaccaatcacccacatttttcaatcattctcacctactttcttaatacccgtgccaatcttaaaaatgcttacattttgggacggagtaatatttcatacacgaggtatcgatcatcatatgatctt

SEQ ID NO: 544 - DNA, 1501 bp, Oryza sativa
tggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatggttgattgtttcagactaacataatcaaatggcttaggataagagatggctagtaaatacagacatgcaactcatttatccaatggttgataatttcatactagcataatcaaattagttttgattcactcatgatgtaaatctaattaaatgtggagagaagggctagaaattactaaaaataaatgaggataagctactcctttgtccagtggttgataattttatactatcaaatgacatagtatgactcatgatgtgtatctatataaaggcatagaagaggggtagggatacctaatgaatgaggataagttactccttgatccaatggttgatgtttttgcactaagataatcaaatggctcaagttaagagacgacaaataaatgcagatactctttgatccaacagtttattttgtactaacatgatcaaatgggtaaagattactcaacctaaacataggtggagaggaggggtagagatgactaatgaatgcaaataagtaactccttaatccaacgttgatatatttgtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcagcggcctgatggatcggacgaaccctatcactgtaacatgtatgcctagctatttcttttcattctttcctcctctctttaaatattttttcttctaaattacttatccaatctacgaaccaatcacactattgtattcgttgcaattaaatatttacaacaagatatcatataattatattatgtcaaaagaaaaacatgtgtttcaaaccgttaaaactaaatgtttcatgcgtgatagtgatatgtttcaatgtgcgtcttccgtgtgtttcataaagagcaatgctacacgtactaaatttttctgactaaacttttactaacaatcatttcaaccgtttgatttaagtagataga

SEQ ID NO: 545 - DNA, 1501 bp, Oryza sativa
gttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgccatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtagtggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaagttgaaagtttaaagaaatagtttggaactaaacttggcatttgtattgtatttctattcaaaccgaggggttttccaaataaaacataacagggtgtcagtcggttcgaggatatatacgatattccgtgaaaagcgaggagtttttttttgcaaaaat

SEQ ID NO: 546 - DNA, 1501 bp, Oryza sativa
ttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtagtgagatacggaaaccccaattttgtgggggggggggggggggggg

SEQ ID NO: 547 - DNA, 1501 bp, Oryza sativa
cgactctatattaagatgttaaaacaagcagaatataacaaacagaagcttaatatacttggatgcaataatatcttgacataaagggcagatttaacgtgtcaatgaagcatatagagcaaatatagttaaattagataagatcggctgaaactccgatactaccctaatcggtaaccagaaggcaggctagagattgatattctaagcatgacttaatagatcaaactcaactgatacagcattaagtatgaaaagaagaacaatatctagacaatcaagccgctgaagtttcatagagtggtagatatcttatataatctaaaccaacgtcgatatctaacctaatcggctaccctctgttaacagatgttagccgattgtgggttagatggtgatattgctagagattatgtaagatatatgataactcgatgaattacataaacaagattagagtatcataaagatgtaagcactaatcccgagaacgcaagccgtcataacaagttttacctcttgttgaagatcgaaaccgatgcagctcaacccgaaagtaagaactcgtcgaaataaaacaaaagcaaaagggtggcgatgcgccgaaattgtattgaacgtgtgtgttaattgattacatggggttcggggtctatttatacccgaaaattacaaactatgtccatatcggacacgactcttatctctaacaaaatctaagataccataagtctttgcgacagacttttacccaaacatatctttaaggaaattacataaaatattttaattaatagatacaattgccttctcaggactctatccatgtgcggcaattatcttgaagcacctcaattcaacccgatgtcatacaccaagtcgtattgtcggaatcggctgcatcggcttacctagtccgactcagacccagccgatcctaatcgtagccgatctggactccagccgattcttgctctgttctcaaatcgatctccgccttcgactccacttcgatctaatcttcttttccgatgccgatattaccaaatttggttgttaacaaaaatataaggcacatttctttttgtcaccaaaatcaagaagtaattaactcgtccccaatgtaacaaaccaataaattatatattaagatggttgcttaggttctcgttgacaataaatttagcacatcaaaactataaatatgaaatatgcttaacactttttggataaagcgaatatcatttactaatcattacagaaatgttccggcatcttaaacactcccatcgtgtagatgggtagggcttgagctacaggtcattcgatttcaaacgtaattcgtaagattgaaaaaaacatcgactgacaaataatgataaattaatcacacttgaaaaaaaaatggggtttttttaactcatcagtagctagtatatatatatatatatatatatatatatatatatatatatatatatgtgagcgatgaaatcatatg

SEQ ID NO: 548 - DNA, 1501 bp, Oryza sativa
cgatttgatttttctatatttacataaaatttttaaataagataaatgatggatacgatctgatgctaccgttgactgactgactgatggcgcaggatggggccggggaagtggtcggcggaggagaggaagacgtacaacctgctggacggggtgagccggcactcggtccaggtgtacccgaggtcgtggacggcgatcatgctgacgttcgacaacgccgggatgtggaacgtgaggtccaacatctgggagaggcactacctcggcgagcagctctacatcagcgtcgtctcgccggcgaggtcgctccgggacgagtacaacatgccggagaacgccctccgctgcggcaaggtcgtcggcctgccgctgccgccgtcctacctcccggcctaattcatcgatcgatgcatatatgtactgaacccgatgacattcttctcttgttcttgacattttttgtgatcttttgcttaatctggcgaaataatcaacttaatttgggctcgtgcttattgcatgtccccgcgaaaagaagaacaaaagaggagtggaaactgaaacgtacgtcctatgaagaagctgagcgccgtcgtcgtcagctggatgtaatttcgatatgccctctaaaaaccattgtaatggtggagttatattatacatatgatttcatcgctcacatatatatatatatatatatatatatatatatatatatatatatatactagctactgatgagttaaaaaaaccccatttttttttcaagtgtgattaatttatcattatttgtcagtcgatgtttttttcaatcttacgaattacgtttgaaatcgaatgacctgtagctcaagccctacccatctacacgatgggagtgtttaagatgccggaacatttctgtaatgattagtaaatgatattcgctttatccaaaaagtgttaagcatatttcatatttatagttttgatgtgctaaatttattgtcaacgagaacctaagcaaccatcttaatatataatttattggtttgttacattggggacgagttaattacttcttgattttggtgacaaaaagaaatgtgccttatatttttgttaacaaccaaatttggtaatatcggcatcggaaaagaagattagatcgaagtggagtcgaaggcggagatcgatttgagaacagagcaagaatcggctggagtccagatcggctacgattaggatcggctgggtctgagtcggactaggtaagccgatgcagccgattccgacaatacgacttggtgtatgacatcgggttgaattgaggtgcttcaagataattgccgcacatggatagagtcctgagaaggcaattgtatctattaattaaaatattttatgtaatttccttaaagatatgtttgggtaaaagtctgtcgcaaagacttatggtatcttagattttgttagagataagagtcgtgtccgatatggacatagtttgtaattttcg

SEQ ID NO: 549 - DNA, 1501 bp, Oryza sativa
cattggcgcccggttgacgatttcaacagcaacgatcgccatggggcagctcttgccatgccatgaccattggtgccgccactctgtttggccacgccactgctattggcatagtcaaaaggtttagttttgaaaatatttttccgggtggtctcttaataaaattatatttttaaaaggtctaacttataaaaaaaatttcgtcatgatgtgaccggaactctaatgatctcgcgtgatatggtgattagcagcagaaggagctgggctcttacagcgatgtcaccctcccgttgctgcacatgacgccgtcccacccgccgccgcaggggtcgccggagttccagctcgacgggtagttcctccattgctgcatcagaccccgcagcgcgtcaactgccccaagaatatttctccaaggattagccgagagccaagcagtttttgcttttcgccggtagtgagtgctgagagatcaactcaccgtccactccattggtctcgcagaaccccgtcggcgttgtcgccgccagcagcaacggcggcgccgccccgcgccgccccgtcctcgccattgcgcgctagagcgcgtgaggttggggaagacgaagaactcagggaagaagcggactagagagagagagagagcccacggcttgcgagagcccacgcgacgctgtatatactgggccggcccaccaaccagccgcgggggacgcgcgtgttgggaattttttttatttttaattttttttattaaaagttttacaaaaatagttttccattttgaaaattgacggaagtagtcgcctaccgccctctgggagggcgatttttaaaaatcaccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 550 - DNA, 1501 bp, Oryza sativa
actgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggtgatttttaaaaatcgccctcccagagggcggtaggcgactacttccgtcaattttcaaaatggaaaactatttttgtaaaacttttaataaaaaaaattaaaaataaaaaaaattcccaacacgcgcgtcccccgcggctggttggtgggccggcccagtatatacagcgtcgcgtgggctctcgcaagccgtgggctctctctctctctctagtccgcttcttccctgagttcttcgtcttccccaacctcacgcgctctagcgcgcaatggcgaggacggggcggcgcggggcggcgccgccgttgctgctggcggcgacaacgccgacggggttctgcgagaccaatggagtggacggtgagttgatctctcagcactcactaccggcgaaaagcaaaaactgcttggctctcggctaatccttggagaaatattcttggggcagttgacgcgctgcggggtctgatgcagcaatggaggaactacccgtcgagctggaactccggcgacccctgcggcggcgggtgggacggcgtcatgtgcagcaacgggagggtgacatcgctgtaagagcccagctccttctgctgctaatcaccatatcacgcgagatcattagagttccggtcacatcatgacgaaattttttttataagttagaccttttaaaaatataattttattaagagaccacccggaaaaatattttcaaaactaaaccttttgactatgccaatagcagtggcgtggccaaacagagtggcggcaccaatggtcatggcatggcaagagctgccccatggcgatcgttgctgttgaaatcgtcaaccgggcgccaatgtggcagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaa

SEQ ID NO: 551 - DNA, 1501 bp, Oryza sativa
gggtttggctcgcgtgctagtggtatgaatcgagtgctcgcgcatggacgccttcggctgcggcgagctcgatcggccaggcgctggtggttgtggatggcctgacgctctacgcgcgcctcggcgccggcgccggcgacgacctcctctccggcctcgccttcggcgcggccgacgaggctctgctgaggatcaagatgaacaccatcatgtcatgccggccgccgctggaccaaggtgatcaccttctcctgcaagctgcacgccgcggatgcctgtggcggagcgaacagtggacacacaagaggattcttctgcacggacaccatcttctcgttcgacggcaacacattctgggcggatctctcgcagggcttcatgtgctgcgacaccgccatcgtcttcaccggcgacggaggcggctcaccaccacccgtcgatctcaggtacgtcagcctccacccggacagtagcggatccaaaaaaaaaaaagcaggtggggctgaataaattagataaaatttaaacctccattttctatatatgtggagcaaatagttgtagaagagctcaggtggggctcccacattcctaacgccagtagtgagggctgagatcccttagcggggccctatgtcagatccgcgtctgccccgtagtacctacttctccacaccttcaaatccgagaagcttggatgtatggagatgcaccacacctaggcatcttggacaacttcatcaaactcgtttccgttaacaccgcccgcatcgctgttgccgctgccacaacgaaagaagaagaagacatgccatcgtcaccgtgccacgccgccaccgaagcagccaacgcgacggtggccatatggactctggacaaatcagctgatgagacttgagacacgctcgacatgaggagcttatgggcgtaggaggactacaagacgtcacggttgccccggatggtgctcacgtggcccttcgtgaggctgcgggaagatggtgttgttctctacttcttagggcctgtttactttgttgccaaaaaaaaccttacaaaattttggcaatgtcattttggcaatgccaaaattttattaactatgccaaaattttggcaggatttcttatatagttatcaaaatttggcagcaaactaaatgtagccattttttggcaactttaccgaaatttggtaaggttgaaaatggcactaaagtgaacagcctaagccgctcaggacataaaatgacccccaactatatcacgtttgcaggattgacatgcacagcaggagagttctgctgtcggggctactctctcaccgctcccatatcattcatcaatcggttgccttgcctgctaatgtcttccaacatcttaggatgatccaatgagaagccacccatgtggtttccgcggagaggtgtggctctcggtagctgtcactattcgccattgtatattgttttttataatggaagttttattatctcagtaaa

SEQ ID NO: 552 - DNA, 496 bp, Oryza sativa
atatgttgagttgtaagttaccagaaaattacacttgctgcagtgtgggcaatgtgaagagcccctttgggacctggccagaaagacttccagaaactattgaactgagtgatcaaaacatatagagatgagtatgaaattgtcatcacaagacgacacaaaatttaaaattccaaaagttttggataactcacacagaagcaagagatgttaaagatgtgaaccagctgggggccactgaaggatcaaatgtgttgttgctcaaatccctggcaattcaagagtggaatctttagttatgcagacaaattatatgattggatgatgaggcatgggggtggttagtttcttacacaacattcaagttggtcatgttgctgagatctggcactgatccagttagcttgttgtttgctaagttcctgcagaagataacattttcaagagaggtgcctcaagtgtcataactcttcctttaagatcagatgtcacttac

SEQ ID NO: 553 - DNA, 1501 bp, Oryza sativa
tatttgttcacgtttttcacttacttctctcgtttttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtaggagaacgaca

SEQ ID NO: 554 - DNA, 1501 bp, Oryza sativa; identical to SEQ ID NO: 553

SEQ ID NO: 555 - DNA, 1501 bp, Oryza sativa
gagggatgtggggcccacgtgcagtttggggctaacggggatttttgatggaaaatgtgatgtagtggcatggttccaattttcctagatttcagtagtacgtagccgatatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacgatgccgtcgtccgctctccccccgccgccaccttccgccctccccctgccgcctccgtgcgccatcccaccgccgccgccgtcgacgacgaccctcctcccctccctctccctcctgcccgtcggagctcggcgccccctcccccttgtactctctcccttgtggcggcgtctgtgcctgcggcggtgtcggagtcggcgccggttcacccctattctcactcatctcgttgcgtagttcgacccggcgctagccttcctccctcttcagatctggagcagcaccggtggtgacggcggctaagaaggaggtgttacgggcgggacgagtaggacaggcggtggggagtgggacatgggacgggcagatggcccggtgcctcctcccccttcatatccccctaccttggcggcagagccggcgtcggtgctcccttcccctttcttctcccgcatcctggccgcctgctcctcctcccgtcctcacctctccacaacgccgccctccccctgcgtctcctccaactcctgccgctccgcctccctcgcacacggctcctctttctcctttcgagtctacgtcaaccacccgctcctcccctttccattcttgtcgttgtagccccgtggctggcgccacttctccctctggatccggcggcatccccttcgccatctacccatccctcctccccaccgcacacccttttcccctttcatccaacactaggtctcaggcggtgccttgatccctccacgaggtggtgtgttggcgaacctgctctacgtcgccgtgtcttcttgagccttcaacgaggaggacacaaatccatggcacatccatcaacgagggtccggtccatcttctcctcgtcgtctcagactatcgactgtaccttgcctcccctcaatcattctcctttcatctctcccatgtcatcctcttctctaaccatgatttgtttgctgtttttttaggggatgactggtgctgcagccatccgaggcacaactgaagagaaaattgtagtccgtgtggattgatgccaattgtatcgcttgcctcaaagagtaagtgcatgctcttgttggcctcaaaattctcttttgaaattatgaatctgggaatgggttcatttaaaaaaaaagatgattctggcaatgaatgcatttttttttactaattgatttgtgtttgcatcttggatttagagacagaataaca

SEQ ID NO: 556 - DNA, 1501 bp, Oryza sativa
cattaaattgtgacaggtgaaagctcttactagtggtcccaggtgtcgacatatgccattggcacacttctaatgaggcacctcttcaatcaaccgaatcacagaaaagagcaatggtgcaaaagtacagtaggtgaacacccttaataaattgcatataaggtataaggcaaaatgataacatgtaaagaactctgacagacttggttacaggagagcaacaaaactaagatcagagtatctacagtacaggcatccttaagagccaagcaagaagcgctataattagtattgtgctactgttttagaaacaaacgaagggggaaagggaggggctagacctgcatacatttccaaacagatcacatctagcttttcatgtcgaacttagataagaagcacgatggaacaaactatctgcctctactggcaaaagtactgaaatgatgatagttgtgaaacatatacagaaacatagtacctaagtactgtttctttgactggtgatgattacaatcaaagagatctggttcaaaaggagcttatctcacataaaaagcataagcctcttggtccacagttctctggactgaaatgtgaatatgtaccaatcttaggaaaggacgctgatggaacttatgcttgttcatattccatatgctttaaagtagtaaaggacagaataaaattgacagaatttatgtttatgtaggatgtccttacccacaaggaatctactaccataacattaagtgtcctttttttcatttaaacaaaatatacacataccaagtaccacccagctataaacaactaaacattaaacaggtaaaacaaaacaaaatgcaacagtttcaaaatactaactaaataacaatccatcagctatgatcatagagtactcaaataatttcatctagtgattatctttcacactccaaatagatcagatagcagaatgatatgccagaaagcaacattcaaaacaataatttgttccaattgtgagtccttatcactatagtatatacatactttcagtgatttattcataaaaagcatgaagaggaagagaaaaatggtttattcataaaaagcatgaagaggaagagaaaaggttagtgcatttttaaagactttttttttgttttgggggggggggtggttaatttcagaggtaactataaggacagcaccttatgttagttggcataaaaaatattcgatcattgtttccaagatgctagattctatgttgccccatataaggaacccctcacaacaaactgcttatcaacctgagaagaccaaaagagtatcaatagacctaggcttggagaagagtgctggctttggcactgccaaaagagaagcactcataacagtttcgacgtgtgatagcaaagagaagaaacagactggataacacaagtaagaaaggatagtgtaaatgcttgcctctttatgtttccattcttctaaaagtgtgtattaattttgc

SEQ ID NO: 557 - DNA, 1501 bp, Oryza sativa
gaactacgcatcctactcctacaacaaggtgcattaatgtgagctagctagctagatagccacaactcatatccttcatgcggcatgcatgcatatgccatcatccttgaattgcgttcgatatattattgctgttttcttgaaaacttatactccatatatattattgttgttgtagatagacatggataaaatgctcttgcaccaaacgtcatgactcgggatacatatagtgctcaaatatgaatttcgcaagatgtatagatttatttatttcttcaacaaaaactggaccaaagtttggatatgcgtgacatgctttttaaaaattactaaacgatatgtttcgtgcgaaaacttcctatataaaagttgctctaaagtttggatattttacaaaataaataactaaaagtcaattaaaaaattaatcatacgttgataccatatcgttttgcgtaaaacacttaggccgtgtttagatgctgtaaaaaattggccaattttttttgacgtatacggatatacatttgaagtattaataatgtaaactaataacaaaacaaattataggttccgactataaactgtgagacgaatctttttagcctatgtgctaatcatgacgtaattaggctcaaaagattcatctcgtgatttacagccggactgtgcaattagtttttgtttttgtccacatttgatgctccatacatgtgtctaaatatttgatgtgacgaaaaaattagaagttcgatgaaaaaaagttggaatctatacacaaccttaatcttaatcttcatccttatctatatatgaatttcaaacaccaccatggtgttcgaatatgaatttcgcaagatatatagattttatttatgacgtactacttgtacgttcgttgagcgtgtattaaagcccgtttagttccccaaatatttttccgaaaaacatcacattgaatctttagacacatgcatgaagcattagatgtagataaatgaaaaactaattacacagttagggaggaaatcgcgagacgaatcttttaagtctaattagttcatgattaactataagtgctacagtaactcacatgtgctaatgacgggttaattaggctcaaaatattcgtctcgcggtttctagacgagttatgaaattagtttttttattcgtgtctgaaaaccccttccgacatccggtcaaacgtccaatatggcacccaaaaatttttatttcctcaactaaacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattttcgattcctctcctctcctctccttccaccgcctaacgaaccactcgccatcaaagcccccagagagcgcgccatggcggcgcagcggcggtggccga

SEQ ID NO: 558 - DNA, 1501 bp, Oryza sativa
gctctggagctcgcatagagcaacaaaattgacagtctcatcccatttgaatcccttattgaggttgccctcgaggtaatcccagaaaggcaaggaacaagagaagaggtggagctcaaaggtccatttttaaggtcaggcttagagtgcaaagaagaatggcaaactaaggtaggcacggactcaggcatgaccaaggttcgttattatccctcttttcacatttgtttgttctcactatattgttcgcctgatgtgttgatgtgctgctgttcagactttgaacctacattttatcatctgtgagtgggttttgtttggctgtattttgtgaatttgtgatgcagtagttgcaacttgtatgcttgccgaacggattttgttgctatctgtttttttttcatttttcagaaatttcgcccgcaattttcaaatttgtattcaaattttttcaaaaaaattcgtccaaaatttccacaatatttctaaaatttctgaaattttagaatttcggtgaccccatacaaatcagtaaacccacaggtcgaaccctgcactccgggagggtatatataatcgcaaaattcctagtgaccaccgacgcgtaccgcacatttccggggcccacctaccagcagggccctccaacctgcccctccacgccctcaccacaaacccacgtgggccccacctgccggtgacccagcccctccccctccccctcctatataacctcctcccttgcgcgatttcaacgacctctctctccccatctatctcctctccctctccgcccatttctcctctccacctgcgatccatccgcgcccgcgaggaggagggagccggacgccgccgcggggagagcaggggagagaaggagaggaggagatcgccgtcgccgtcgccgtcgccgtcgccgatctcggtaaccaccgcccccgcgaaattcccccgctggtcgtgttcgatctcgctggttttgagtggaattctgcgtctgcttccgatccgatcggttcggcagcagctggtttggtttgattttgatttgatcggtagatttgggtgtgtgtgtgtgtgtgcttgttttgtgcgatttttgggggtgggtttgtatgggttggggtgatctgaaggagatttgattggttaggttttctcgctagattcgataggtttggggggggggggggatttgaattgattcggggggaagtttgacccggtttgaccggctccgctcgatctagcttcgttcccacgcttggtgttgggaggaatctgggtgggcgcggggaatcgcttcggttggccgcgaatccgatccgatgccgcgctttctgcgtgcccttgctcgcagatctgcgggctgcgggcttcagatctcgcggatctagctgcggttgctttgattccgctcgtttttctatcgagaccctgtggatctacgggactgactttttttgtcttcatttcgttttcagagcgggagcggaga

SEQ ID NO: 559 - DNA, 1501 bp, Oryza sativa
ttgagacacgctcgacatgaggagcttatgggcgtaggaggactacaagacgtcacggttgccccggatggtgctcacgtggcccttcgtgaggctgcgggaagatggtgttgttctctacttcttagggcctgtttactttgttgccaaaaaaaaccttacaaaattttggcaatgtcattttggcaatgccaaaattttattaactatgccaaaattttggcaggatttcttatatagttatcaaaatttggcagcaaactaaatgtagccattttttggcaactttaccgaaatttggtaaggttgaaaatggcactaaagtgaacagcctaagccgctcaggacataaaatgacccccaactatatcacgtttgcaggattgacatgcacagcaggagagttctgctgtcggggctactctctcaccgctcccatatcattcatcaatcggttgccttgcctgctaatgtcttccaacatcttaggatgatccaatgagaagccacccatgtggtttccgcggagaggtgtggctctcggtagctgtcactattcgccattgtatattgttttttataatggaagttttattatctcagtaaataatataaaattattccgagagcatctctggcgtatgcacccaaagagtgcacccagccaacaagaaagaaacaaaagataatatcatcatccaagacaaccgaaaaactttaggaactctctaaccgtagcctagaactccacccatgtgctagggtagaaaactccatggccactaactccaattattggcaagccgcagtgatggtacccaacaaattgaccttctggagaatagcccatgagtagagcctatatgtagtaaaaaaaatataacctataacagagaagatatgtttttcatttcaaaacccacatcatttttgcaaagccaaatagatcaaatagtggcagttgccccaaataagaccaaatgcctcaaattgtgtagttgtcttcttatgaaatgcccaaacatatgagttatactattaggtaaactaatattcgaagcagattggattaaagaccaaaccgcgcaagataatcaaagaataaatgattaatagtttcatctttacgacaaaaagaacaagttcctctcccattccttttaatcagattatcttttattaaaactactccctgatataagtaccataagaagatcttaatctttaatctttatggggctttaatcttccaaattctttaatttatattgggaacatcggtatgcaccaacacaagatatagagatttaaccgaaaatctgtcatcagtggttagattccatttaaactcatcttggttgtgagaaatataatattagcgatgtgtgagagaaggtgattacacgccactaacttagagccagtaaggtccctgcgctaagaaaagcttagcagactagtatggaaaatttctgaaatagttgcatgtttatgcctaaca

SEQ ID NO: 560 - DNA, 1501 bp, Oryza sativa
gacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttctagtgagccatgccacttgtcgccgtacgttcagttggtccacggccactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttccttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccacaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaa

SEQ ID NO: 561 - DNA, 1501 bp, Oryza sativa
tggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatggttgattgtttcagactaacataatcaaatggcttaggataagagatggctagtaaatacagacatgcaactcatttatccaatggttgataatttcatactagcataatcaaattagttttgattcactcatgatgtaaatctaattaaatgtggagagaagggctagaaattactaaaaataaatgaggataagctactcctttgtccagtggttgataattttatactatcaaatgacatagtatgactcatgatgtgtatctatataaaggcatagaagaggggtagggatacctaatgaatgaggataagttactccttgatccaatggttgatgtttttgcactaagataatcaaatggctcaggttaagagacgacaaataaatgcagatactctttgatccaacagtttattttgtactaacatgatcaaatgggtaaagattactcaacctaaacataggtggagaggaggggtagagatgactaatgaatgcaaataagtaactccttaatccaacgttgatatatttgtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcagcggcctgatggatcggacgaaccctatcactgtaacatgtatgcctagctatttcttttcattctttcctcctctctttaaatattttttcttctaaattacttatccaatctacgaaccaatcacactattgtattcgttgcaattaaatatttacaacaagatatcatataattatattatgtcaaaagaaaaacatgtgtttcaaaccgttaaaactaaatgtttcatgcgtgatagtgatatgtttcaatgtgcgtcttccgtgtgtttcataaagagcaatgctacacgtactaaatttttctgactaaacttttactaacaatcatttcaaccgtttgatttaagtagataga

SEQ ID NO: 562 - DNA, 885 bp, Oryza sativa
atgatatttctccctcattgaacgcctgagaggaagcattatctttttccaatgaaacaatattttacaatacgaataatacttttttttctccatttcattcaggaagaattcaagttatccttgccccccccccccccccccccaaaaaaaagtgggaagaatgccagtgaattagtgtcatgtgccaagtggccacattccaattcatgcgctcaatatcaactctgattactcctcggaaacgagtaatcgccagcttattgtcaaccccatgtttttttgccgtctccacgtgtttctcatgtcatttgtttagtctcgaagtgaaccatcatcaatcggtgctctgattatatgcaccagataatcggattccattgagaaaagaaatatcagtatatctagaagaatcatgcgttaaacgatatcaagaatcattcagtcaggacgacccggtttttcttttcacgcagtttggaaagatgatacatacaatctttcccatctagaaggaagaaataattattcagaagtcagaactcacaaagacccccggaccaatcacagtccgtgaaaattacacggctatggactcagcagcaaacgtagtcatcatctcaagcttccacgagtcaagcgtacgtgtcaaatccggcgcatgacagtgtcgcagccacgacagtggacttgctcggccacatgtataaatcgaagaccaagaccaggaacagcggagcaggttcgagctaggtggtgtgatccattcagacaagtaactaacaaaaacggtcgtgtccgttcgtgacatttgctatagctagctagctccagctcccatggcgacggcggcggagaacaagaacgagccggcgcggccattcg

SEQ ID NO: 563 - DNA, 1501 bp, Oryza sativa
cgactcgtcgacgcgagcttcacgagccgagctcgaattgtttgacgagcctgtctttactttctttttcttttggcagtgagtaatagcataccgagtagtactaccagtagtattcatttatcatgtcaacatcacctagctgcttgcagagtggagtagtactcctactagttagtagtgctaggagtagtactactgcatgtctgtcattacgagcgccatcgtcaccaaaatccaacagtccatccaagcaaccaatgcgactaagctcgatagcaggctcgagctcgagcgagctcgagccgaacccatctatgagctcgaggcataaactaggctcggctcgagctcgactcgaatatgtaccaagctcgagcttagatgggtaagctcgctcgagctcggctcgttgacagccctaactccacccccgccccggcgcttcggccgcaggcaaggaaaggcaagggatcacgagccacaagttgcatttcttccaccacttgttcagtgaccctgcaatcgaggtttcaaggtagaagagaagggaggcaaacaaccagtggtagagaaatgcgaagatccggtggaatgcggggatgtggagaagacatatgatatttctccctcattgaacgcctgagaggaagcattatctttttccaatgaaacaatattttacaatacgaataatacttttttttctccatttcattcaggaagaattcaagttatccttgcccccccccccccccccccaaaaaaaagtgggaagaatgccagtgaattagtgtcatgtgccaagtggccacattccaattcatgcgctcaatatcaactctgattactcctcggaaacgagtaatcgccagcttattgtcaaccccatgtttttttgccgtctccacgtgtttctcatgtcatttgtttagtctcgaagtgaaccatcatcaatcggtgctctgattatatgcaccagataatcggattccattgagaaaagaaatatcagtatatctagaagaatcatgcgttaaacgatatcaagaatcattcagtcaggacgacccggtttttcttttcacgcagtttggaaagatgatacatacaatctttcccatctagaaggaagaaataattattcagaagtcagaactcacaaagacccccggaccaatcacagtccgtgaaaattacacggctatggactcagcagcaaacgtagtcatcatctcaagcttccacgagtcaagcgtacgtgtcaaatccggcgcatgacagtgtcgcagccacgacagtggacttgctcggccacatgtataaatcgaagaccaagaccaggaacagcggagcaggttcgagctaggtggtgtgatccattcagacaagtaactaacaaaaacggtcgtgtccgttcgtgacatttgctatagctagctagctccagctcccatggcgacggcggcggagaacaagaacgagccggcgcggccattcg

SEQ ID NO: 564 - DNA, 226 bp, Oryza sativa
aaatagtctggaaatttgggctaaatggctgggcgtgacatcgcaccaccatacgcctctttgtcagcccccccctcccccccccccgggccaccttcaacacttcacctctgcacaacgacatctcacgacctagcatagctcgaccatcacactagtcagaactcaaaagggctagatccccctccgacccctctcgcacatgggaccactactccactcgtca

SEQ ID NO: 565 - DNA, 1501 bp, Oryza sativa
cgggaagattatgaacaatatccttcgtcagatgtgaaacagcacacacaacagatgagcctacaactgacgcgataaaagagggattaatcataacccagcccagcaaaaaaccgcgggaccttgagcggttgaggcagacgagatcatccataccacgcgtgccgtgcgctgcgtccattcccgctgctcggcacggcacgtcacggcacatcgctcgcttatccgctcctcccgcgcggcgcgcggctccgcccgcctcccgctgttcccgtgtgcccaaccacctgtggcgcccgtacgtgggcgagtacaccacgcttcacgcatcagctatgtcggaacaggccgcgcggcccccgcgccatggataaggcagacgcccccacccaagctcaccggcccgcgcggcgctgcagcgcgccaggtcgtccgtctttatccgtcccttgcctcggcaacttggtgcgtttcccgtcgttggcgtcaaggtagccgcaggtgcggtagatatccgaccagcgaagcgctccaatcgccgaacaatccggcggtaacgttaaatcgtagtaagaggaagctctcacggaggaagtggtcctgtcgaccgggtcaccgggagctcacagactcagctgatgtaatcgtggcagccgctttttatcaccgtgttgcagtacaatacagtagtatatacatgggtgtttgggagagaggggctaaactttaggtcccacatacaggctcgccgtggcataaacaaagagggaaacgcccaggtgtctcgccaccaggcgcgactcgacacaagcagtgatgcaagctgccccctgcttttcccccatcctctgctagctgtactgtgccgacttgcctcattagggaaagtgaaacaaaccacctctgattagccccaaagcaacggaggcacgaaggtttgactactacttttcagtatgactgtatgagcgagcctccgcccgccaccgataaaacttccgtacaaaaccacccgagacgcgacgtggcggcgggcatgcagcacccgcatccacgaccctccacgtactggccccgcgcgcccacgtaccccctcgcctcgcgccaaaaccacccacgctaacccgatagctcggcaaccaacaaagggatgctacgcaataccgccttgccttcctcctctccccgccgaaacccaacggcgcttctcgccaagccgcgcttgctataaaggccactcgccacccaccacaccgggtgtcacctcaaagtacagtttcctcttttttttttcttcggtggtgttgggagtggacaaggtagtgtgagtgagtagtgagcaccatggcgagccgagagcacctcctgctcgacccggcggcgctggccgtctcttgggctgaccccgctgcggtggagatcccgcccgagctcctcgccgcgctgggtgagtacctgtccgccaggcgtagcgacggggaggccgaggccgacgccgagg

SEQ ID NO: 566 - DNA, 1501 bp, Oryza sativa
ctcaactttcaaactcaactcgagagtcaagacctaaagataaccctaatttttcaccttaaaaaagtgttacctcttgatgctcaaccttatttatttgtacataaaggcactccacaaaagccaaaatcctacttaaattaggaatcctacttctatatatagaaaagcctcccaaaccatgtattattttatctctttgtaaattcaaaccctaaatcctacttcagctagtactcttttcaactttgactttttcttttatctacacacatctcgcttatgccaaacaaaaactccatctccagtttattgttcaatctttagccttagcatattgtataatcttcttgatcgttaggacaactatacttaagtcaattccaatccaccatagacagttctcagccttaagcaacacttatatatgggaaacgaagaaaccatatccgactttcctaacttaaactcacattagcataaacacaatacacatacgaaataattggaagccataaacatcacggaattaacataaaaaaataactcaaaatccaatataatcaagaatgttctggtctaattgcacctcagccatcagttcggccgcccatgcgcatccggtctaatcggacttaagctctggttggaccacctgtacaccgacccttcaccaacacaaccacaacaattcaacaatcggactaaccatcaccatggccaattgttcatcacgacatataactcaagacaatgattcctacaacgatttcacacacatatgtacacaacaactccatcgagctggtgggtatgagcatctccaacagtctcttcaaatttgactctaaatattgatttggccagtttgtcaaaaatttggatggccaaatttgtatttcactccaatagactctctattacactgtccaacctaaatagtgagtcccatatgttaggctcactaccctttttcaacccctcctctccctctctcctattcttctcctctctctccataccaccgcctctctcatccccaccgccacactgccacccctggtccccgcccacgccgccatagcattccccaatgcgctcgaggtcggtgcacccgctgcctccaacgaggtcctccgatccatatccgtggacgccgacagcgaagttggcggtggggatggcggccccgatgacgatggtggcggagaggtgagcacgggaggtggtgaagatgaaggtggtggcggatggcggcccagacctcagcgacgataggcaactgagtggatggcgatccagaccacggcacaacggcggttgtgcagatggcgaacgaggcgagcacgggagatggcgcaagagggcagggaaagggagggtaggggcagcggggcggcaaagcttcggctccggctcgccatcctccctccttgctatcgcgccgcagtggggcgcctcccacttccgctttcctcggctacggcgacgggactaacta

SEQ ID NO: 567 - DNA, 1501 bp, Oryza sativa
tcaccttgttcatcgcctgctccgcgtacagcggccagcatatcatcggcagcgccgacatgatcgcctccagcgtcgagttccacccgcagtgcgtcacgaacgcgcctaccgcctcgtgctgcaccacctccgcctgtggcacccagttcttgaccaccatgcctctgcccttcgtcctctccaagaaccccgccggaagcagccgctccaggtccggctccggtgatgtggactgctcctccggtgggctcctcacggtccacaggaatcggtggccggagctctccagcccatgagctaactccttcagctgcgccgccgggaacgcgccctggctgccgaagcagaggaacacgacgctccgttgcggctgggcgtcaagccacgcgaggcacgcgtgcctctcggcgccgctccctaccttcttgcgggcgtcgaccagtggcccgatgaagtagactctctgcttgggctcgttgggcacgcagacaccggcggcgagcgctttcagagccttgggctccagccagtcgaagctgttcaccagcacgcccttcccttccatcatccgcttgaactggtacaacctgatcttggtcgtctcgctctccttgtccttcaccgtcgccagcatgtcgacgttgcggatcggcggaatgccgggaaatcggatgagcgccgccttatccatctccctcaacgacggcgcgttgcggtagtaatacgggaggtgggaaaagacggcgaggacgctggccggggagggaaagaagaagtaggcggggatggcgagctcggccgcgacgtcgagcgcgtcgacgcagaacatgtcgagcaggagtgcgtcgacggcgggcagcgagcggaggaactcgcggagcacggggttggcgagccggagcgtgtcgaggttgcgcttgacatggtgcgcgccggggtccgggctggccggcgccggcaggatgcggaacgtgacggaagggttgcccgcggcgaggcgcgccatcgcgtcggccgacatggcgtcgttgttgggcggatcgatcaccgcgacgatgacgccgaggccgcggcggcgcaggtgcttggctagctccaccatggggttcaggtggccgacgcccagcgacgggaacagcacaaaggtctttgtcgtcatggctcgctgctgttccgaacttccgatcaaacgggatgtaaaaaagacggaaacaaatgccctcaaatcggacagccacaagtatatatagaggggttgtatggtaagccatggtgagcaacgttgacacgccccaatgtgacctgcataaccaacacaaatttcacgttggctttataaagttttggaggaattatgaggactactctttcactaaagtcagcagttcagtaaactggtagacgaggaaggaagagagctcacgtctggcgtatactacttccttcgtttcacaatgtaagtcattctagctttttcatattcatattgacattaata

SEQ ID NO: 568 - DNA, 1501 bp, Oryza sativa
gtcggtgtacaggtggtccaaccagagcttaagtccgattagaccggatgcgcatgggcggccgaactgatggctgaggtgcaattagaccagaacattcttgattatattggattttgagttatttttttatgttaattccgtgatgtttatggcttccaattatttcgtatgtgtattgtgtttatgctaatgtgagtttaagttaggaaagtcggatatggtttcttcgtttcccatatataagtgttgcttaaggctgagaactgtctatggtggattggaattgacttaagtatagttgtcctaacgatcaagaagattatacaatatgctaaggctaaagattgaacaataaactggagatggagtttttgtttggcataagcgagatgtgtgtagataaaagaaaaagtcaaagttgaaaagagtactagctgaagtaggatttagggtttgaatttacaaagagataaaataatacatggtttgggaggcttttctatatatagaagtaggattcctaatttaagtaggattttggcttttgtggagtgcctttatgtacaaataaataaggttgagcatcaagaggtaacacttttttaaggtgaaaaattagggttatctttaggtcttgactctcgagttgagtttgaaagttgagagagaagtgcttggagacactttataaacacatcttgatgtaatataaagttgatcagcttattttgtcgagttgtgtttttgtcttctaccagttgtcttgcacgagcaccagcggttagactggaggaacactgactgtcagatcgagatcccatcaacagtcgaaccaacgatgtaaagatggtcagactaaaattccaacaccggtctaccaactttctgaagctagctcaaggaacgtattaatggatgaacaacccaacccttagggtccattctatattttagagctcggttctttcaacttaaaaaagatttttttttatgatctccttgttcaccttctctggtagtcttgcttcttatgcttaatcctacaatatgaactacatcgtgttaagtgattccatctaaaaacaatccactatttcccttaaattcagcatgtgctctgtgaagaggccaccaaccttgtttctccaccgttcccatatggtgatgaaatgcgcgattggagtctgtgttaatattatctactcgccgcgctcgatctcaatcccctttcagccgacgagcaggggcaatttggtctcatcaagtagaattccaacgaaaatggaattgaaaatgacgaaaatggagaaaatggcaaagtagctgtgatctcgcgctttagattggcattttagcgaaatgcgtttttgggatggcatttcagcgaaaccgctttttgaacgtggccaaatgtccattttctccatgggaaggggagctggtggtggcaggggagcgatggggcgaggggaagggaaggaaccgatgggggcgatgt

SEQ ID NO: 569 - DNA, 1501 bp, Oryza sativa
tgttttcttttaattttatagacccacttgcagtctataacatttctaccttgcttaggtggaactaggtgccaagttttattattcatcaaagcctcatactctatatccatagcctttttccagtttgtattttgcaaagcatcagttaaattttttggttcaccagtcacagtaagaaaggtattcttgtatttaactgtgccatcggtatataccttctcttttcgaatacctctttgcagacgagtagttgggcgagacggcgcttgagtcacttcctcccctgtcgcgaacggctcggatgcagagatgtgtgatggtgacgggacatcatcattgctggcaggcgtcgcggtggcgtgactaggttggctcggcgaagagctgtcggccgagtgatgcgtcatcacgtcaggagaggcaggaaaatgtaccacgtccagggatgtggcagcgccgggttgactggcagcggtatctgatgcagacggtgatgcagcggtatcctgatggatctgttcagccagattttctgtggcaccggaagaatcatctgcttcatcattttctgcagaaacaggctgcacattgcttccaaaaatttgattagcaggattaacaggaatattagccatattgtcatctagctgttgttccccaggatttgatgttggatttaggagatgtgaaggaagcaataaaatttctgaacgaagtctagcaccggcgtttgtgtgaagtttagcaaagggaaaatttgtttcatcaaagataacatcacgggatatatagacacgacctgtggagggatcaagacacttgaaccccttgtgtagtgtgctgtaccccaaaaaagtgcactgctttgatctgaactgaagtttgtgtgtattatagggtctcagatgtggccaacaagcacagccgaacacccggagagaactataatctggggtttgattaaacaagtgctcaagcggtgtgaggaactgaagtagttttgtaggtgtcctattaataagatacacagcggcttgaaaagcttcatcccaaaattttagaggcatggaagaatatgcaagaagggtgagaccaacttctactatatgtctatgctttcgttcagctgagccattttgttgatgagtatgtggacaagaaacgtgatgtgtgattcctatctttgtaaagaaggagtgaagtttttcatattcacctccccagtcggattgcatggctattatcttcctattaaacaaacgttcaacaagagcttggaattcatgaaacttttggatgacttcagacttatgcttaatcaaataaagccaagtaaatttactataatcaccaataaagctcacataatattgtttgcccccaacagaagtgagggcaggaccccaaacatcagaataaataagttccaaaggatgactcgacatactagaagatctagaatagggcaattgatgacttttaccctgttgacatgcat

SEQ ID NO: 570 - DNA, 1501 bp, Oryza sativa
acggccggggctacaaaccgtgtaaaaaatgaagggattatcttaaaaaaaactgctgcaagttaatggctccgaatagtttttttttgtcttttttgttttcgttggatatacttccgtatcggtttccaaaaattgtcttaattattccctccatatttattttgagatagaggttgtagctcggttcggatccgttttgtagcaagttacccggccggtattcaactgctcgctgtttgtagtaatacgggaagatgtgattttctttttaatctccaggataaaaatgatacagcggtcgagctttggttggaggaaggactacagcctacagggaaaacgccgtttgcctttgtccattgaatgcttttgttgtggtcggtcaccttcgatcggatgcatttctgattctttcttcttggaaaagaagggctaaagattgtcctacggggctcggtgctgtagtatgggacaaaggcagaggatgtgaacccgtatgactttatttctaactctgtatcacgatcaccggactaattgactttcccgactaataataaactctatcacgatctctatctgattcgtcgtgtccttattttactcctgtagacatcaccactgacggcggttcctaaaaacaatcaggcttgtgaatctcgaggcctaccggccaattaatttaatcacatctgttagttggtggcggcacagacgaacgactagaagccatcgatgtgtatcctgccttgcctgcgtgtgatgatcatactgtgatcccatcttgtgcagtactccatccgtttcacaatataatcattttagcattttacactttcatattgatgttaatgaatctagatatatatatttatctagatttattaatgtcaatatgaatatgaaaaagctagaatgacttacattgtgaaacgaaggaagtagtatacgccagacgtgagctctcttccttcctcgtctaccagtttactgaactgctgactttagtgaaagagtagtcctcataattcctccaaaactttataaagccaacgtgaaatttgtgttggttatgcaggtcacattggggcgtgtcaacgttgctcaccatggcttaccatacaacccctctatatatacttgtggctgtccgatttgagggcatttgtttccgtcttttttacatcccgtttgatcggaagttcggaacagcagcgagccatgacgacaaagacctttgtgctgttcccgtcgctgggcgtcggccacctgaaccccatggtggagctagccaagcacctgcgccgccgcggcctcggcgtcatcgtcgcggtgatcgatccgcccaacaacgacgccatgtcggccgacgcgatggcgcgcctcgccgcgggcaacccttccgtcacgttccgcatcctgccggcgccggccagcccggaccccggcgcgcaccatgtcaagcgcaacctcgacacgctccggctcgccaaccccg

SEQ ID NO: 571 - DNA, 420 bp, Oryza sativa
agtccaagagaaaacaaagacaactggtcgcttttgtcgagatctcttcctcccccgttccgttttttttctctctcttttcaaactccgccccctcctctcctctttctctcccacatcagcagcagcggcggcggcggcggcagagcgaagagctccacttgtacgcacgggaatccaatccgctcgaagccctcgcgccgtggagtgcgtgccggccgggcaggggcagtgcggaggcccgcgcgcgggtagctggcgcctggcgctgcggcttttagcatctggtgctttgcgcgttcgctggaagctttgcggccaccgcggccagatgcggttgattgtgttgtagtggttgggtttttttgggttggaacgccgagtcgccgaggaggaggaggaggaggaggggaaggggaa

SEQ ID NO: 572 - DNA, 1501 bp, Oryza sativa
cagtaatatatgcccgtgggcttgggatcccgaccacacatggaaacatggaaacagatagagcggaggcggatgcggtcacgtggacattattgtgctgcctcaacggccgtcacgcgggaatcggacacaggcagggaatcggacgcgggcgggagtcaaacttcctacgatttgctcacgaattcggacgacataccaagacaaaaacatttttaacttttataatagtagacggagaagagaatagagaggatatatggttaatcaacttaaaaaccgactcaaacacgaatgacttatcaaaatctcgataaaaaacatcttcaatttttataatagtagagaagagatatatagatatagattctttaatttttataatagtagagaagagatatatagatatagattaggtatttatagatgtcccgggatattattttagccgctcaaagtggctctcgtcagtggagcgtgcctgtagctgttttggtgcaaacgaattggaatagtaatggcctgggcttgaatgaagcaacgtgggcctagtgcctgccatcctggacatgtgaactgaggaacaacagttgggcccaaactgaggactctgcgtgcgtcgtcgtccgttaccgatcaggttttctgcatggctgttgagaaattaccggaaactatgttgtcttggtgatttttaaaaaaccatccgacaaatggataggcagttcatttagagcaagtctaatagtacagcccactactaactccaattcatttatagcaaatctaatagtcaattcatataatagttgcttactatactattaatatatggtccacctgtcatacattgtgtcttggagtccgcgctacagctggctagatatctgtagcccgctgtttttttctctcatcatttatctcattaaaatatgtttatagctgactaatagcctgctattgtacctgctcttatatctaattgttttttacaaggaaaaaaaatattcatgggccagtccagcacaggtacacaaggccccatcaatctcgcttccgccgcagcacaacaccgaaggcgacgcacgccgggctccccgcgcggccgcgtcccgcatccacaagtcgacaacagcaacggccgcccccgtcccactcccaccgacaccggcagtgcggcacaccgccaatcccaccacccacacgccacacgcccaaaacaccccgaatcgcacgccaaaaactcgcaatcccgccgtcccgccccgcgcccgtcgttccgttccgcctccgccgcgctgcccgcctcggtgcggcgtgggacgaaaattagaaacttccaccggtaggtcacgcccgctttaccccacccacctcgcctcgtccccctcctcctcgcctcgcatcccctctctcttttcgtgagcagggaagagcatcccctctctcttttcgtgagcagggaagagggggggggggggggggacgggcgggcgggcga

SEQ ID NO: 573 - DNA, 1501 bp, Oryza sativa
atgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcgaaatcaatctagggtttgcctcctactctgtgctacgccgtcgctcgtagactactccatcccgctcgccggcgtgcaccagcgatcgggagagcaggtctccggaacctctaccttcgacgtcttgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagt

SEQ ID NO: 574 - DNA, 1501 bp, Oryza sativa
atcaaatatgcgcaacatatcgaacacgtaccgaggtggtggaaagactggttgctcagcaggaactactcgcggttgcgggagtcgacgaaggcgcgcagcacgcgagcggagaggaaggcgagccgtagcgaacgaacagggagcagtcgcacgaagcgcttcccaaaaactttattgccgccttctcccggtgcaggacgtcgaaggcagaggttccggagacctgctctcccgatcgctggtgcacgccggcgagcgggatggagtagtctacgagcgacggcgcagcacagagtaggaggcaaatcctagattgatttcgcgtatgttacgtgaaggcggcggctcggtttatatagagataggtcgcttgatcagggcgcccgcacgatctctactccgtgtaaccgaaccggataagtcgcgcgtaacttatccggacttcacgccgttttcacgcaccggatttttcggaatgtttccaaaacaaaaacaaatccgaattttccgcagcaaaacaaaactgcaaaaggaggctgcatctgcgcaaggatgaggagcacgacgcgcctgcccttccctgccaggcgaggcgaggcgagcgcgtgtgttccccctcttctctccaccacacatgcttcaagtggctaggagggcatcctcccttttaaggaggtcctcctctcctagaataagcaaggtggtcctaaactccacatgcatgccatcccatgaggtgggcttttgtgattttccaaataattaatcttcgaatgggtcttagcccatctattaattccaacaatcccccaccaaatctcaaaatcccactgagatttgccttttcaaatgtactgtttatataccagcggttcgatggagaccgattaaggttgaacatccacctagaactccaaactacacttactcacaacttgaacaatggactacgccttgaattgcaagtctcgtgcaagcaagtttcactcagagtcttatctagtactataccgtctgtagactacccctcgggtggagcgtataagtcatactcctaggtctttagtaagcttcctagaagattcacccaaaatctccatagactgcgatcaatagtcaagcttacaaaggtgagttctttcaagaatgctctgcaggataacatcttcgctaattaaagccaacagaactcattaagccataaccaacctaccttgcagctcacgagagtacatgcatcttcacttagagagggtatagattggtactctcctctagtttactaatggtttgttcttcccaggttctaattcacgggatctccgatcacatagactgggttaccaccattgtataactcacatgggtctcaaacccatctccttcgatgcattgtctatcacatttcgtgatagtcccttcgtgaagggatctgccaggtttctagcagtttggatgtaatctaacattataaccccggagtttctcaatttcctaa

SEQ ID NO: 575 - DNA, 1501 bp, Oryza sativa
agtgggtatgtgttcacacttggaaggggcgccgtttcctggaagtcttgcaagcagaccatcttaacgaggtcaacaatggaagcagaactcgcatctttagatactgccacagttgaggccaaatggcttcgtgagctcctgatggacttgccggtggttgaaaaactagtaccagcaatcctgatgaactgtgataatcaaacagtgattattaaagtgaacagttcaaaggacaacatgaagtcatccaggcatgttaaaagaagactgaagtctgtcagaaagcagaaaaactccggagtgatagcattggactatgtccagatggctaaaaatttggcagatcagtttaccaaggggctaccacgtaatgtgatagactgtgcatcgagggagataggcttaagacccacttagagttgcacaatggtggaaacctgtccattgtgattggagatcccgtgaatttggatggcgaaacaaactattgggtaactgagagaagagacccaaaaatgagcttatcttcatgatgcacttctcttctaatctgtatggtaggatggtatacaccttaatgtgatccgagtggcttttcataaagcagagatgttggcctacagaacatcttagaaggaacacgcctatatgactccgactgctagtcacagtctatgagatctgggtgatctctagatactcatgaaaaggccaggagtatgacttatacgctccaaacagaggggatgcaaacgacagcccaataccagttaagggtttgagtgaaacctgaatcgcacaaaactgacaattacaaggcataatccattgttcagttatgatctggtgtaactcttttcctaggtggaagttcaacctaacagtctccatcaaaacactggtataactaacaggttcagttttgagaacatttcttgtgagccatgaaatttggtggggattgttgaaataaatgggctaggcctaatttaatttaattaaaatctcaagagcccacaagtaatgttagagagaataatactaccttgaaaaattaggtggaagaacctcaacttaaatagggtgatattggagattccctgttgaccggttgaggtgatggttggactgccacacgcatgcgcacgcgctgagtcggcctcggccatggacgtagcgaggcgaggcggccgaccgagccgagcctgcctgctgctcttccgtttccgttttgtaacaaacgagaatgaagtcaccattaaaaaatgaaattcacaacaaatgagagattcattgtgttgtaacctccacaacaaatgagagattgattgtgttgtaacatccacaacaaattagatttatttttgcggtaatggagatctctctctatatataacgcaaggcagaggctctcaaagtgtgtgtcttcctcctgtattgttccttagcgatactctcgttctgttcctgcgctgtctctttgtttccccggttctgt

SEQ ID NO: 576 - DNA, 1501 bp, Oryza sativa
tgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctacgccgtcgctcgtagacaactccatcccgctcgccggcgtgcaccggcgatcaggagagcaggtctccggaacctctaccttcgatgtcctgcacggggagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttacta

SEQ ID NO: 577 - DNA, 1501 bp, Oryza sativa
ggattcgccgccgccaccgccagattcaccgctgtcgcccgagcccgcctccggattcactgccgccgccctccccaccactggatctgtcgccgtcacccgagcccgcctccggattcaccgctgccaccgagccatccccgccctccccgccttcaccaccgccaccgccggattcgccgccgtcgcctgagcccacctccggatacgccgccgccgccgccctccccaccaccggatccgccgtggccatcgcttgagcgcgccgttgttcgtcgagcgagcgagcacgatgggcagaggagcagagcacgacgtgagcgagcgagcggggcgaagcggcacctcacgccgtgcgctcatcccaggtgggatgagttcgtccgccagatttttccggatggcttggtcccggatctgagaggaatattcctctctaggaaccaacccattccactcacccctaaaccaaacacctctaaaagtgggttcgtcccgtcccatcccatcccatcaaccaaacactacccaagagaacaagcaaacttaagcatgcacttatcatgcagaattgataaatgagaccatttactattcctgctacacatagtttccaagtaaaatttagaataaattgacaaaactcaaacactaacaagctatggttccatctccaagtaattgagttttcgcttgaaccgaggttttaaaacccaatacaaaaatgcaggtctcctttgcaacgctggtagttggttggttattgctggttaccagaacttactggaaatatttgaatccaaataatgtttaccggccagtgaccggtagccggacctattactagtcagtaaccaggcagaataaatacatctataagaaatcaataacattctaattcaaaattaaactattcaggctcattcggtccaatatcgaatgccaccagtttccatacccttactttgacactatcatattgttggctaagacatgatattatttctaaattctattcagtattctagaaaatgctaagcaagtaagcagtagccactatgtagaggccaagtaatcggactaggctgccacctagatagaaatatggctgaaaggaggtgacatctattcctaggtaaacaacctagttgtggagattatggataccccatacctacacggcatgtatagtccgactgggtatggggtgccatgtgtagatagaatatctttagaaggactcaggttaaaatctaaacttgtatgtcaagaaaatatccgagatcctagtcggttacgattgtattttatctgtaactacatattccgttagggatatggactgtattttgtaatacggaccccttcccctatataaggaggggtccgggtgcctctaggggcacgaatttcacccagatcatacgatcaataatatactcggcggatcaatccccggacaggagtagggtattacttcttgaataagaaggcctgaacc

SEQ ID NO: 578 - DNA, 1501 bp, Oryza sativa
gaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccggcgatgcgttgcggcggcagccagggtgaagccgaacggcgaccggaggcggaaaaaggcggccggtagggtggtatggcaggaaggtggttctggtggtggaggggaaaaatggatgggcggccgagcttgccctcgcggtggtaaagctaatggcggccgcggggtggctgagagcagtgaggtgtggccggaggcgacgaccggagtggcggaggatggtaacggcttgggtgggtggtggaggtgatgactcggccacggattggtggaacgaggcagtggccggtgctctgcttggagcggcgaagccgacactggcggtggtgcggcttggcggtggctagcgtggcgaggagaggcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtggcggcggtttttcgcgggacggagtgggggaggggagcggggtcgtgggtgacgaggtcccacggtcgggcaggagtggtgcagggtggaggaggtgggcggggaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatga

SEQ ID NO: 579 - DNA, 1501 bp, Oryza sativa
tatctatctattatctatctattatattattaaaacagctttgaaaagaggcatcacgttcgctgtggggctagaaattgccacattaatcggaaaaaaagaaaagaagaaaagaagagtccaggtagaaaaacaatttaaaaatagctgaaattcggaattaaaaataagcaatattgaaggaagtttccatataagaacccaatacgagattaattaaaattcgaaataaaaataaaataaaatctaaaattagaaaaaaaaaagagagtccaagtagaaataaaatttaaaaatagctgaaattcggaattaaaaataaggaatattgaaaaaagttttcatataagaacccaatatgagattaatcaaaattcgaaataaaaataaaataaaatccaaaattagaaaagaaaatgatagtccaagtaggaatacaattttaaaatagttaaaattcagaattaaaaataaggaatattaaaagaagagtccgtataaaaacctaatacgagattaaataaaattgggaataaaaataaaaataaaatccgaaattagcaaaaaaaaaacaaaagaagagctcaagttgaaatacaatttaaaattagctgaaattcagaattaaaaataagcaatattgaaagaagaatccatataagaacccgatacgaaattaattaaaattcagaataaaaaataaaataatatccaaaattagataaagtaaatgagatttcaagtaggaaaacaatattgaaacaactgaaattgaaaataaaaaataaaaatattaaaagaacataatacgatattaattaattttttttaaaaaaatctgaaattagaaaaaagaaaaataagattccaattaggaatacaatttataaataactaaaatttgtgataaaaataaagactattgaaataaaagaccatctaaaatacatgacgagataaattaagtaacatgcatataaaggagtagagtggtggcggttgatatgacataaaaaaattgttaatgaaacaccaaatagaatcctaatgacgactaaaaggaggggcgacagggaggccgtaaagcaaacgatcaaggcgattgctgggacttctagaaagtaaaaaaaataaaccccattgataatcatattcgatttttaaaatctcaatgataataaaaaggagcagcagcggacggggtgtataggagtatagttgcagagctgccgacggttgacgggacttctagaaaataaaaaatgaattccaacgatagttatgttcaatttttagaatcccaatgacaataaagagtaggcggcggacgggccgtagaggagcatagtggcatagtttgacaagacttctaaaaattataaaaaaataaaacccaacaagacaataaactctataaactacaaggttcaatttttgaagtttcggaacttctaaaaagtaaaaaaaacaatgatagtcatattcgattttaaaatctcaa

SEQ ID NO: 580 - DNA, 1501 bp, Oryza sativa
atagtaccagctaaatcgtgatggttgatagtacagcctacaacactctgcatatccatagtcaattactaataagtgtcacgacactaatggcatgacaaccatattatgcacttctctatctaattttaaaatttattgcagatgtatacacatgacacggtagttacccacagacaactcatgcacatatgtacgtattccatatgatatgaacacttgggactttacataattcttattcaaaaaatttacgtaattataatttattttgttatgagttgttttattactcatagtactttaagtgtgatttatatcttatacatttgcataaaatttttaaataagacgaatggtcaaacatgtgagaaaaagtcaacggcgtcatctattaaaaaacggagggagtagcaaaataaccatgctttactatggtaaaatcccgcgcttatttgatatatgttattcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttctcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaa

SEQ ID NO: 581 - DNA, 1501 bp, Oryza sativa
ctagagactgagggtgtgttgtgatggatgataatggatacaaaatgtatattcatagctctatgatatatactaccaacttaaaagtgtgatgaattttttcttcatctccgtagtggttccggtttagggaaaattggttatatagcatcgaaagtttacatttttggttttatagcaccaaaagataccggttcactttaatagcacccaaaattcattccgttcccatttttaacacttccgtcaattctcgaccgtttttcgttcgccttgatcgctattgacctagccacacacgtgatataacgtatctacccctcacaagtacaagtagaatgcatgtcaatgagggtagaaacatcatatcgtgtgcgtgactgggtcaatagcgatcaaggcggacagaaaacgatcgagaattgacggaagtgttaaaaatgggaactgggtgaactttgagtgctattaaagtgaaccagtatctttgattcttcaagaatgtccttacggatataatgttcattgtttagcccaccaaaaccaacctgacggcctgttgcggcatcaagagaagtgtattagatctagtctttcaatatttaaccttctttatcaatgtggttatttcctcttccaagcgtaacgacgcgctacaagaagaacacgttgcagaaaattgcataccttctttaaattgaagagcttggtgctataaaacaaaaaacgtgaacttttgatgctatataaccaattttgcctttagcttatgctcgattgagatcggtcgtgtcctcgatccccagttagaactacatttacttattattaatatttgatatatttctaaatattgtgtgaaataactcatattaaagttatatatataattgagtataatatgacttatttatattaggcatgattattttaaaaattttagggccccatcgaactagtccactgcctgtgtacatttctgagcgtacaaattatcgaacaaataatataaccccggcagctggtgggctctccactacctgttctaccgcagcaccggccggcaatctggcatcctctcaagcgaatgattatacgaacacgtcaaacaaactcaaaaatctcctggattcatttataagatactacaccataaagctccatcaagcaaagctaaacggcatcataaattacaaggccagcatcgtatgaaacgcaatccaaatcccaagatttaagaaacagattgttggacagaaagaggttgaggatacagacgaatgctagagacagttatccatgaaagagcgccatttggatctttgtagtaagcagcaggccgtccaatatacgatacccagtacctttcactacatggcaatacacgaaacaatgtaaaaatacacttgtatttatacaaaaccatatttatcatcagtctagtacatgtccaccaatcagggggtgcagctccgattagcggctcaagctaaggcagcca

SEQ ID NO: 582 - DNA, 1501 bp, Oryza sativa
ctttttttggaatgcaaacatcgtaaaagttctcttcgaactattgttcccgtaagctctagaagtacagaagtactggttttcgtagttcgtacagatatagtactaaaaacacactgggacggctgctgtcacagttttccttaatccttatgtctgtagaaaagatgctccggaaattgaaaggtatccaacattgaactagcagagaacgactgcctcatccagtgaaggagaaagacttggctgatggggaagttgtcaaatgacctgacaatacaaaaacacaagttgagcggcgttgatgaaaagttgatgtttagtagtttgtattttcattgtttgtaatcattctctcaaattctgccaaatggcacattttcatgcaatggaagacttggtctcatgttagtggttttggttagattaattgattaaatacatacccaccaattagggaagaactagtctaactagtggcccaaatgcttcagttaagctaatgctttccggtttagaccttgtaaaagaacattaagaaatgcaaactccttgacttttgcttccaggttaatttgggagcatgttcgttctaattcctattgattaccataacttattgctcgcatgcatgtaaagtttaggagatactgggaaaaaaactggccatattgactaaaagcaaaaataaatatactttttatattttcaaataattgactaaactcggtagagatatcttcagatatattggataagttcatccaatcactgaacagatcaaatgaatcatgatattatcttaaagaatcagaatcacagaaaatacaaaggtcaaatttagtggtgatgcactacaagcctacaagcatcccaaattgttgattcaattacagagacagggaggccactacctttgccatagtttctgacagacaatacatgaaacagaacaaattgacaagacaaaaacatcccaacaaaatttgccttatgttactatgtgcaaatacatacttcattttccatggacacacagtaacatacaaaaatgacaggatcatatgattgataataattcataagtagacaggccatgatttgattaaacccattttttagataatgtataaaatcgaacatttgcttcaacagaaactacaacataatttgaccaaacctggaagactgaaactgatactctgaaagtaaccccacaggggcactaccattggcatgatgcccttacaatatttctcacaaatcctctataaattctcacctttgccaaatgccaaccatcaagccatcaagcagagagcaagcagttggcacacagacacctgtgtctcctaccctaactctctcaaaccaaaacatcaaaaaaaccaagaaaaaagcacaagctcacacacaaacacatggagctcaacttccaagtgcaacctccagtgttccagctgcaagactactgctactactacagccaagaggtggcggc

SEQ ID NO: 583 - DNA, 1501 bp, Oryza sativa
tatatacaacaggggcttatgtgaaaaaaagtacctcttgtgggtcccatctgctacctctctcctcagccacgccgtgctcctttccctcactcgccagtcgccaccctcgcggcctcgccgcgtgctcctttactgctctctgctcgcgcaggagggcccacctttcagcctccgtcacgtcaccggctccgcctcccgccgattccttcctccccgtggaagcaacccgcagcggcggcgacggcagcggcgtcggcggcggggacgaggtggggagtcgagaggaagagatggagtacaggagagtgaaggaccaggtaagcaccaaccccaagtcccgcccaaccctaatggagagagagagagaggaatgccactcgcgctgatgcgtccgcgcctccagattagatcgctgcaacgggtgttccctttttgcgattttcgctggcccttttctgttcctcacttagggttctagaatttccggattttcgggcgttttgcggctcttgatgtcagtgagacggtggcttttgtaatccaatcgttttgaactctgaaaaaaatgtagcaaatgaaacaggatagtgactactagttcatattgttattaacaatgtagcggtcattcaaccgcatttttagatttaagacaatttatctgattactggtactccctccgtcccataatataagggattttgagtttttgtttgcgctgtttggccactcgtcttattcaaaagtttttgaaattattatttattttttgtgacttattttattatccaaagtactttaatcacaacttttcgttttttatatttgcacaaatttttttaataatacgagtgatcaaacagtataagcaaaaactcaaaatcccttatattatgggacggaggaagtagtaagtagtaaagtgaccaatgcttaattcctgtattgtaaatagtaaactgaagatatagataacggcaagtttggtgattgtgatttgggaaactggtggtgctttcaatcacctgtcagtggccaaacctggcagatgctctgtggtttaaacttgaaattcgacttagatttgcctggtctttttagttctgttgatgtttggcaagcaggtgctgataatcatcaatctggcaaatatattcaaccatatatgtttggagtcatgagcattgcaattaagcttgtacttcagctgttgttctgtttgctaacaagttatgtatctgctgtactgtctaaaggagagctatgatgttgtatctcagaaagacatagaaagccctggtgagaggtctctttctagcagtaagttgtcgattcctcatagaaactttttcttttgatatccataaccaggactccaatatccttatgatcttaccatttacagcttcagcaacctccagtcttagcacagcaggagcttcaaagggcaagaatagttggaagttaaagtaagacttaattattgcaatctttgtc

SEQ ID NO: 584 - DNA, 1501 bp, Oryza sativa
gggaagaagagtttaaagtcaatataggaatacaatttagacgtaactgaaattcgaaattaaaaattaaagaatattgaaagatgagtttagagtccacatagaaatacaattagaaataataaaaatttagaaataaaaataaataatattggaagaagatcatagagtctatatagaaatacaatttacagaaaattcggaattaaaataatatattaaaagacgagtatagagtctatatatgaatatatataatttacaaataactaaaatttgatattaaaaataattaataactaacaagtatataaaatacaatatgaatattacacattagtagttttgtaaagttattgcaaaatttaaaattatgttgtcattttaatatatttaaataatataatgagaaaatatatatactattatatgatagaaaatataatgatgctagccgcgcaatctgcgcaggccaccatgttagtttattatactgtgatatattacatcatccaaaatcacttatattatgttgtacatatgttcttaatgacatagaaatcaatgttgaaaaataaaataccatgaaaaacttaaaaatcaattttaaaattcaaaatatgattggaatgacaagatgaagagcaaacgataaaataagcccttatcgcgctctttttatgcggaatggttaaatacatgaataatttgagataattgtttgaagattaaaaaaaacttaatgcattaactattataaaagttgaaagaaaagaatgtaaaacatttttttaaagaattcatatatagttttttttaaaaataccatttagaagttcgataaagaatgtgtgtttgttgattattccactaggaaaaaaaggagacagtaaatcaacacgtgatttcttttttgttagccaaatgatttctacgttatagtattgcaaagacttctaaaagggttaaaaaaaggcctttgctagttgtcatgttaccgttgcttaagcgtccgttatagtcaacgtgtctaaaagaaactatagttctcacctctcaatggactgtgaacagtattctctaactcaaaaaaaacaagattcacatcgacagcaaagaacgaagcatgtgcactcgtggtgcacattgatgatgaacagctactacaaaagcctggaaaaaagaagaccaccacaaacttggccacggttcacgcgagcgagcagagcagacgacgacgatgcgagacgcgcgtgcattggccagagaggatcccaaccggcaagtcggcaaccgcaacgccccaccaccaaacccgcggaacccaacaaacggccagccgtgcgccgtgcgcctctccccgtcggtctcccccgccaacccgaccccatcacccctacgcgtacgacctaccctaacctgcccgcctatataaacccccgcctcctcctccacctccacctccccacaagccgcctcctactactactacccatctctc

SEQ ID NO: 585 - DNA, 1501 bp, Oryza sativa
tatagttaaatatattttcataatatagtaatgggttaaaaatattactattttttcttataaactcagtcgtactttaaatcagtttgatgttggctgaagacaaaacgatttatagtataatcttttaaaacggagggagtactaatactagtactaggggagtaccaacgtggaaagcttttgcctgcgcgtttgaaaaaaaaaaaggttggtgcgacgggcggacggggccagcggcgtgctgtttcggcagcgcaacgggcgggcggggccatgggcccatgcgccgtgcaaagcgcgacggtatgcgcggttaacgaaaggccgatgcgtgtttttatccacgaacggagggagttggtatataagcagccaagcagggcgacggcacaccgcccacatccacacacacacccacgattccccacaaactcaccggccatgtcgacgacctcgccgagggcggaggaggacgcgaaggagacggtgaagccgatcttcatcacgctcaaggtgatggaccaggaagaccggaggatccgccacaccatcaggatggccgacaagctgcaggtggtcatggacatgtactacgccaaggcgcccgatgtcacctacggcacggggaccttcctcttcgacggcatacggctgaagggcgacatgacgccgatggggctcgagatggtggacggggacactgtcgatttcttcccggttatgatcggcggcggaggatttttccaatgcaatcttcttcccagttctcactagtagtctacgactgtcgccgccgagcgtcgtagactcgtagttagaattgttcatcctctgcgatttgccgatcgtcgtagtttgcaatttgcagtgttttatttcctcatggcagcagcaatcgatgttaacattgaatcagttgttctgggatgattaattatggcaacagtagttgatcttggcaagtcactagcgtcatttaatccactcaattgccatgcaatgcatccgctgatccgccatagcctataggaaaccccttcgatgatatcaccgtgcaattactgcggcaacatcaaggttcagttctgagattacgcatatcgccagttaattaaaatcatgctcttacattggcatcatatattcatatatgctgattgaacagcaaaggaagagaaatattatgaatatggatcacgttgtattgagtcctcaggagttggtaactcggtatatatatagcaaattacaaggataaagataaggataacttcgagatacaaatcaatcctatcctagctaatggagtactatctctagttagaacttaacaatatactacataagagtacgtagggtgaaatccatggcaacgcaactactcagatagctacgcaagtacacctacgcagatagctaaaacaccggaggcgatgtacggctggtctggcatcccagcggcggtgaaggtggagaaggagaacgaatggaagacgcc

SEQ ID NO: 586 - DNA, 1501 bp, Oryza sativa
atttgcagtgttttatttcctcatggcagcagcaatcgatgttaacattgaatcagttgttctgggatgattaattatggcaacagtagttgatcttggcaagtcactagcgtcatttaatccactcaattgccatgcaatgcatccgctgatccgccatagcctataggaaaccccttcgatgatatcaccgtgcaattactgcggcaacatcaaggttcagttctgagattacgcatatcgccagttaattaaaatcatgctcttacattggcatcatatattcatatatgctgattgaacagcaaaggaagagaaatattatgaatatggatcacgttgtattgagtcctcaggagttggtaactcggtatatatatagcaaattacaaggataaagataaggataacttcgagatacaaatcaatcctatcctagctaatggagtactatctctagttagaacttaacaatatactacataagagtacgtagggtgaaatccatggcaacgcaactactcagatagctacgcaagtacacctacgcagatagctaaaacaccggaggcgatgtacggctggtctggcatcccagcggcggtgaaggtggagaaggagaacgaatggaagacgccggcgacttgggaatggaaggcgccggcgaccagggtggccggggaatacgtcacgctgaaggtgcagggcaccgacggccgcgccgtctaccgcaccatgctgcggacggaggagctgcagggactgatggacttctactacgaccgctcgcatggccgggtgcagcgcggcacgggccggtttctgttcgacggccgccggctgcgcggctggcagacgccggcggagctccagatggaggacggcgacgaggtcaatttcttcgaggagttgatcggtggcgccgccggatctggatgggatcccccatcgtcgatcctcgcgtagcttgttcctggtagttatggatttagtcttttagatatgaacactgctacacatactatttttttcttactaaatctttactaacaatcatctcaaccgtttaatttagatagatagaagttataaaaaatctagatacacttactggtggagaaaccatctttgatcggtcgaccaaattccacaatagtctcggttctatttaaaaccgggactaaaaacgattttttagtcccggttaaaaaaagtctcggttccatttaaaatcgggacccggttaaaaaagttttgatctttaggccctaaagataatttttagtcccggtttatcccctgtcagggggccgatgatatttagtcccggttcataataccaaccgggactaaagattaccactttagtctacatcctagttgctagtaccaaccggaagtgggagtaaaattcgcaaccacttcctcacccacagatcgatccttccctcttctcctcctcccccctctcctatcttacacagatcctcccctttctcct

SEQ ID NO: 587 - DNA, 1501 bp, Oryza sativa
ccacgtcaatgccacgtgggacaaaggccaggtcaacactgccacgtgtccgccacgtcagcgaaactgtcctctaaaaccactaagggagccaaattgcaccagttttgcaggttcgggggtcaagatttctggtattgtggctgagggatacgatttagattcggtggtcagttgagggagtcaaagtgatcttattccttttaatgggtttgtaagcccatccatccataagtgtgccactcgtcggacttcgattgattattcagttattttccatcatctcctccatttatgtgaagatctcccgcatacaaataaagttccaagtacaagtgaaaatagattattcttaaacaaatatgtatgcaggcattactagttcttatttattttagatatattgacaatcaaaattggtctataatgaccctcaacaataatttaatggatattagacatcacgtataacaattttatatgatgaaatagctcttgtaaaccgaaaacccactcgccatagcggtgtcgccgaatctacaaacactaaccacgccacaaatttctgaagaaaccttggcacccctaatgttcgagttcaatgatttgccatcgacatggtctctttctataatataccggtgactttaacaattgttctacgatataccattaggccggaccttcttttcaaaaaatacccaaaatacccttagagatatacaagataaacaattgatttatctcattagaagtttcaaaaaaaatatgaaaatttttacgtggcctccttacacaatatggaagtttctatacaagttgtaattttttttctggtatatttagtttttttaaaaaagtgtttttacgtggtatatgagagagagtttgcttatccaggagatgatagcataaaactatcttatgtagtgtgtgaaagatgatttatattaaaaactaataaaaaggtatttttatataccatataacagataagttatattttttttaaaaaaataaatgtaaaaaacttaaaactcctatagaaatttccatgttatgtaataaggaggccacataaaagttttcatattttttttggaacttctaataagataaatcaattgctaagcttctatgttcataagggtattttgggtatttttaaaaagaatgtcaatggcaaatcgttaaactcgaacaaacccagtagtatacaatagattatctcaactcgctggtagtacggtacataacccattaatatttctataagtacaaaaggctgtgatttacacgaaggcctaagtcaaggtctcctcgttcccctgaatttctctttcaaagcatgaaaggctaccgattcaatgaaactgtgaaacatcacaaaaaggaggctatatatataagaagagaagttgtaagcaagctatataattaagcaaactacaaagccgattagctaaatttctccagtccaaccagcttccatacatggcca

SEQ ID NO: 588 - DNA, 436 bp, Oryza sativa
ggcagatgagaaatatctcatatgtgttgttgtgtagtagtagtagtagtgagctccaacctggaagttttgactctaaattatttagtgttttcaatacattatcttgaataagtttaacaaattaaaaataataagaatgattggtaagtatatatatatcaaacatgctattatcatttaatactcagtaccgccatgatccaaaaaaaaaagcatcacatcaagcaaatcatgctccataaacaatttagtgcatgatgcatcattatcaaaaactatataattacacagttaataacatatctctgacattctgagctaatgagctatacctctgaccaactataaatacacctcgctcctcagagtccaaacacaactcacacacagctcgtattttcctagcccagtagcccactagccggcatggaga

SEQ ID NO: 589 - DNA, 1501 bp, Oryza sativa
atatataaactgtggtttaaatggaatttttagaaattattttaaaagcctacaagctaaactctaattttctaggaaaattttcaacataaaaatgagctacataaaattttattaaatactatgcttgttcctctattttctagatttttctgggaattatttgagcaagggaagtatttttaataattgaaacaacatttcacaaattgttttatttgaaaaagttcaaaaacctctcctttaggttattgggccgattttggcccaatactccctctttcccgcacggccgagccggcccaagccggcccaaaccgtcgccgccgccccctcctctcgggagaccgacatgtgggccccacatgtcggatccatccctaacctccagccgccggctcaagccgcccgagccgcctccttctccctccaaatccgcctcaatccggcctccttgagtccgattgattgaggggttttgatcctctcgttctcctctatcttttcccccaagtttcggagcaaatcgttgaggattttatccgaatcgagttcgtttcgattttatccctaaaaccgagtttggatttttcccgagtcgattcctctcgtttggagtccgatctcttcaatccaaggctataaataggaccacctcgtcgtcctctttcgtttgccccctatcccgagctctctagtgccccgtagcgtcgccgcatcgagctccaagtcgccgccgtcgccggccatcttccggcgtcgtcgcgccgtcgattccgccgtcgccgccgccttttctcgtcgccgttaggtgcgccgtggtgaggagaacctcggccgcccgtcccccttcgccgccgaccaccggagctccgccgtcgccgttaacccgagccgccgccgccgtcttcctcgtcgccggccgtcgtcgttcgtcgtttgccgttgtggtgagtaccatcgggttcgtctcgtcgtcctctacgcgtagatgtcctccaaatccccggccgaccgtcctatctccggcgagcttgctaaccctagccggccggccatggatgacgtcagcatgacgtcatcatctccttttttctttcttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaatttatggctgaagatgactttattttcctatg

SEQ ID NO: 590 - DNA, 1501 bp, Oryza sativa
tcgcaaactagtcccgattaaaaggcattatacatgacaacaaccgcccgaccagccgcatagtgttgtttctatttcaaatttatcatcatatatgtttattgtttaattatgcaccaaggccaatgatactttaaatcacatcaatcaaaacaccatgcgtatatttcccacgatacatgcatcgattaaaatatcatgacaattacatcattagcatgcacacgttctcctttgatatattaattatatttcgatgaaatccgtgtccatacggttatataaggatcaatttaagaaattttggattttattatattacgatcaatttggaaaaagggagtatcgatggaacagcacgcggatatacatgcaccaggacggatcaagaccttagctggatataaactgcgacaatgatagcgcaacaaccatccataattaagcggtcaactggacagataagagcaggtacaatagtaggctataagccagctataaacatattttaaagagataaaagaagagagagaaaagcagcgggctacagatcatgtagctagctgcagcacgggctccaagacgtaatgtatgtatgacaggtgggaccagttatttatagtatagcaagtaactattgtatgaattagctattacatttgttatagataatttgaagctggtagtgggctatactattaaacttgctccaacgaaaataaccaaggcgttctgagcaatttacttggcagcttgacctttggtttcttgggcgtgctggagttggagagcgcgcgcgtggtgataagcacaagtacacgataaatgagatccggaaaggaaattaacccaaacttccacctatgtggagattatgggtaccacatacccacatgacgattgacgagtatatccgactggttataggggataatttatacagatagaatatatttaggaaaagactcgggaattatgttaacttgtatatcaaggaaatatctcgtagtcttaattggttgcaattgtaatatatttgttagcctagttcgtaatgcatatgggctgcacattgtaatctcggctcatccccttatataaggaggggttggagtgctcctaggggcgtaacttttctcccggatcatcatatcaataatatactcggcaaaataattccccggacaggagtagagtattatatcttctaacacatccacttttttagcttgattgctatcccttttagtgttgccgaaattttgtttcgacaatctacatcataaattctctattcccggtgtagttccatccgtaggatgctttccatcattttcagtttcgcaaaatacagtctaaaaagaagagaaatttatttctagagctgtgctataaatttaataattagttcatcctctcaactaccaaccctataaattcccctccccaactcccgcgttcgccggtggctccggcccatgttcttttttttttttttaga

SEQ ID NO: 591 - DNA, 1501 bp, Oryza sativa
tactaagttattatttaagatgaaaacagttgactgttaacatatacatactgtatgatcagctcatcgcacctttagtagaccatatatgttaactgtgagagtagcttaattgtccatacatgaaatgcaatgtaagcatactattgatacaatgctaaatttcacagaagctgctaagtcatttaagatgaaaacaattgactgttaacatttccatactgtatgatcagctcatcgcacctttagcagtgaggtctgcagaatcagagacagggtacccgcgagcttgggatcaataactacacacttcttccccctaatctgatacacaggaaaagaatacaaacttttcagtttccaccgtcaataacacgagtatgaaaaattgaaaatgggatgttgagaaacgcacactcttgaggatgtttagcaggtccttctgcgactgctccctgcatgccaccagtcgaagcacatcaaacatacatgttgaaattcacagtcgaagcacatcaaacatacaggttaaaattcacaggaacaaacacaagggtaagcagatgagtggggatcatcacgagatacctgagggccgcgagattgagaggagcattgtcgagattggggatctgagccatagtcccccaatccaactcctcgttctcagattcagaatcctgcttacttcagagccgggccaaacctgcggcatgcggtttcagctaagggttaaggcgaagagaaaaggtgcggggtagagaggggatggaagagaggatgctgcgtacgggtgctcaccggcgacgaggatgcgggcggaagcagcaggtcggcggcgcccgctgctgcccccgggacggagatcggcgctgggcggcgccggcggggaacgagctggcgcggagagacgggggagtcgaggccgaggggaaggaaagggggagagagaacgagtctactagagaagagagaacgctgggctgtccagcgccgggtgctttctatagcccagtgcgtgatcacagtctgaatccattacaggccgaaataagtctatttggagtccctccttttccttctcatgattgaatgcgcctccccatctttgaaacccggtgtaaatcaactccttcaataatttgggaagcggtttctgctgacgtgataagttggctgtggttgactcactgattcaataggacccacatgtcagccaatcagcgaacatcatctctctctatatattcccctcctctcttttccatctcaccccgaggccggtagcacaaatcattctgaaaagaccacgagcaatcgatgttacatgcctcgccagtagtgacatggtcgtggatcccttggatgcgtgcggtaagcttgcagtgcacgtgtgcacagtctcacggtacaggacatcgtccatagttgccacctacgaccgggaagctttccgtaccggagcatgatgtcgtagagtagctttagatggtcaaggtca

SEQ ID NO: 592 - DNA, 1501 bp, Oryza sativa
ccaccgccctagcgccgtcgtccttctctccgccgcccgccgccgccgctccggtcgcagccgctagccaccgtgccgagccgcgccgtcgacgtcgtcgcgttcaccgtcgtgcgggtcgtcccgtccacccctcctccgtagcaatccgccgccggagtcccatccacgccgcgcgccgatgagcttcgccatggcaggcgccttcggtcgctgccctagccatccattgtttcccctccctctctaactcatcccttttgatcccctaggtggttccggagcccgtctcgccgtcgccatcgccctccgtcgctcgccgtcgtcagtcaacgtcggtgagacccctcctccccttcctccctctctcccgcgccgattagccgccgcgccgcggcctagccgcctagccgccactgtcgccgtccgtgtcgccgtgacgccgccgccctccgccgccggccggtcgcccgcttgcatcgccgtcgcggcgcgctgcgccgcagcgcgccacggccgctgggtcagcttgagccgtgcccgtgcgcgcccggccacgagccgcctccgccgtccgatctaccgggcggtatatcggggccgtccaaccccgccgcccgcgtggctgccacgtgtccgccacgtgtgcgccgcgtcagcgccacgtgtgcacaacgtggtgcgccgctcctccccggtccgtggacccggtccaccatggaccgccctcccgagtcactgccttgtggggcccgcatgtcggcgccgcccctccctctcccggtatttatttattacgcaataaatcaattaaggatgtttccgtttaagcccattcaagtctcagtaaatcaagaaaaatgtatagaatccattaaaaatggttttgttctctgtttcagtagtcttatggcctgtttgtattgttttctttgtatgtcgcttagattcgggctctcccaccgctccggtgtactttgaaataatcgcggaggttcctccagcagcagagcaaggtaagtcatgcttgtcacttgaacatgttgatcctatattacaaatgctctatcgttttcttttaaatactgcatcgttttataatgttactatgggatgtttacctactgttacagccacactaatttttgtaccatgctcctttgttagctttgggtataacatgactatagattggattagggattgcttagccatgcttagttcaactagcacacaatgggggaaatacattaatacatagatatcagattctagtaatgatgttggttaataccaccgctccggtgttggttaattaaaattaactaaatggtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtga

SEQ ID NO: 593 - DNA, 1501 bp, Oryza sativa
aatttaagatggagactaaccacaaaacatatatatttcctccgttccgaaatattcaacacttggttattttacacggtcatgagagccatatttcttaccatgatctttttttagcagagcaagaaatatatatttttatccgagtttggacgggtgtattttatttctaagaatgacaatgcaatttcatagcgtcccattagcatactatcttctaggggatgcgatgtagttacaagctcacgagccaagggactatgtcagttactggtttgctatatatctttcaacagatttcatctttaaaatcagacggaattttcaccattgattttacgtataagatccttgcttttctcgtttgatcacaaacagactgcaactgatagagagccatgtcatgtcctggcgtgcgtgcagcaaccagagcagggccaatcaggctggcaactggttaataagtgagacccagctgaaacagttacgtaataaaatgatccagcaaattaaagtatgcaatatgcctatttggtattataagtatacatgagcttaatgacgttattagaaaaataaattgaagccacatttcaaattacagtgtaatgagaatgttgtaagttattttaagctacgatgtaatttatataaaattacattgtaccttgttaatatgcttgtaactttttaaatctagaaattttaaaacaaaattcaattatattgtattttctaactaagatacttgtgtacgtctttatcctcttagtgagctttatattgttctaatagccaagtgtagggtggttttaaaaatccatgtgattttcccttgaaaatttcttgacaaaacaatacctagcaaaaaacgattttactattccgcttacaatagattttgggttaagtttcagtcgtagaatcttctagatgtgttattgcagaccgaacttatggttaaactcaattagtacaaaacaccaaaaataaagtttactactattttttctctatatttatgacattttaaatgtttatcatttttaatattttatttaaaatagactatgtttatttattagaattgtgttaagatttgaactccaaacctttcgacagtttaaaagaaatatatatccgaggctgtttgtttccagtcgagtcaagtcaccagccgcatccatgcctaacctaaccacctggcagaacgcctgttctactcgacgtcgcccacgcacacccccgacgcgcagaatctccgccgaagcccacgtccgcactcatcctcatccaggtggaaagcaaaccggcttccatgccgctccaccccccatcccagcacaccgcgcatgcacgcgtcggctccccaccgttctccacgcgtcgcgcatccacccggctcacacgtgccccctcgacgtgtcgcgctcgcgccgcgcgcgcctcgcctataagtccaacgctttgcctcgttctcctcctcgcgtcacccaccaca

SEQ ID NO: 594 - DNA, 1501 bp, Oryza sativa
cctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaagaaaacgatagagcatttgtaatataggatcaacatgttcaagtgacaagcatgacttaccttgctctgctgctggaggaacctccgcgattatttcaaagtacaccggagcggtgggagagcccgaatctaagcgacatacaaagaaaacaatacaaacaggccataagactactgaaacagagaacaaaaccatttttaatggattctatacatttttcttgatttactgagacttgaatgggcttaaacggaaacatccttaattgatttattgcgtaataaataaataccgggagagggaggggcggcgccgacatgcgggccccacaaggcagtgactcgggagggcggtccatggtggaccgggtccacggaccggggaggagcggcgcaccacgttgtgcacacgtggcgctgacgcggcgcacacgtggcggacacgtggcagccacgcgggcggcggggttggacggccccgatataccgcccggtagatcggacggcggaggcggctcgtggccgggcgcgcacgggcacggctcaagctgacccagcggccgtggcgcgctgcggcgcagcgcgccgcgacggcgatgcaagcgggcgaccggccggcggcggagggcggcggcgtcacggcgacacggacggcgacagtggcggctaggcggctaggccgcggcgcggcggctaatcggcgcgggagagagggaggaaggggaggaggggtctcaccgacgttgactgacgacggcgagcgacggagggcgatggcgacggcgagacgggctccggaaccacctaggggatcaaaagggatgagttagagagggaggggaaacaatggatggctagggcagcgaccgaaggcgcctgccatggcgaagctcatcggcgcgcggcgtggatgggactccggcggcggattgctacggaggaggggtgga

SEQ ID NO: 595 - DNA, 1501 bp, Oryza sativa
gtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgctttgaaatgcctgctttatgcaaaagaatccctagcttcctttggttatatcctgcatcatacctcctcttccggtatgacttgttgagtacagtgggtagtactcagtcttgctctcttttcccccacaccagagttgaagttcttctcagtggagccgtctcagagaggttggcttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctagacaggaatttaatgcacattcagcttagaaattctggttcgagaattttctgagtgtgacaagttggtatcagagccgaccttgaccgtaggacaagccaactagaaacctaagagccctctgaacccttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgccccgaccttcttagtctgtttgcttgccagttttcgtgtttaggtttgttgcttgtggattagtcggcggtcgatatcatatgtcagtggtatgactgcctcaattaggagttacgtgcctctttttcagtgttttaatcaagattaagataattacacttaaatttataagaaagattagtttctgagccccctgtttttcttccttttctcatatttctacctatccccttcaga

SEQ ID NO: 596 - DNA, 1501 bp, Oryza sativa
gccgaataaattccgaataaacttttactaaatccctagactgtccctagtcgagaaatccaattaaataagcgaccaagatttttcccacaaatcaaaagaacaaaccccaaaattttcccgaaacaaaatccaagtgcaaaagggcatatgcatatgaaaaaaaagggttcagagggctcttaggtttctagttggcttgtcctacggtcaaggtcggctctgataccaacttgtcacactcagaaaattctcgaaccagaatttctaagctgaatgtgcattaaattcctgtctaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaggtatgatgcaggatataaccaaaggaagctagggattcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataacactcccctaaccatccacaccacgctaaggtttcacccccacccctcaaaatgcagtgggcggtcccctcttgcgccgcggtgaatccggcagctggacaaccgaacacctcggccgacccaactccatcacgcccaccctcgccaccggtgcctaggaaagggtcgagctatactttagatcaagcagttacccactcccgcttgtggtaagcacagtaagtctcccagggtttcccgtgaaccggtccttaactgccatgggtgcgtccagcaaaaccatgcactcacagcttgccattcagaattttttaattaactgacacccttgcggtggcaccaatctaaagctatgccaatagtcagagtatatgtaataatgtgacccccatttgtgtactagttgaactaagcatggctaagcatttcctaagccaacatctagtcattttgatacccaagttatcaatggcataaggtaaccaatatgtggctaaggaacaggacccatcccacattacattgtaaaagaatacaaca

SEQ ID NO: 597 - DNA, 1501 bp, Oryza sativa
gcaccaagcaaaggataggctaggacagagaggatttactagtgagaaactgtgtctagggcaagcttaagtttaatcctaacgcaatacttcaggcactggcaacccgctgttcccagatgtcgctctactacatacccggatagggaggacttaactgatctcgaggactgtcaccacctctacacctacctcaaacgtaccgtgggatacacagcaattaatggataacaattacctaaacaccacgtctaagcaattaatatctattttagtgtttataactcaccaaagcaatcactatattttagttgattatagtgaacaataatctcgtatgctagttaggaactagccaatagataattctcacaagataaatctaaattactcgggaagataaaagaaatgagacaagattaccgacaactccggaattcctctgacttcttctactctattctcgtcctaattctagtatacaaatagtacttcctccgtttcacaatgtaggactttaatttctagcattgtctatattcatatcgatgctaatgaatccatatatataataatgtctagattcattagcatctatatgaatgtgggcaatactagaaagtcttacattgtgaaatggagggagtacaatagagcctcttataattcagctcaagctttgaagtgtgtgtgtaaaagtgaagaaagtgaagtctatttataggacaggtacaacggttatgacaaggggaattgtccgaaatgccatgcaactgccatcaggagtgcatctggaccgtccctaccaaatcccagtatcaacggtggtggtcagggttcggccaaacctggactggccctgctagcttggcctttggcccgtctcctcccctagtcctacttcatccatttctcggagttttgggctgattctccagtattttgataaagttcaaagcccatccttgtatggatatatttccttcttcactttagtctgattttcctcccaacttctgggtttatcatcttcatacaaatatacaccaatactcgtggagtatgtgagatttaacaactatcactatgttggatgttttattatctggactttatgaagatgttggtggtatagaatcggcattttaataaccgccaacacttgctttattgacaacatttacatctgaacatcgtattatttttaccaagttacccttgcttttgcatctaaataaatatttttttattaaagtttaaacacaactaatatatcaaaataagctagaaggcaacccatagttagatgagttgaatatagcctggaagcctgtataggaggactcactggtcttaataaatatatcagtgtagaagaaggcataatttgtattctggtagcaatattttatataattatattgaaatgtaagttcaccagtagtaactataattccaataatcttgactgttctgtagactggatgatataactatatat

SEQ ID NO: 598 - DNA, 1501 bp, Oryza sativa
ggttcccgtggaccggcgcccttgtgtcgctgaccagtggaccgcctcggtggtcccggtccactgtcggcgcgcacttcccctttaatgtcgtcagcagtgctttttcccttgaaaaaacaattaataattgcgcaataattcgataataattctagaaattcatttaaatggctcaaaacttctaaaattcatatctaattcattcgaactccgaattgggccattcaacttgcaaaattcatctaaagttgagctctacatatttgtttactttttatgtactgtttccttggtttttattagagtttttcctcgttttgcgtgccagcgtgtagtttccgtcgtgtcggaagtccgcggtcgcgaggaaaagagttcagaatattgtttgaaggagcaaggcaagtcacgcattcccctttgagcatgttgatcccaatttataaatgttttaccgtttgcaaataaatatgcatgttttgctaattacatgggatcagggattacctatctgctcgcttgtgccatgtttacttgatatctgtcctttgtcaacattgggtaataaatcgactagcttatgttacttatgtgacctagctagaactatatgctgagccatgcttaattaccactagcttagttgatgggataattgcagtattagaccttttagtatcatgatgagctgcgtgctcgagacatctggccatgtttcatggttgtaattatctaactaaaatacgactgaatggtgggctgtgggtgcatggttttgctagtcgcacccatggcaattaaggaccggttcgcgggatgcactagaagacatacaacgcttgccacaagcgggaatgggtaattgcatgacttgaagtatagcttttctctggctgacgcatccaggcaagggtgagcgtgatggagttcggatgggccctgcgacggcctatgcggctttctgattcgcctaggcacgagaggggactgcccgctgcctgttgggggcggggatgaaacctgaggtgtggtatgcttggttagagggggttagatgaagggtcttgtcacaatcacttgacatggtgacgtgtccggccgggcacggtgacatgccggtggattgtcttgtgggtacagttgtgcacctctggcagaatagtcgtgcccgcggttatgggcgatcgaccagattcaccgtgattagtttcacacttaataaatcgacccaatgcactgtagttcaggtgtgttggttgggcctgttcaacatggtgtagcgttgatcagtggagatttaatgttattttaattactcaagtgttttactattgtgctcaataaaatgttttacaactgcctttatgcaaatagcttcaagccattcttgaatccccatgcacgcctgcatcgttggtgtggcttgccgagtatggtggttgtactaagccttgctattatttcccccttttcagaagtgtagtgcttctgagctcaa

SEQ ID NO: 599 - DNA, 413 bp, Oryza sativa
agaggagatggtggcctggcggctggcaggcgccggcgacgccgagagggcgagatccagaggcgagccggcgagccgcccacgagcgcgcgccgccgcctaggtcacgcggctcacgccacagccgcacgggatgagtggatgacgggaggggaggggaatggatgtggggaggagagagactgagggatgtgctgcactgctgcagtgctgctagggttaaggatttttttagtgggctgggctttttgggctttctttgatctatattttgaggtctatatgtactccccggggccccgcgggtcacccgcaggtgaaatcagtcccccgtcccctccccgcccaaatgcggggccccgtccccgacgcacccacgggtcaaaaatcgcccccgcccccgcccccgtagg

SEQ ID NO: 600 - DNA, 1501 bp, Oryza sativa
taggatcttgtcattggcagcaagctttttgcttagcgcatcagtggttttagcttttgcaaaaactagatccttcaaggagggctggttagaaaagttaccgttgttgttacctccttgataatatgggcgtggctggctccatccctgacctccttgtggacagtacccgttgtttttgttgcccatgtacatcgcctcctcacgggtttccaggcagtcattcccagaatgacccgtgttgccacagacctcacacgtaatgtgcgaatccaaggccttgatggtgccttgtggtcttttctcgtggtcgtccaatcgcttcatgaggaggtctagcttggcagcaagcagttccgtctccttgacggtgtgcatgcctcgctgacgggtctggattcgttcctcgctccaacccatattggagaccatcttctccatgaaccgttttagagaagaacactcctctagctgccgcgtctaggtgatcgcgggacgtgggcgtgagtccattgtaaaagttctgcaggattagcgagtcgtccatcccatgatgacgacaggcggccacatattcctgcagacgttcccatgcttcaggaatagactcgtaccttgtctgctggaaactggaaatccttccacgaagggcattggttttgcccatcgggaagaatttcgagaggaatgccatagaacatttgacccaggtattgacagtagcacggttggcatagaaccactgcttcgctctcccgagaagggagaacagaaacagtcttaacttgacggcgttgggactgacgcccttgatggtgtacgtgctacagatctctaggaactgttgcagatgagcattggcatcctcattaggcttgccatagaacgggctagcctgcgccatagtgatgaggctggacttcaagtcgaaatccacgactcccatgttgatttgcggcccaatggccacattgtcagcagagggagcagcgaattcacagagagtcttgttagccatagtcttgaaggtcggtggcgctggtatggctagtttctctgacggtagagttttctatggagcagcgactcgcggcctaacgctccggaagaaagctactggatttttctttgaagttttccggcaagttgaaaccagttatgcactaccctgttttcacaacaaaagttaaaacaaccaaggttagactgcaaaggaaaatgattatacagaggtaaatataaaatattagttcaggtaatctctactatgaatcttccctggcaacggcgccagaaatgtccattggtatttcttaacgacattactagaaatataattcccagcagtggcgcagaaatactcctggtatattatggttacagagttcatccgcaagcgcacggatataccattctaacatttcacccgagagtattccaagggtatcgtatttattttatcccgtgggaagatcatgtagagataacttgactaataatt

SEQ ID NO: 601 - DNA, 1501 bp, Oryza sativa
gttgatcatgattttggtacattgtgatgttggacagggatgtggtgataaatttaatacagctatttcttaagacaattattggagacaatatatctttatgttaaaaaaaatggtaggatgcatggcagcctagctagatgattaatagtgaaggggtccagcaccacaataatgcgtctctacatattaatgcaaaaatatgtacactactaagggattagtgcacaccttttaacaaggattacctaaacaaatattatccaaattgtgctctaagtagcaaaaatgaaaattttttatatgtgtacatacatatgtaacatattttttacggtaaatacatatgtagcatacatagatccatcaaatccaaagcataaaaatgctagaaaactacaaaagcagggtaggaaagtatggatattatctttgacgtcaaaagacactacatattcgagttcaaaaagttcctcctatatattgcttattttataagagagaaagctcaagctaaatgagcagctctcgaggaaagaaaaaggcatcatagatcctttttagcatgcagccagccaccataagccgccgcctacagtaactgatcttcaaaggtgactggtttaaggtgatgcctgcggtaatgtatcttcgtagggagcacctcaattaatccacctacggtaatttatctttagaggcgaaacttcaaatgtatcttcccaggtggcccttgtccacaactacgtagacgggcgtttgcggccgaaaatttgaccagtcatgctgagtaaaatagctcacctagtcgaaaatcatttttctatcggtggttgttactcctcggagatccaaacatgcataaaagtctgtgtctgaaagtcatgtcatcacgtatatatcacgtatacatatatatatgacatgcaagcagaacacggggtatacaatttagtgttgtgatcaaacatatacgaggcactagctagttagatcataaggacgacagaatgtttgcccctactagaatatatgatctcgcctcatcttttatttgcaccatgatactgccggtatagagcatgatctatttttgaaaaaccatgtattcctgtctttctgaacatcccaactgatcaacatgatcgccaatgttaagtccttctgacattctatctcagctaattgagtcatcactatccaccatttgaaaaacatagtgtgtgtatgctaattacctgtttcaggcgttgttagactatacaattgtttttccatactatatatatacactacggttgacaaagacatcccaacaactaaagataaatgacaaagtttttttccacaatcattactctctgtatatggcatcccaacaattgaagataaatgacaaaccaataaaccatttgtttttttccaccaatcattactctctgtatatatatagccttagtccgtatggagcacttgataagcttgtatgctaaatctcctt

SEQ ID NO: 602 - DNA, 1348 bp, Oryza sativa
catataaatgattagcaacacagtactatatatagccaccacatatgtaacaaagcatatatatttcagtgggtctcacaagtcagtaaataacaggggcatggcttaaaaaatgtcagatatagtgagcactaatcacatttgtttatgtttccatcaatccaaagaacacacatgtccatacagtggcatgatagttatggcatatgacttctaactcaatttaatcatgttagatactaaaattagttgcactgcagactctggcaatgtcctttatttgaagaaattatgaagttttggtaactatacatgctagcagaaaactagataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgattttagcattgttgccacgatttttttcgtagcaacaaatcattttcctagtagtgatagagaggtttacattttaaaagagagcgattaactttgcaaataaagtttaaatccaagttaaaagaaattaagagaaggcaacatcacttcaacagaagaatcgagaagagtgcaactaaaatattttgcaaaacattttccctgaaaatttgagtctgtc

SEQ ID NO: 603 - DNA, 1501 bp, Oryza sativa
cctaatggcggtggcggcaagcggcggcgacggcggagacggctgctcggcgcggctgcaacccggccggcagtagatcttgattttagaaaaatttagcaacttgaaccactcgaatcggatctacagttatttagttatgattttcagaagatttaatctattagaaaaacgggaaaaagaaaaaaccaatgatgacgtcatgatgacatcatcaatggccggcccgggttggcgacctcgccggagattggatggtcggctgcaaatttggaggacatgtacacgtggagaacgacgagacgaacccaacggtactcacccttgagccaaacgacgaacgacgacggccggcgacgagatgaacggcggcggcggctcggcttgaccggcaacggcgagctacggcggccggcgacgaaggaggaggtgcggccgggcttctcttcaccttggcgcacctaaaggcggcggcggcaagcggcggcgacggcgaagacggcgactcggcgcggctgcaacccggccggcggcggcggcggactatgcggcgtcgacggcgggctacggtgcacgggagaggacgggagagggggaaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggagaggatagaggaggataagaggaatatttcccctcaacaaattttgcaaacggagctcgggatgtggcggatttaacggaggaagcggcggctgcacagggcacagcaccggcggctcggctctgtccaagcttgaagatgaatagtgccagggaggcaaactagactttcggctgggcttctacttccaaggactgattaaaggagggaaataaagcagacttcgggaaagagaggaaaagggctgcaggctgagaggagactgggccgagagtgagaggacttttcctaattcggcccgaaaaggaaaaggtgaactttaattacttttccaattaaattaatcactgaaatgatctttgaattgttaaaaatacttccaatgctcaaataatttcaagaaaaatcttgaaaatacttggacactcaaagtacttaacaaaattataatcagaccatttaatgattaatttaatatttaaacaattgctgaactgctctttgtatgattaaaattaacaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatctataaatcctgaaacaaaaatcaggatgtgacaacga

SEQ ID NO: 604 - DNA, 1501 bp, Oryza sativa
caaacctgacctaggtatcgaatccggtactcataggtatcagacccgatacttaggtatcagacttggtattcataagtatcatactcggtacctgggtatccgacccgttacacatagatattggaacaaatactcataggtatgagatcagatacccgatacccgggtatccaatctagtactcaggtatcagacgcgatacctagttatcggatccggtacttataggtatcaggccggataactcagcatcagatcttgtatttataggtttcatacctggtacctaggtattcgacccaatacctagatatcagatatgataatctagcatctatgtatcacatactagagtttctaagatgtggtataactaagagcccaacatgacatatctaattagaataatccattgtatccatgtataatctaggtaattatttgtctggtctaatccgtgcatggtataggacacaacaaatagatgcaactcatcttagacacgtagctaggctactaggctccgccataataagtaccctacatagctagggtacaggtctactagtagctatctgggttaccctgatacggctgcatagtcacgtatccgtatcggatacggcaacggatacggatacgtatcggatacgctccgatacgtatcccgtacgtatcccacatatttgcgatttccaaaaaaataaataaatcacgatacgccagcgatacgccacgaccttcctccgtcttcgctcgcatcagggatgcgccacctcacgagcttccaacctgatggctgatgcctctcgtgcgtgcccggcgttgccgccggacgccggctgcagccgcgcgcgtcgctgccgtgcgcggggccacaacgtcccctacgcgagacggcagagccgccgccgccagcctggtggtggcgcacctcttttgccgccaacctcgaggccagaactgttgccggcttgccgcgtgactgcgtgaggcacttcctccgacgccggccgccgggcatagcggtggccagtggcaggctagtagcatcgaagcacggagcaactttttctttcttcgcttgactgcctggccgggtaatccattatcttcaaaagtttcatgcttgaatctgctgtgcctttcttgttttccttaggacaaagtactatcgtttttattagatacaagtgctagtgcatctagcaatcctagaggttactgcttagtgcggcttctaatgttgatgcaaagtcatcaagaaatatatgattgaactattaatatgtggtttttgggatcttaatcgcttgttaatttgaattgcttatagaagagaaaattgcagaatattgatatggaatctgctacactgatactagtattatatcgctatttctttataaaagttccttgattttttgtattttttttatatataaatgcaatttccttaattttttttgtgtatatatatatatatatatatatagga

SEQ ID NO: 605 - DNA, 975 bp, Oryza sativa
atatcactccactgtgaatggcttaggtgattctgagtttgtcgcaagtaaaacaccatcgtatctcctaagttttacgtactatatatttatagaaaacgagataattaatgtctaccacatctgaaaagtaaactatgaaaaatatttgataatgtatgtaatggtgtttatttgatatatcacaaatattatgttttctctataaattcaattaaatatagaatagtttgactagctatgcatgctgactagtcaccagtgaagcagtgacaagctgaaagctacagagcatcgcacagcaacaagagggacatcgagctactatagctctagctgcaggagccgttgactggtacgatcggttgaacaggcacatcgactagtcgtacacccaattcagtccattcgatcacgtacccacccacgatcgagatgaacgggcccgttcagtttatcgccaaaataaatctgattaaattttaacaatatcagaattttgataatttaataatattatcaagttttgggacgatttttttatgtatttactagagtttggtaaaacactaaaagaatacacatatttaacacctttataaaaaacgatatggtttgaaatgacgacaatctgaacaaccgagctcgacaaccacgcccacatatgaccccagcggaacgaagaagctcacatgctgcaatcgtccgtcgttgcaatcatgcacgcaacatactactctctagtagtacatcccatttttctcctcgtcgtctcagctaaacacacacactattttacacatgcatatgagcaaaattatttgcaaagaggaagaccagcactacatacgagtctacgagcctgtttaggggagcttaaaattttaagaagcagctgctgaaaagctagctggtgagaatctagagaagctgcttctggcttctaatttattttccaaattctacaactatagt

SEQ ID NO: 606 - DNA, 240 bp, Oryza sativa
tccccccccctccccccccacacacacaacaatctttgagctccttccctacctgttgcgccccatcttcctctcttggcggcatccggttatgcatctgggctgcagctcagctcaagtagttgacgggggcggagtggcctcggcagcggcgtggagtggattcgacggtgatgatctgcttccaagccaagtctgatgccgtgcacggccgcctcctggttctcttccgcacgcagc

SEQ ID NO: 607 - DNA, 1501 bp, Oryza sativa
gaatttagacataaaatttcacatatacgtgtaatgttattgaaagtatgtgtccaattgtttataaaatttcttatggtatttgctaattggtgtgtatggagtgtgtgtaggaagtttttttttagagaagggtttttttttacctgtcttctacatccagttagatatatgtaggttttttaaatcaaaaatttagcctatcggaaacttagccctcaaataatctaatttgaaattcgctcttacgtagatttaaactcagaaccttgatatgctactcaggtcactgcagccactaggctacatgtccttttccttcaaatttcaaaccatacattgatattgtacagacatatatatatatactctccgtgaatgtataaatgcaccatacatacaggttactgatgagaacataactggatgtttgtcataaaatttagtcaaagtgaaaagaagttataggccatgcgcttcacagttttgttgtaactaaaacctagtgcatgcatgctccctaccatctactcattcttgaccatgcatgttacttggagcggagtacttacttgttcagggagattcctgtgatcgtctacatggagctgcttgcatggatttgacgtgtccggtcacaacgctctcgatcttaatcattggagggtttttttcccttttcttttggatcatgtatggcggggaatgcattatttggtgtcaggaatttatagctggatccacaggaatttaggcaagttgttcaattgcatgagtataataatgcagtgatcggaattaatatatcctttgtaaaaaaaaatctaactctagctacacatgttcgtaatcaggaatggatttttttagatagagggtgtatattcgagcaacttttgctgcttgtggtgaggcagcaggaatcgcctataaaatagtactaactggctttcttgtgttcaactctgcaaccaccaatcaagccgttctccgtatagctacaagagcttcaggacatgggctgttttgccaccttgttgacaaggcaacaagatgcatatagatcagcccagctcatacttcagtgccaatgaagtgactagtgaggaaaaggaggaaaatatatactagtattattttatctttggttaatttgagagccgcataaataagtaaataaataaatattctctgtcccatattagtaggtaatatgatacatctcatttggtttatattactatattttaggatgaaataagtataaattgcaaatgcagatattatatagagttgcgacttgtaaaacagtgagaaaaattggcatgcgtgatgacggcatgccaaactttagctcaagattctctctcaggccgagtttagttccaaattatttcttcaaacttttaaattttttatcgcatcaaaactttactacacacataagcttttaactttttcgtcacatcattctaatttcaattaaacttctaattttagc

SEQ ID NO: 608 - DNA, 1501 bp, Oryza sativa
agaaaacacgaggcctgggagatctgcttaactccagtgcaggtccaaagctcaccttcgaatgtatgagcgtgccagttgatttgatcctgtaatcaacaagaaatagagacaaagaattcgtggttaaatctataaataatagccgatcggctaggtgccgatgacatatcatttatctttgagccgatgtcatatatgaatcgatcggcggttataaatagacagtaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactctacataaagatatcaaaacaagtataatataccaaacaaaagcttaatatacttaaatgcagtaagatcttgacataaagggcggatttaacatgtcacttaggcacatagatcgaatatggttaaatcagataagatcggctgaaactccgatactaccctaatcggcaaccagaggacatgctagagattgatattctaagcacgacttaatagatcaaactcaactgatgcaacattaagtatgaaaagaagaacaatatctagacaatcaagacgctggatgtttcataaagtggtagatattttatataatctaggacaacatcgctatttaacctaatcggctgccttctattaacagatgtcagccgattgtaggttagatgacgatattgccaaagctaatgtaagatatataataactcgacgaattatataggcaagattagagtgtcataaagatggaagcactaatctcgagaacacaagtcgtcataacaagttttacctcttgttgaagatcaaaaccgatgcagctcaacccgaaagtaagaactcgtcgaaaacaaaactaaagcaaaaaggtggcgatgcgccgaaattgtattgaacgtgtgtgttaaaaattacatagggctcggggtctatttatacccaagaattacaagatatgtccataccggacacgaccactatctctaacacactctaagataccataagtctttgcggtagacttttgcccaaacatatctctaaggaagttacataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacttagacccatccgatcctaatcgtagccgatatggacttcagtcgattcttgctctgttctcgaatcaatctccgccttcgactccacctcgatctagtctcctcttccgatgctgatattaccaaatttggtcgtta

SEQ ID NO: 609 - DNA, 1501 bp, Oryza sativa
cataggtatcagacccgatacttaggtatcagacttggtattcataagtatcatactcggtacctgggtatccgacccgttacacatagatattggaacaaatactcataggtatgagatcagatacccgatacccgggtatccaatctagtactcaggtatcagacgcgatacctagttatcggatccggtacttataggtatcaggccggataactcagcatcagatcttgtatttataggtttcatacctggtacctaggtattcgacccaatacctagatatcagatatgataatctagcatctatgtatcacatactagagtttctaagatgtggtataactaagagcccaacatgacatatctaattagaataatccattgtatccatgtataatctaggtaattatttgtctggtctaatccgtgcatggtataggacacaacaaatagatgcaactcatcttagacacgtagctaggctactaggctccgccataataagtaccctacatagctagggtacaggtctactagtagctatctgggttaccctgatacggctgcatagtcacgtatccgtatcggatacggcaacggatacggatacgtatcggatacgctccgatacgtatcccgtacgtatcccacatatttgcgatttccaaaaaaataaataaatcacgatacgccagcgatacgccacgaccttcctccgtcttcgctcgcatcagggatgcgccacctcacgagcttccaacctgatggctgatgcctctcgtgcgtgcccggcgttgccgccggacgccggctgcagccgcgcgcgtcgctgccgtgcgcggggccacaacgtcccctacgcgagacggcagagccgccgccgccagcctggtggtggcgcacctcttttgccgccaacctcgaggccagaactgttgccggcttgccgcgtgactgcgtgaggcacttcctccgacgccggccgccgggcatagcggtggccagtggcaggctagtagcatcgaagcacggagcaactttttctttcttcgcttgactgcctggccgggtaatccattatcttcaaaagtttcatgcttgaatctgctgtgcctttcttgttttccttaggacaaagtactatcgtttttattagatacaagtgctagtgcatctagcaatcctagaggttactgcttagtgcggcttctaatgttgatgcaaagtcatcaagaaatatatgattgaactattaatatgtggtttttgggatcttaatcgcttgttaatttgaattgcttatagaagagaaaattgcagaatattgatatggaatctgctacactgatactagtattatatcgctatttctttataaaagttccttgattttttgtattttttttatatataaatgcaatttccttaattttttttgtgtatatatatatatatatatatatatatatatatatatatatatatatatatatatata

SEQ ID NO: 610 - DNA, 1501 bp, Oryza sativa
agggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtc

SEQ ID NO: 611 - DNA, 1501 bp, Oryza sativa
ttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcggcggcggcgcgaggcggctgggcggcatgcgaccgtggtggcggcgcgcggctgccgagcggcgtggtggcgtgcggccgtggtggtggggcgcggcggctggcgttctccctcctccgcgtcagaggcggcgacgacgggcgttctgctcctccacgtcagaagcggtgatggctggcgttctgccgagcagcgccgtcccaggcgtggaggctgctaggcgacgtgcggccgtcgtggcagcggtgcgcgtagccaagcggcacggcggcggtgttccgggcgcggcggccgtgcctcgccggtgtgagcgcgagcggccaggcctcggtggctgggcaaccgatgccgccgtggtggccaggtggggagcggcggccgggcaatgggagcgccggcgggtggcaccggagccaaagcggcaatgtttccggcgtcggcgcaggcccagatggttgtgctaagggagctggcggcgataggtcgtcttcctcgttgccggtcagcaccctcacccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggagaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggag

SEQ ID NO: 612 - DNA, 304 bp, Oryza sativa
cacgatgcaccttcgtggcgtttagcccagaaacgacatattctacgccacatccatcacaagcggagcctcatgaggactgtctaaccaatattactcacccattcttcccactgaaaaacctgaaaaagttgcacacaacggttggggagaggggagagagagtgtggaccgcgtcgagcgtcaccttgccccgcccacacaggccgctaaggagccgagcgccggcgagttgaggagattcggcgagccgccaccgccacccagaaccgcgagcaccagcgggctgaggagagaggggtga

SEQ ID NO: 613 - DNA, 1501 bp, Oryza sativa
tggatccagaggctgcgtcctccgcttgtgggcgatggattgggggctctcccacgcggctgcaggagcgatggcgggcggagatggacggggctggagccgagcgtgggggaggaggccgacagcgagtaaggggatagcgaggaggacgaaggctcggcggcagcgagtggcgcggtgctggggtctaaggtggaactcgccagaaggtgtgccgacgcgggtagcggcgggatagggcggagctctggagatcccagacggagatgcgggatcgccgagaggagtggagaagggggcaggggttgatggggaggaggacgtggcggcggtggcgggtggaggtgacgcggcggagagggctggtggcgaggagaacgtggcggcagtgacgggtggaggcgcgacgacgtgaggcgactcgctggagaagggagcgggggaggaggatggctaccgagggggctcacaaggcggcgtggagatgcgggcgggggagaaggtggcgatggcggggagacgggcttcgacggagggagcggagaaggcaacggcgctggagggggaggagacgcgaggacgggcgacatagatggcgagggagatggacggcgacggaggcggggatggaggggaatggcgtcgggatggagtgaaatggcgacgatgcgatacgaatccataggatagggatagggtgagtaagagactgataatatacgataataccctacgcgaattatttttcctggatgaaaacaccccttcacatttctactcccactaattctggtgggagtagaactagatcttaagccttcaattaaatatgatcaatggctcagattactttctactccgagtataaagcaccggagtgggactctaaaactaaaactacacgatgaagctaaaataatttggtaaatttgacaagataagatgtggtggcaagttttaatatggtcttttgaggagtttctagaattatcagtatagttttgtgtgagttgatgtttctaaaattaccaagtgagtgaccagaagtttaattatcataagattgtgatggttatgtatggtctgctgcgaataaaaaaatgagaaatgctaaaatttggtgccaacaaggccgaacgcataatcattccactgcgtaatttatgcggcccatacgaaagaaaggcccccttgtctgtcactgactggtgggccaatcctctcatgggccaacgcatgctaaagcttgactctccagttgggccaatataggtctcactgagtaatgggcctcaccgagcaactgatgcaacttaagtgggcccatctagaaaatgtggcccactaccaccggcccggcctttttagtggcttcgctaggttttttccctctgcgtgctcggggtcgcggcggctaaccgtctctctcgccgccgtctcgcacctcgcgtcgccgccgccgccgcgagtgtcggagcggaggagaaggggaggggggcca

SEQ ID NO: 614 - DNA, 1501 bp, Oryza sativa
ggacaggtaagtaatctcctaatatcgtttaggggtaattttgatatggattgtttaaataaagggcaggtaagtaatcttctaatatataaagggcaattaagtaatctcctaatatcgtttaggggtaattttaatatggattgttttctttggttcgatcacatcaggtcggactccttatcgcatcgcattaggtccgactccgttgcacgcagtctcgtcgctattcctcccccggcgtcgccgccttgtccaccccctccgtcaccatccgtatcccccgccctctccgtcgccgccttgtccgcctcctcagtcgccgtccgcctcccccaccctcgccgccttctcctctccctccgtccccgtacgttttccctgccctctccgtcgccgtccgtcgcccccgccctctccacctccggcaccgttggcgtctcctccccttcagcgtccttgcctcctccgtcgtcttcctaccacgcgtggcatcaggtcagaggcaggcaccggcaggcggcggcgcggccggcagctagtcctcccggcaggcggcgtcgcggccggtggcacggcgcgtcgcatctgtccgacacaagcaccggcaaaagcggtggcgcggtgaaatcctcaggtgtccactcctccccccccacctgactttctgttccccttcctctcctcagtgttaaacttgtctgaatttttcctctacaaatgcatatacttgcttgtaaatggctgtgtatactagcttgtaactatactagagaatctacatttgcggatgttaaattgaataggagatttattaaatcgattttgtatgttaagttgtaagcatgaacgataaaactgaacaataattttggtcttaagctgcaaatgaaatacacctgtcacttgaaattccactcaaaacagtttgctgaaattgatgtgttactaatataagtccaacattaaacctcagcaaaggtggcaagttaaatcatatcttgtgcaattgatctttgatcttttctaccaaatgattgccttgtcaactggttaaagcatccaacatttcctgctagttcatcagtagtactagtagtacattgaattaatttattagtgcatgccttagttcttttatcatacatacaaaatttgcagccattatgggggaactgtagtaattgttcaatagtttagagtggcaatgaatttatgcagttgatggatctgtgagatggatactcttttatagcaaatcaaacctgtcttcctgaatttggccatctctgcatctgcattacactctgaaactgaaagaataaagaattcagggcataatttggccatctctgcatttgcattatactctgaaactgaggcacttaatttattttagatgtgtacagaggcaaataagctaaaatgctttagaactataaaagaattctttgtcagaaacattacataaatacggaattgagcttgatttaatccattt

SEQ ID NO: 615 - DNA, 1501 bp, Oryza sativa
ccacatgcatataattggttaaatactagtgctcaaaatgcttcatgtttgtgtgagttgaaaaacctaagccaaaatttttaatcccgagttgtttcacttgtcacaacacttacaccgggtttctttgcaagtttttcaatatctcttgaaggttttggaccatgttttatgttgggtttgatagcccacgaaactagctttccatagagtccaagatcttcgaaatcggagttcagagtaaaaagttattgcatttttgcttgagcaacattagactatccgatttgaaatcagactatccgatgtatcggactatctgatttttcacagaacttcactctctgtctttgtttgaaaaatcctttcgagtgagtttttctaagtgtcggagtatccgatgttggatcagatagtccaatgatacagagactccgaaatttcatggaacttgagtctctgtttgaagatgaagtttttgcttctaaaatatcagatactccgatttaatatcagatagtctgatgtctcggaaaatccgaaatttcatgaaacttcgttctctgtttctccttgccttggaggtttaaaatatcggactatccgacgtggactgaaagattccccttcaacggtcacattttgggggatctataaaaaccccccactaaccccttttctagggttgcccaaactcattttattcaaatcttgttttgggttgagctttgtgctaagtgctttggatctttgagctatctccctctctatctcaaatcccccttgttctttgtgacttggatctttgtgtgtgaatttggagtttgggagtctagtgtatatttcttttgatcttgagcactaggatttgtccaagagttgtgtggtgtttattactcttggaggttgaggactcctagacggctaggtgtcgttcttgggccaccgatctacgtgtggttgttcaagagaagtttgtgaaggccggatctcgcctccgcaaggaaagagatacccttagtgaaaggaggagtccatttgtgcaacctcacgaggatagggttgaaaaagacccggctctttgcgagcccctcaacggagactagaatcccctcaaggattagaactccgggaaatacatcggcgcataaacctcggtgatatcctcactctctttaccttcttgttgcattgctttgtggcatgctaatattgttgttggttgagctcacctctttgcttgtggattgaatctagatatcttaggttgttctcttgtttgtattgttgttgtgcaggtcagatagtctgatctcagttcagactatccgatcacatagaactatccgacctgatatcagacaatccgaccctgttttgttttagcttccgtatttatttaaaaatcgcctattcacccctttagacgatatcaagatcctttcactatttaattacatgtaaatattgaaaagataatgacatgcaaataacgaaaacg

SEQ ID NO: 616 - DNA, 1501 bp, Oryza sativa
ttgcgaataataaaaatttgtgatgttccgtttatggaggatatggaccaagacacgaaaatattaggggtgaagatgctaacagaaaacagaggggtggtagagctaacggtcaggagtgatggccaggcacatagaggggcaccgtgtagcatccatagtatatgtcacagaggggccatcaacagctagatgttgatggaatcatggcggtgacagatgggtcatgtgctggcccgttgcggctctgctcgataggggacataggttagcatttatggtgagatggggctggtgctaagtaaattggtagagcacacctaggcagctagctggatatcgagcggtggcggcagttgatgcaatacatttgataggaatacaagatgacaactcgacgaggcgtatgtggggaggaacacgtggccttatgaaaataatccaacaattctaggtcttggtgtagattgtacaataaaaaagagtacactataaatttaattgatattttttttattggcaagtgcacatgctgttacatccatgcaagttgagagctagacgtgaaaggaggtccataggcaagcgccgcggaatgatggttgattgattttgatcgggtggtgggggtcgggggcgtgcttccattcatgcagcggaagggacatcatgcgtgtagaactcgctcgagagggcgtgggagtgaggatgggcttacgattgacgagggaccataaaccaccactacatgtttttaggccttaagaatttattagttctttacatatatagtttggaactaatggtatatatatatatatatatatatatatatatatatatatatatatatatatatatatatatatatatatatatatatatgtatatatatattctagttccttctaacacgctggtagtgtaaagctttttcttctatttaaagtttggaaccaattgcgtatttactaatacaattcctataaatagatgcaaacttggtagtcctagttatttcgctggcgcatgacaagcagacctcttaaaaagtagcaatgcattcacatatcttctttactttttttgttaacttatataataaaaattaatcacatcatcatgtttcgtttatggaggatgtggatgacatctatttatatcgcctggggttagaaaacaggcatggatgcacagtgcaaaatggagatcgttggccaactttctcgttgaggaattcttatgcaattgctataaatagatgtggtttgggtagtcccagttgtttcgctcgcgtagagcatgcagatctctcaaatagcagctatgcagtcccatcttttttctacttatttttttaacttacaaatattgaagactaatcatttcctcattttccatttatggaggatgtggaccaacgcatggacgaatttgtggtcacaaaacaatgactagtgtaaatgcgactttcgtagcatttttttcttactgtcaaact

SEQ ID NO: 617 - DNA, 817 bp, Oryza sativa
tggaattgcaagattattttccccagggccatgcgctcctccccacctatgccttgtcgagttgtcatcttgtattcatgtcaaatgtattgcaatgactgccaccaccactcgatatccaactaggtgtgctctaccatattaattagcaccatccccatctcgccatagacgctaacctatgtcccttctcacagagccacaatgggctagcacttgagcccctccatcgctgccaaggtaccatcaacatcgagctgctgatggcccctatgccacatctactatgcatgccacaccgttgcccctctgtgcctggccatcaatcctaaccgttagctctaccacccctttgttttccactagcatcttcgccccttatttgttcatgcgttgctccacatcctccataaacggcatgatgaggtaattcatttttattgtataacttaaaaaataagtagagaagatatgggaatgcgtagctactttttgagaggtccgcttgtcctgcaccagcgaaacaaccgggactaccaggtttgcatctatttataggaattgcattagagttgctcaacgaaagagccagccaacgatctctatgctgcaccatgcgtccctgcctagttttctttgccccctgccaccataaatacgcacccagctgcaacatggatcaccaaacacatcgatccattcctttcaagaaacaagaaagacaacaccaacaaactagctagctcgccaatggcctcgttgtactccttccggctcgccgtggcagtggcggcattgttggtcgttggctcatgcg

SEQ ID NO: 618 - DNA, 1501 bp, Oryza sativa
ctcaagagtgaggcggcactcaagggccccttctccgtccgcttccttgtcaagaacggcggctaccgtgtcgtcgatgacgtcatccccgaaagctttacggctggctctgaatataagagtggcatcaacatctaagtgatagacatgtgtgcttttttttttgaaataattcttaacctctctataatcctttttttttcaaaagagagatcaagtctgcattcggggaagccaaaaattaagtttctatggttattttgtgaaatatgccatcaacaaaataaagcattccatatgccatgtccgcatgttgctgcagaggtatatatccagacgattttgagtatattactgtaacatgctgaaaattagatattttctaattatgtatcatgccggttcttatgttcttaataaccttctaaatctaggaaattatgattagagggaccttctagaactaacttgcataaaacccctctttgatatttaacttcttttgtgtttttcatttaaaaatatatttggttaaattgaggtatttcttgatttggttttaaattaaaaccttctttcgacaaaatttcctcttattcaaatttagtttaaaaacccttttcatttgtataaattatggtccaagaaaaccctccaaaccaactctttgtaattccaattttaattggaattaattgtcgacccatcctttgattccaaacctatccttagttccctttccaaatctcaaatatccaaattcctccttttgatctaaccgccaatttagttcctacggcttgatcccttctcggcacaagaatggtattattacaaatattatgaataattgctcttgtgctaagaaaatatattttatccttctcttccacacatccaaattcctattagcctcaaatacttctctaaaatccatgccatatattttggggctaaaatcctattattttcctctttgtttgcttgcctcattcccaaaaatattttgaggaattatattgttaatttctctcccatttgagtgcatcaattccaccataccccacttctaaaaatattgcactcaaataaatagaagatctttatttcgaaatttatctccacatataaactccctccaaatataattccatctatacacaaaatcaattctactcaatttgggccgaagttccttcacctaagcccaagtctgaaagtctaatttccctcccttattcctttcctcactgtgggcgccgccgccgcccagctgctcccggagccgccgtcgtcgccttgctgaccacgccaagccgacgccgtgccgtcctctacctcctccgccgcccaaacgcagcagagccgccgcgtggacgcgccgccgacgccgaccaatcacagagaagagccggcgccgttttcttctcctccactccaccagcgccgtgcttcccttgtttttctcctctctgaaccgccattgaccacctcctttcgc

SEQ ID NO: 619 - DNA, 1501 bp, Oryza sativa
gggaacgccaaaactcctctcgctgctgataacgttacgttcagagcgcatgggaactagagttcatggaacaggtaccactaatgttagtaactgaaaagctttgccatgacaaagctaatgtgtttggcacgtcatggattgcgggtaaagcgtacatttactgcagtaaaatataaatgaatatattcgaatagccgtgctcacggatttgagcattgggactcatatggtatttggttagaaacctaattccaaactttattaaatactgttgcattaaaatcattacaggctttctactttttctgcaagtaatcatagccctactcaaataccactatttcatacattcatattgaatttaatagcttgctgagtacgttgtactcacccttgcttcaacccctcttttcagagtcattttggaattcttatcgaagccgggagttcagttatataagttagtctcattctaacttagttctcaagtatagattagatagatggtttacgtctatagtaaaacactagagttgagtcattctatagcttctgctataatagttagccacaatcttgtaaataccctattattttatgtaagagaatccccatggaagccttgctcaaatgtatgcaatgaagatccagattgttgaacctgtatcaatttactgatccagggcttgatacagttaaacatgtcggtttccgaatcattagttttgggacccgacaattacgtatataatatttgtgggaaaaagtatagttggtgaaccttcatcgagatagtttcttacattttagttgattagtttcttacgttttttctaaagtttgagtacatttgtatatgtatttccatatcaatgaagctcatttatcttcttcagtttgacagtaagaaaaaaatgctacgaaagtcgcatttacactagtcattgttttgtgaccacaaattcgtccatgcgttggtccacatcctccataaatggaaaatgaggaaatgattagtcttcaatatttgtaagttaaaaaaataagtagaaaaaagatgggactgcatagctgctatttgagagatctgcatgctctacgcgagcgaaacaactgggactacccaaaccacatctatttatagcaattgcataagaattcctcaacgagaaagttggccaacgatctccattttgcactgtgcatccatgcctgttttctaaccccaggcgatataaatagatgtcatccacatcctccataaacgaaacatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatacgcaattggttccaaactttaaatagaagaaaaagctttacactaccagcgtgttagaaggaactaga

SEQ ID NO: 620 - DNA, 1501 bp, Oryza sativa
acatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatacgcaattggttccaaactttaaatagaagaaaaagctttacactaccagcgtgttagaaggaactagaatatatatatacatatatatatatatatatatatatatatatatatatatatatatatatatatatatatatatatatatatatatatataccattagttccaaactatatatgtaaagaactaataaattcttaaggcctaaaaacatgtagtggtggtttatggtccctcgtcaatcgtaagcccatcctcactcccacgccctctcgagcgagttctacacgcatgatgtcccttccgctgcatgaatggaagcacgcccccgacccccaccacccgatcaaaatcaatcaaccatcattccgcggcgcttgcctatggacctcctttcacgtctagctctcaacttgcatggatgtaacagcatgtgcacttgccaataaaaaaaatatcaattaaatttatagtgtactcttttttattgtacaatctacaccaagacctagaattgttggattattttcataaggccacgtgttcctccccacatacgcctcgtcgagttgtcatcttgtattcctatcaaatgtattgcatcaactgccgccaccgctcgatatccagctagctgcctaggtgtgctctaccaatttacttagcaccagccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccacccctctgttttctgttagcatcttcacccctaatattttcgtgtcttggtccatatcctccataaacggaacatcacaaatttttattattcgcaatttaaaaaataagtagagaaaacatgggaatgcatagctaccttttgagaggtctgcatgtcctgcaccagtgaaacaatcggaactaccaagtttgcacctatttataggaattgtattagagttgctcgacgaaaaagccggccaacgatctctatgccgcaccgtgcatccatgcctggttttctttgccccctgccaccataaatacacacccagctgcaatatggatcaccaaacacctcgatccatccctctacccttcaagaaacaagaaagacaacaccaacaaactagctagctcaccaatggcctcgttgtcctccttccggctcgccgtggcagtggcggcattgttggtcgtcggctcatgcg

SEQ ID NO: 621 - DNA, 1501 bp, Oryza sativa
attttgcaggtgcagatgcatctgaaactgcttcaaaactagatggagcactagatgttcagcgtgctctctctcttctgtcagctagttcaaggggtttgactgaccccggacaccaaacatcttctatcatccaatttacgaattcgaaccaaaacagcacattgcccagtgtaccaagcgaaggaaactctaatgtacccttttgggttgatggacaacatcaagcagtagagcctcaggtgtttcagttcacaatggacaccggtaacactgtgtttccggatctagagcggatcaaaccttcctacgagtcttcaatgtttggtctgaaccagatacattgaagcctgcaatgatcaccagcacggtcgctgctagtatggatgaataagcacacgtcctggactatccaagatcgtccaagacttgccccaatctgccgagtgtcaatgctatatccgtgtgtttatttaccttcccataattcagataaaccttgtgaacgccaacatctaagtatcaagcgttcacaaagtgtgctagtttcaaccttatttctgtcaaaatgtaattgctgttgtgcaattctttgttcttcgtgttgtacaaattattcattgttcttggcgttgtacaatctactgcctaaccatttgtcagaatattagctctttcgggaaacaagacatgatttttccctgtgcatactgtttttcagtgtctaatagtataatttgaaatcttaacatgtttaaagtaattttatccctctttaaaaaagggagagagattttaccccgatatgccgttgcgcttgacttctggtcgcctggacagcatatggtttctttctgactggtgcggtgtactatgtgcatcttaccagctttttacacggtggttaacgttatattttttttatcattaatttctgtcataatgcattatcaattactacaaaattaacatcatatataaatattttaaaatacgaataatgatactacacacatgccaccaaaaacatttttaattcatattagttaaaaaaaatattaatgtagattttatggaaaataaaggtttcttatttttagcacaaaatcttgtcccaaatgaatcaaaataaagctatttcttcacccatcatcttctctcaaccaatcataataattcttcatctacattctttttgtgaatcaatcataatattcctccaatattttcacctacttttttaatatctgttcctacaaaaaaaaatgccaacattttggaacagagaaagtattttagaacggagtactccaataagtggaagttcaacagactataggtgtttagaatttggtgacacaaaaccacttggaaaatctgcataatttacctggataatcaaaaaccggagtggaaccggcagatacattttagatttgacttcgacatagatgataggcatagataagtatcatggatccatatggaaaacaacacaagg

SEQ ID NO: 622 - DNA, 1501 bp, Oryza sativa
tataaaataacaatataatcaccatcttgcatctatttatagcaattgtacaagagctccgaacgaaaaagccggccaacgatatccatgcagcaccgtgcatccatgcatggttttcttacccccccacccacccccaaccaccataaatacacacccagctgcaacatggatcacaaaacacatcgatccatctaaagtttatatagtactacgagaatatcaatctattgcaaagtatctaaagtaaatacacaattggttccaaactttaaatagaaaaaaaatctttacactaccaacgtgttaaaaggaactagaaaatatatcattagttccaaactatgtatgtaaagaactaataaatccttaaggcctaaaaaatgtagtggtggtttatgatccctcgtccatcgtaagcccatcctcactcccatgccctctcgagcgagtcctgcacgcatgatgtcccttccactgcatgaatggaatgcccccgacccccaccaccgatcaaaatcaatcaaccatcattccccggtgcttggccatggacctcctttcacgtctagctctcaacctgcaggatgtaacgacatgtgcacttgccaataaaaaattcaactgaatttatagtgtactcctttttaatgtacaatctacacccagacctagaattgttggattattttcataaggtcacgtgctcctccccacatacgcctcatcgagttgtcatcttgtattcctatcaaatgtattgtatcaactgccaccaccgctcgatatccagctagctgactaggtgtgctctaccaatttacttagcaccagccccatctcaccataaatgctaacctatgtcccctatcgagcagacccgcaacgggccaacacatgagcccatccgtcactgccacggttccatcaacatctagctgctgatggcccctctgcaacatctactatggatgctacacggtggccctttgtgtgcctggccatcactcccgaccgttagctctaccacccctctgttttccactagcatcttcgcccctaatattttcatgtcttggtccatatcctccataaacggaacatcacaaatttttattatttgtaatttaaaaaaaaagtacagaaaacatggaaatgcataactactttttgagaggtctgcatgtcctgcaccagcgaaacaatcggaactaccaagtttgcatctatttataggaattgtattagacttgctcgacgaaaaagccggccaacgatctctatgctgcatcatgcgtccatgcctggttttctttgccccctgccaccataaatacgcacccaactacaacatggatcaccaaacacctcgatccatccctctacccttcaagaaacaagaaagataacaccaacaaactagctagctcgccaatggcctcgttgtcctccttccggctctctgtggcagtggcggcattgttggtcgtcggctcgtgcg

SEQ ID NO: 623 - DNA, 711 bp, Oryza sativa
actcaaaaaatcattttggcaggtgaggctgcgactacctataaattgcgacattgtttgtattggttgcagcgcaccaccaagcatccaaacagacctagcaacaaaatccaaacacaggattttcaagtcacatgatttttttaaaaaacagtggaattgcgtaggaatgtatatgcaatactaaggatcaagacatattttttttcttttagtgagctgaacaaagaagatggagtagatgtttttattcctatggaaccaatacattttgaagatctagcacatgattcctatagaaaaaaaaatcatttaaatcgtataaccgaaccgaacaaggcatatataataagaaaaaggagcccgtatggttgaaccatttggattctctctgaagtactatggcagttggggcatgtctgctatccagtgctacgttttgacaaacacgacgttggaactacacgagaattacacggtactggcatttgcaggctgcagccggcgttgacatgaatagcctcctaaagtcgccggtaaactaattacgtactgtaccagcaagcacgacaagttgccaaccgaccacaaaaccgatgagcaggaacaaaacagtggactagtccactctctagctggctagcactgtgtactatatactccgtatttgtgtgaaattgttgacttgcatcgtccatggcaggctaaaca

SEQ ID NO: 624 - DNA, 1501 bp, Oryza sativa
gcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagtcgctaggataagggatgccggatccagatgctcgacggaggtcttggcgaccacctctcgccaccttcgcctccatctcatcgaccgcccacttcttcattcttcacccaccggaccatgcgcctccccttcatatcccttcctctagcgcctcccaccgccgccgccgccgccccttatcgcagccatcgaagacggcgtgggggagaaggaggcagcaggggcgggggcggcgtaggggccgcgcgtgcagaggcggcggcggtagggaggccacgaccacggtagaaccgccggatcttgaccctcccgttaacaccggcggcggatctgcgtgagcggggcacggagagacaacgggatctgagcgggagaggaacaggtcgccggatccaacccctcccgtcgcagctgatgacggatctgtgcgagaggggaccggaaagacgccgcatcgaattcgccgtcgccgtcccctagcatccgcgccgcccatacacccatcttaccgatctgcgttgccaggccagttagccgccaccagaattgccgtctccgaccccgatctacacctggacgccccccctccttgcccccgtcagccggcttgaagagtaacgagagagagagagtgggagagagagagaacgagagagtgagagtgagaggataaggatctctaaatttctctccaaggtaatgtacaacaaccatctttcttttcttttcttgaaaaaaattacggtcaaattgtgctaatccatggattcaaattgtacaacaaccatctttcttttcttttcttgaaaaaaattacggtcaaattacggtcaaaaagaaaaagggaagaacatgctcgcgaagctccggcccctcatggcgacggcggcggcggcggcggcggcggcggcgaagccagctccggctttgtcgttttccacggcggcgg

SEQ ID NO: 625 - DNA, 1501 bp, Oryza sativa
cggtaagatgggtgtatgggcggcgcggatgctaggggacggcgacggcgaattcgatgcggcgtctttccggtcccctctcgcacagatccgtcatcagctgcgacgggaggggttggatccggcgacctgttcctctcccgctcagatcccgttgtctctccgtgccccgctcacgcagatccgccgccggtgttaacgggagggtcaagatccggcggttctaccgtggtcgtggcctccctaccgccgccgcctctgcacgcgcggcccctacgccgcccccgcccctgctgcctccttctcccccacgccgtcttcgatggctgcgataaggggcggcggcggcggcggtgggaggcgctagaggaagggatatgaaggggaggcgcatggtccggtgggtgaagaatgaagaagtgggcggtcgatgagatggaggcgaaggtggcgagaggtggtcgccaagacctccgtcgagcatctggatccggcatcccttatcctagcgactgatggcgctggcgcgttcctcatccatctcgatctgacagcgccgccgtaggaggaggtcaccatctaccagtccaacgacgccaatgtgagtcctcaacccaatcatccagacactttcctctgcatcctcttttgattttctcttctatccaggatacttggtgctatcttttggtttgtgctttcaccgataagtcaggggacccggtgttggttgctaagcacatcgcatttgaggatgcaacttctttttaagtccttatggggttcaccacattccattagctcatcagatttgtctctgcttcttctggtggagaaccgtgtttgacaacactccttatgtagtcatagtgtccaagctacatacactgcagataatctagttgtgtattaatctacatttcttcagatcttcagaaacatcatccggctcactggagctatgctgataggcaagccttacgggagaaacaatgtccgcattatactgaatttctttcgaggccaggctgcggccggctgagttcgaggagagttggcccgcgccgtgcttgccaacgaccgacgtccttgactcgccgtcagttccagccactgcctcccaggtgctttattttttaagacaatatatcatgttgttgatgtgaaattttgggatcatcttgtatagtagtaatccggttgcttagaaattagaatacggttcttatctgagcttgtgttttgaaatgtggaattgctggacaacagttttgtgatcatgcttttatgttgtttataatatcatttacatcccatgttacatattttcctttgcttaaactaaattgagagttgaatccactgtcatttatttgtttcaagtattattttttgtgattctcagcattacattttcactctgatactcccaccgttccaaaatgtaatgtgttttagttttatcctaactcaaagttatcttccttttagaaaataatct

SEQ ID NO: 626 - DNA, 1501 bp, Oryza sativa
tggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccagcttgagacgagtgcctagaggctttcgtcttgacgggatggggcaaggcgtgcgtcagaccgccagtcgccacctaacccgtgatctgaccggtctgtgactggtcacagaccggataaagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaaccagacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgcca

SEQ ID NO: 627 - DNA, 1501 bp, Oryza sativa
caccacttgctggctgggcgctcccggttgggagtaccagcctctttctttttgtcgctcgcaggcctcccctttcgggtggcccgcggagcgccctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacattctggacgaggaggcgccctccgttgcacggggagtacgccggctattacgcctgcgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccctgctcggccattaggctgaacaagaaaaacttggcgcacacggaagagtctgagagctcagaaaacacacgctgagccccctacctgg

SEQ ID NO: 628 - DNA, 1501 bp, Oryza sativa
tgtatttagttataaatgcaatatttaacactttagatatctgcacggttttctcaagcaatgtatttacggagttgctagaaatatggcgccatatgctacagtcgattttttttcagccacttacacagtagttacacctcatttacaccccaatttacatatgtaattttagtacttacatatgtaattttgagacttacattgtaaatacactaaaattacatatgtaatttagggacttacaatgtaaatacataccgactattttttgatgaaaaatatggcgccataaatatagctacacccatgtatttatactaaaacgacaaatattctagttaccaaaatttacagcgcacttgtactaaaattacagtacacttacatgacatatctactgtttttacaaatgtaattttagttataaagcactgtaattttagttataaatataacatttaacacttcagatatctgcatggtttctcaagcaatgtatttatactaaaacgacaaataaattatagtgcacttacatgccatatctattgtttttataaatgtaattttagttataaaacactgtaattttagttataaatgcaacatttgtcggtaattttagttataaatgcaacatttgtgttaatctttattgaatactactctactaataagtacaatcacatgctacttggacggtttctctgtattgttatttttttttttaccgttggatgcagatacgaggggagaaaaaaattgggtgatttttttctcaaaaataacacgccacatgcctagacagtcccatcaggaaaagttcttcgaagtaaaggcccattgtatgacatatccgggccgcaattgtggcccatccgtcgcaagtttcccgggcaaagcgagatgggccgagattgcgatctgtcaactctcttttgtgggccccacctgtcagtctccgtgtctcgctgacttcctctgcatctctcgcgccgcctcgccggcgaaggtcgcctctccggctccgccgccgccgtcatcacgagggctgccacggtcacgagcaggcgggcgccggcgaggtggaggacgggagtagcggttgcggggagaagaggaggccggtgaaggggaagaggagagggtaggcttgccggcggcggcatcgggcgacggcgacgtatcaggtgagagaatctcggcgagttctctcgccatccgattcttcgattctcttccctgtcagtacgccccgcaattccacagtgctcaaattttacggttcaagacaaatcattatgctgatgcagaacgcagctagaatttttcaggtttgcagccgtttttttttttttttggatttccggaccgctgtgcaagattctgcaggcttgtgaggaacacaagaggaatggataataccccacgattttcaggaggaggagatgattgtgagttgatgcagcagaaacaagaatgggccaagtataccctc

SEQ ID NO: 629 - DNA, 680 bp, Oryza sativa
cccccccccccccccccctcgttggattctccgcccgcgccgccgtcctcttcctccgcctcccccccgtatttctctccgccccccacccgccacctacctgccattgcactctcctcctcctctgcctctcccggaggccgcctcctccgccggtgagtgacacaggtagctactgctactactactagttccctgcattaccttctagaagcttccacagcagcatccagtaggcgggggtggggtctgatccgtccgctggtttgatttggtggtgtctctgcaaggcaactagtaggatcttgtagagcaatgccgcagtgggtttttctcgactagaggatcttgtaggatggagtggactactacgttagatttgaatagctccgctcgctgcgaacgagttgctccagaggagaggagtccgactagtaacattttctgcatctggggaggaattcaaaactcgtttgtttggggggaggattctaattctaattgattgtagaccactggatagcaatgccttccccttttatgtatctgtgtctgttaatacgcgataaatatctgataatgtagctacattatcatttcaggtttatcacttgaaaagtcaattgcagatcagtgccgacactccgcggactagtagctttgtgtaaggctgggaaata

SEQ ID NO: 630 - DNA, 1501 bp, Oryza sativa
agaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaccaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccacttccaacacacacgctcacccgattccccgcttcgccgccggcgctcgcatcggtcaagtcaactcgacgcccacacacgcaccggccatggccgcggcggcggcggagcagcagcagcaggg

SEQ ID NO: 631 - DNA, 902 bp, Oryza sativa
tcggaaccgcggcttcggctggagaagcttctagaagctccggcggggaagccacctcgagcgacgcgcggcggcgggcggagctggagaggtgggacatggcggcggcgtagaccgcgggcgggatggtgaagtcctcgggcccggagagccccagcttgcggaagatggcggtgacctccgcggccccgcgccccccgcggatgcggaagctggtctgcgacgcgtactcgcccccgccgtcgtcgagctccccacacacgtcgtccccggagccatcgtcccccgcggcggtgtaggagtgcctcatggcgttgatccgcgcgagctgcgcctgcggccgctggcgcgccgccatggccagtgcccctccctcttcctcctcctcctcccccgcgctcccgcggcgcagcagcagagcgagcggatcgcgagaagattgggggattctgctcgtggtggggtttgactaggcacggggggctcacgcgcgacgacggcgacgcggccgtgcgatgtgggtgcgtgcgcttttgacctggacccggtgcgctgctcgccgtggcgccgaggggtggtggcgagcgagtgacaaggcgacgccggaaagagacccgcgttgcggatgagggccttttataacggcgtggagccgactaccctccccgtaccccgagagcgacccgagcgtcgatcgagacgacgtcatcggtaactggctaactgctcccgttacgaccaaccgctatctccgagtaccaagtcgtgggaattgcggaattggctttgcttgtaagattcagagtgtgtggctgtttggtttcgtcaccgggaacgtcagcgccgtcggttcagacttcagactcagacatgcagacgcggagtagcaagtcgtcgtaagt

SEQ ID NO: 632 - DNA, 1501 bp, Oryza sativa
gaagaatatttattttcttaagtgattgcaaacacagtccttcacattacaacttgtgattcatgccccgtaatggaactgaattaacctcttttaaaagaggatgaatgattaaaccgttttttaagtacattattataccttttcttgctcttttgggtatgataaataattgtggtttctgaaattattaggtattttttatcttatagtattcagggtctatttcaaatcatcatgtaacatcggaattcaagttatgtcacagcctgtgctagaatgaagtcctttcgtactcaacatttaccaatataagtacatacatattctgacttgtgatactttttaccaataacaaacggtagggcggcccgaagcgcgcctaaagttctagtaaaaccaatttgttgcaaaaacccacccacccaaaccctccacgtgtgtaaatagctgagtcagcccgtgacttgtacccgtaaaagaccagaccaatgggtcacgtttggtttcaggtgcatccatttgaacctagtcctaggtgtagatcaaagagagaagacggtctcgaacaacgcgagggctgagggtagcggcgaatcagtataggcaattactacatccgtcctaaaatataataacttttggctataaatctaaatgtacagttatccagattcatagctaaaaatgcttatattttgggatcaggggcggagctgcagtactatcattggggtcattagaccctgatgacattcgatcaatcaagtgaattgttcattattttgtagctaatgaccccagcaacaaaagcttaatgaccccggccagcctgataaactgctggagctcaggaaggctgaaacaattgtaccgtttatttctttggaagcataatttgttagctgtgttatgctactgtcaatccgctactaatgctgcaattagacatatttgatctattaaccaactacttattttagctatgtgctatgtatatcaatgcattaggcctgaagttttgctaatcaactactagatgtgttttttaagttactcactctatctcaaaatatgttacttctaatattcaaatttgctttaaaatatagctattttctatgaaccatcccatctccaatcacaaaattcctcgatataatttttttcacctacttttttttcccaaccaatcacaataatttcacaccctaacattaatctcttaaaaagacgtaggtagttgtattttgagacagatggaataataaacaactttcagaacatacttgtatgtctgaaaaaacacatggttgttatgcccggttatatgtagtcataacttttaaaattttggaccttaaaaacctcagaagttcttatagaatagactttaaatatttatttttagcaaaatggaacaatcccaacttactcatagctctagctcaaaagtgagctaaaaatatctagcttcgagaataattatagtttcaaacac

SEQ ID NO: 633 - DNA, 458 bp, Oryza sativa
cgcggcgaaatgtcccggtgtaaggaggggagcctacaagctgatcgggtataagacggaggaggaggcgataacggggtgaagcaggggacgagagcaaaaccccgagtatagggcgaatgcagcctgtgatccgcacaaaggacgaagatcggcgctgtgcccaggataggggccgggagcgaaagtgagccgttaggggcagtgaagccggataaactgcgaagcccctatgagctagtaaacgtaggagggggcgtggcggcgtaatactattttccttaaaagtggattaagcgccggggacatcagaagaagaagaagggagtgggagcggtaggggcggtaagagatggcggggtatagggtgggagaagaaaggagccaaatacgggataaagggcgttaacagataaacggcgtaagggcacgataagcagtataagaacggggggata

SEQ ID NO: 634 - DNA, 1501 bp, Oryza sativa
caacagacgcgtgttgcgcgagccgcgctgacgctgcacatacagcgcggacatgccacaggccacagcagcaagcggagcggagaagtggccgctcaagccaagcaactgcaggatcggaggcgaaatcgcggaagcaaacctcccccgagtgggcaaaagaaattcacgcggagttggccacactgccgactgcccgcgtctcgggcaaaatttgccgacctcgccgcccgccgcccggtaaacctcgcggcagattgcacgttggatttccctggtatccatcggtgaaaagcggcaactactacagtagcgcttcgtacaccagtgccgatgattctagtacggcactatcccgtcagtgtgtgcggccgattaacacgtgatctactcactggtccccggtggtgcacataaacaagcatggagtaatcaaccactgatctgcagcacgttgcgcatttcgggctgcgaagggaagggacggaccccagccacgttcccgtcatgttcagacgttgtgatgctcatgttcgcgcatggggctccggttcccaaggagatcggataggatttcagacacccggtcaccggccaccgctaacaccggccggcgagcggccgcgaacatgcatggcgtctcgtctgtcgtctcccgatcgaccgtgttcgtgtacgctaccgtggtgaccaaccagccgctctctgtgcagtgcatgggcgagttgtgtctcctcccaactctttttccttatcgggtaagcaaacggccgtgattgggggaccaactgccccggtgtcgtggtacgtatcaagtacacctccgtcttaaaatatactaattattttgtagcagagtagcaagtcaaaaaatttaaccaccgcaaaaaaagtcaaaaaatttaaactttaattattaatagtaaaaaaatttaaaaaagatcaatcatgtaaaattgatggtattagatttatcattaaacaaactattataatatgtaatttttttaccttaaaatactagttttacaatactagttttacagatattggtagtcaaactaatattttatattttagagaccttattatagtttaaaatcattatattttgggaggtagcgagtaccgcggtaggacgcgccaccacggagcgaaaggaacacgagattcgtccgaccgccgcctcgcgctcgccggcagttggccatcgttgacgcctcgctcgggcgcccggaaatggtgtctcgccacgtgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcataaggtgggcaggaagccctctagggggca

SEQ ID NO: 635 - DNA, 1501 bp, Oryza sativa
aaatatgctagccccccatgatatgaagaacaggtaaactcattgtttttcttttccttatagatcatcatgcacacgagcatacccatgatcctggtgtttcttctgtaagcattgtttgcaaaggggagatggatcttgaaaaggttgattctaaatttatctgtcatgctctatttagtcattattgctacatgaaattttacatctaaatactatcacccatttaattgccccacacatgatggggttgtggatattgaaataagtggataacaattttacatgctctcacataagctggcatgtggttgggaaacctactgctagaatgtctttcaggtttatgttaaacttagcctgtagttttacatagttcactattgattcttccatcgtagtctcttactgggacatttacacaatgaaccaattactctatatgtgttcttatgtaagaaatgtctgtgttccttgggcagggatactctatatgtgttcttatgtaagaaatgtctgtgttccttgggcagggagtgcacatcattttccggggaagaataatgtgggaaccaaatgagccatgcatcaacaagattgtattcatagtcaataatctcaaatggggaagaactggagaaacggcttcaaagattgcctactctactgaaggaataagcgagaaacgggactccaacaggtggtgtatacttcaatccaaccaatcaaccacatgaaagtgcagcagcctaaagcaactaatataaggaggaggtgatcagtctaatgttttcatgtacacagcctgaaagcaagaagaatgcatgaatgggctggctatccgctgaggtcaaggagatggtccgtagaggctccggagccgggccaacttatctacaatgacagctgcaatgaagtcatgagtgtaggcggcgtatggcacccgtctgcagtcggtgaaccccaagctgtaccagtcctcagccggcctccgtcccagccttgctgccccatgccaagacttgaacacggccactgcgaccccccttcagacgggcgtggactagatcatccatcgcaccaaaggtggtggacagccgagcctccagatctgcgcggtccgtgtacattgggatacctgagaggatcaaggacctgtccgggaagctgctgctccagacggtagcagggttcgcgagagcacacagcgcgatgagcttgtgcacgatccgtctggcctcgaccaccctgttcacatggtatcctggtcctggagacatcaactcgtcggatagccagttcttggcttggcagtaggccacgggacccgcccagtccctcgtgctgaagctgagctgctgcggcggctgctgcggcggcggcgtcaggaaccgggaaacgtgcagccatgtcatcatcagacagtgaggagaaagcccccatctcatctcatcatcatcatcatcatcaccccatctcatcccaggagcgtgcagccatg

SEQ ID NO: 636 - DNA, 1501 bp, Oryza sativa
aggacctgtccgggaagctgctgctccagacggtagcagggttcgcgagagcacacagcgcgatgagcttgtgcacgatccgtctggcctcgaccaccctgttcacatggtatcctggtcctggagacatcaactcgtcggatagccagttcttggcttggcagtaggccacgggacccgcccagtccctcgtgctgaagctgagctgctgcggcggctgctgcggcggcggcgtcaggaaccgggaaacgtgcagccatgtcatcatcagacagtgaggagaaagcccccatctcatctcatcatcatcatcatcatcaccccatctcatcccaggagcgtgcagccatgtctcgggaggctcctgcagcagaagctcgacatcctccggactcccgagcacgaccaccacgacacccatggccctgtggatcacgacggcctccacctggtgcctcagctccacccggtgctccagccagtcggcgatctgggccgcgtcacactgccaccgctctgtgcccagccctctcagcagaatcacccggctcctgtactcttcctgctgcgccgccgccgcctgcgtgatcacgtacggcggaagcaggagacggagcaaggacgacgtgccaccctcgtccgggagcagcagcgaggaggagtccagcatccggaggcccgtcctgacgagcaaccgcggcgccctcctggcaaccaactccgtggcgtccgcgtcgtcgtacacgagcacgccggcgtccccgcccctccacgccaccacggcgcacgcgtactcggccccggcgaggtggtctctcgccgcgcggcaaagaccgtaggctcctccaccaccaccatcggacgtgccagcgacgcggacgacgaagacgcacctcaggtggagatccgcgtcctcgtcgtccagcaggtaccgaggcggcacgagcgaccggaggagcccaggctcgggctcagcagtggtcctccgcctctccgcctcatcgtccagtgcgtccaagatgtatccgcgcgggtcgccgcgtccgctcgcctgaacaaatccacattcacattgtcacggagtactagctagtagtagtagtagtagtaattagttcacaaaatgtaactagcctggcaacatcatctcggctaattgagttgtttactgattcatttcttgtgtaataaaaagcgcagaatcatgccttgaatcctattaaaaagaaagattcaaacaacgcaaagcattgtcctatcgagttttggtgattttgctcttagcggacaggatgcattgggtaaccgatttcgtccaaaccttcaataaaaggctacaattctaggagagagctcatctgctcatgtatcattctccaaatacacgtgaaccagaagcactgagcagaaaacattatcgcacagacagcaggaaacaaactcgcatagacagagcgggatgcagagattcagagaaaacaaactcgcacagacacagcag

SEQ ID NO: 637 - DNA, 1501 bp, Oryza sativa
agaaatatgtactgttggtcaccagttgggcgatacccaccgtataaaaaatcaggatccctcttcgctgtactactaccactccaggtgagagcatgcacacccttttggtcgaattaatgtgtcattagaagtgaacagtcattgttccgtttaatcatactgtctcgtcctatgaatgcgtcagtcacaactcctaatcaggatagcaagtacaacatcatgattacatactcctactacagtcctagttgcactactactagtattagagcaagtttaatgtactagtggtgtagctaactaattaactaattgctttaaatcatttacgatcactttaataatcaatttatacgatagttatctataaacatatcacatatactacactattaatatatggtccctattatacacatgttgtgttttagattccgtactgcagctggttacagatctgtagcccgctgctactctctctcttcttttatctcctcaatatgtatttatagttggcttataatatctgagaaagcttaatagtatagcccactactagctccaatttatctatagccaatctaatggttaatttatacaatagttgcttactatgtagtgacagaaaacacgaggcctgggagatttgcttaactccagtgcaggtccaaagctcgcctttgggtgtactagcgtgccagttgatttgtcacgccccgaactagccccgaacggaactagcctgtgacgctccaaattaacctgttaatcgataccagtctcaggaaacagtgctggtatcacaggaagacagaatatcatagcaacagaggtctctttattatagagtaggagtacagtcaagttgggctgtggacagatcccgaggtcacaactgcattacaaaagggaaagcggaagccaagacttggaccattcatcacaggcgcgacttgggaactaggccgaaaccctaaaactcatcgtagccgacttgctcctggaagaactcctcatcagcaggatccacatcatcctcttcagcaacttgggggggattatttacatagagcaagggtgagtacaggagtactcagcaagccatgggaattaagtgtttaatgcaggcttcaaaagaaaggctgttgtttttgcaattggttttatttaaactcctttttgaaacaactaagtgagtgcttctcaaacgacacggatgagacagtgtgtctcgtccggtcggagtatgtgcaatgtatcagtttttgaattgattcaaggttggcacccgtccaacagctttcaaacggccacccgggcctggctgatcccatcagccgcagatttttcaaacatcgaacccattccacaacagtaatttcaccagcagtagtcaaacaaaactacgctaggaatcacctcacatctgcccatgacagtgggcacggctgttcgaacagtttaataacctctgcagaggggatacactttacccaca

SEQ ID NO: 638 - DNA, 1501 bp, Oryza sativa
cgggagcacggtttcccgctcttgcacttaaggacctattcctttggaatttcatccgaacatataacaagtacgaccacatgggtgaaatgggacacccctggctgagtaattagctaatcaggggagccttgatgccgagagacaagtggatttgccagggtggtgtcggggaggacccctgggcttcctggcacagtatggtctgggacctaacctgttgttggtctgggacccctctcgtcggcatatggtaaacctgtgtcggctctcgaaatgccttgtcatgaaagcctcaaggacaccagacgtggctgttctgcacgggctgggtgatccgggttagtaatgtcgtgtgggtaaagtgtgccccctctgcagaggttattaaactgttcgaacagccgtgcccacggtcatgggtggatgtaaggtgattccttagcgtagttttgtttgactactactttgtgaaattgctgttgtgggtttgggttcgatgtttggaacatctgtggctgacgggatcagctaggcccgggtggccgtttgaaagttgtggtcgggtgccaatcttgaatcaatcaaagactgatacaatgcacatactcagaccgaacgagatgcactgtctcatccactccgaccggacaagatgcactgtctcatccgtgtcgtttgagaagcactcacttagttgttttaaaaaaaggagtttaactaaaatcaattgtaaaaacaacaacctttcctttgaagccttcattaaacacataattcccatgacttgctgagtactcctgtactcacccttgctctatataaataaccccccctagttgctgaagaagatgagatggatcccgctgacgaggagttcttccaggagcaagtcggctatgatgagttttagggtttcgatctagttcccaagtcgcgcctgtgatgaatggtccaagtcttggcttccgctttcctattttgtaatgcagttgtgagctcggggtctgtctgcagcccatcatgactgtaatcctactctataataaagagacctctgttgctgtggtattcagttttcctgtgataccagcactatttcctgggactggtatcggttaacaggttaatttggagcgtcacgggctagttccgttcggggctagttcggggcgtgataaaagatggtatcagagcacaggcttggcccttggacgaaacccgacgtttaggacgaccctaaggatattaagttcaaaaactacttgtgaaaagctaagccttctttttgctttctttattttcagtagtttgttgctaaaatggttactgatcttttctccctctttcaaaattgtagatggcagtgaacgccagcttcagttcccatggttttggtgagggtcaccacgtcgctcagcttcgtgacctcgcccgcttccttggcttctcgtgtcccgagtacacggggtactccgtggaccgtgttccccctcgttgt

SEQ ID NO: 639 - DNA, 1501 bp, Oryza sativa
agagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatgg

SEQ ID NO: 640 - DNA, 1501 bp, Oryza sativa
agtcaaaaaatttaaactttaattattaatagtaaaaaaatttaaaaaagatcaatcatgtaaaattgatggtattagatttatcattaaacaaactattataatatgtaatttttttaccttaaaatactagttttacaatactagttttacagatattggtagtcaaactaatattttatattttagagaccttattatagtttaaaatcattatattttgggaggtagcgagtaccgcggtaggacgcgccaccacggagcgaaaggaacacgagattcgtccgaccgccgcctcgcgctcgccggcagttggccatcgttgacgcctcgctcgggcgcccggaaatggtgtctcgccacgtgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcgacagttggcgcgccaggtaggggctgcgtcgagttttccgtcgagaagtgcgatggaactttgtgctggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccg

SEQ ID NO: 641 - DNA, 1501 bp, Oryza sativa
  unsure (1)..(1501): unsure at all n locations
tcgaggaggccgtggttgagcgcgcgggggagctccgcaacgtagaccctgaggaggcggcggcggtcggggccggacgccgcttgctgccgcgagaaggggagcggcggggaggcggggcgcaggaggaggaaggagagggagaggaggagcgcgacggggacggcgaggagcgcgaggcgcgccatggccgccttccagatctcgctctgcttgcttcggatgggaggaggaggaggagccgccatggccgcactgctgcttgtgcgatgcgttcgtgggcctgaaactagtatacttaactgggccgggcttttcactgtgtccgtggtccatttgccgcgaaaaaacaaaaaaaaatcctcgtcttctctctcgccggaaaccgcttaagccagcgccaccgtgtcccatgcgctgcacgcgtgctcaacaccggagattgcaaattntnttgtatgggtttttaagttcccccttttttttttttttttaaacaaccccccccccttttttttttggtgggttctttcaaatttttttttctcccctttaaaaaaaaaaaaaaaaaaaatttatttatatataagatctaaacattttaacaacgttatttgggttagcgtggcaagacaatactactacgtcgatctggctaatagtacgtctattatcttgacattgcagcagtgagaagggcacgagagaaatagaagtcgtcatcgacgtcgcctactcccttctgctgctcccgcttctcacctccgcagccatcctcctagtcctctccatcgtgaagccgcctgtggacaagagtggctgcggcggctggtctgccactttctctaacgacgcccaccttgcattcatgtccaccgccatgctccggctcaacttctttcctacctcaccccgctggtctcctccccctcctcctcgatctgccggcctgctcagacgaggagaagaggacagggtaatgacttggtcaccatgacatgcggagcctacgtgggtcctgtgctgactcagctgctttgttgaacaaaaccagggtcaatatcacctaaagaccaagaataattcggttctgtaagttgacaattttgtaattcgctgagggacctcagttgtactgtttactggaatctgaccaactggacaaacgacccattttatacttcctaggcccatatactacgtggcatggtccacgaactgatcgaatcacgaggcccacggcatgagcatttctgggctcgggatgggccctttcttcccttccaagccgtactccccccaacacttataccatctccaatcctatacttccccatcgcatcgcatcgcacattcgcactcgtctcgtcttactcaccccgcacgtttccacttcccctctcccccacctcaccaacactcctcgccgtcccaccaaaccctactaaccgccgcgcgcgagagggtcccatccccgacttcgccgccatggccggcgctc

SEQ ID NO: 642 - DNA, 1501 bp, Oryza sativa
  unsure (1)..(1501): unsure at all n locations
tagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttttttttttttttttttaaaggggagaaaaaaaaatttgaaagaacccaccaaaaaaaaaaggggggggggttgtttaaaaaaaaaaaaaaaagggggaacttaaaaacccatacaananaatttgcaatctccggtgttgagcacgcgtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagca

SEQ ID NO: 643 - DNA, 1501 bp, Oryza sativa; identical to SEQ ID NO: 634

SEQ ID NO: 644 - DNA, 1501 bp, Oryza sativa; identical to SEQ ID NO: 637

SEQ ID NO: 645 - DNA, 1501 bp, Oryza sativa; identical to SEQ ID NO: 639

SEQ ID NO: 646 - DNA, 1501 bp, Oryza sativa
gggggggggggggtcgggcccgagggtggtgtgttcgccctcctctttgtctccccgagggggtcggaccgctcccgccttggccccgagggttggggcgccccgaccccttgtggattttgcgccgcgtgtatgggttaggtgagcacagcggcgctcacctaaccgcatttattgcggtttggacgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtgaaagtggaggtaggtatgggccgtcccgtcagaaggtgattcggatggcagcgatacaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggaggggggggggaaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcacctcatcccatcccaattcccaaacccaaactcctcttccagtcgccgacccaaacacgcatccgccgcctataaatcccacccgcatcgagcctatcaagcccaaaaaaccacaaacccaacgaagaaggaaaaaaaaaggaggaaaagaaaagaggaggaaagcgaagaggttggagagagacgctcgtctccacgtcgccgcca

SEQ ID NO: 647 - DNA, 1501 bp, Oryza sativa
gtggaggagatagggacctgcttgatgacgagggagccggcgtcggagaggacgatgtagacgaagttgaggttgccgtcgccgacctccttgatggtgagggcgtcgaggcggccgccgaggcgcgcggcgagggcgggcgtggccttgatgtaggccaccagggacgcctcgtcgagcgggcggaagccctgctgctgctgctccgccgccgccgcggccatggccggtgcgtgtgtgggcgtcgagttgacttgaccgatgcgagcgccggcggcgaagcggggaatcgggtgagcgtgtgtgttggaagtggctgctgctcgggtgggatttgtaacagctgccgtttccgcggaagggggcggttctctgaacctggacttgtttttggtacaaggccaggattcttcagttgagtcatgtcatcatcgtgtgagctaatcttgaggagttcaggctatttttgagttttgaatatattgcttcaaatcttgaactgaatgcggcttctagctattggatttggtgcttttcgtgccataccttctccattttaaaatgtaatagcatttctgatataattttggataagtgtttgttcacttaaagtatgatgagataagagttaaaaagatcagaaaaattaaaaattaaaaattggatcacttcaggctagctgccaatggcggtgtactggcgtaccgtcagttggagttggaattttctaggatatccaccagactcaatatggtgtactgaacaaaatgttcttctatagataaaagacgatatttggattccaaacacatttttaaaaaaaattgtaagcgcgttagatattgaacacggggtctcaaaattgaaatcacacattccattctataagtgcatcttgttcttctatatatagatacatgccatgactatatagttttgctgaaaaaacaggtctcaggtaaggaccgtatattcatttaatatgaaacggttactgttcaggttcgtttgtgtgtttattataaaaatagaaatttactgtgatattttagaggatcacaattattgtctcccttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaa

SEQ ID NO: 648 - DNA, 1501 bp, Oryza sativa
ttgtgaactaaactttaaagcctgggttctcagtattacttattacattgttcttagcagcctttttttgaagtctgtggatatggcataagtcaattaagggtgaaattatgattaaaagcatattatgcttcctgcaatgttttttgacaaagggtcaaatacttggcaccatcacaaaaatcagagagttggaaaatattatcatatgtggcaataatatatataggcccatgccctatgtgtcattctcacatgtgatggtattttgctatttgcatatctttacgatggcgttttccaatttctcttcaaaaatggatattatggatgttcgcatacattgagaaatgtatggttttatgtatctgttcgcaaaaaatacataatgtaaaccacacttatcagaaccagaccggcctggcagtccaaaaaggaaaaaaagggaccagatcccagccagtctggcacgctgttggatcattcaagcagttagcctgacttgaacaagtaaaaccctggccaaagtggacagtttttcagtgaaccagccacaaaatgtgtgtggccccaaaagttggttcagttattaattgcaaaaaagttatacaagggtataggtataactaactaatatgcagttatccatcattaacagcagcatagtaactggttggactagaacccagttatcattttgatatgctgtcatgtaaaatgcagttacaacttacaagataacctggcatgtagagaactaaaatggatatctgtatacacatttctttttactatatatacgaaaaatatttaaataaagccaacaaaggtaacaatgtaaacccattatttattgcatgaaaaagtaccattctaccaaattcccgcatgccaaacatagaattatctttgccagcaatattccatcattgtatggtgtagcaatacttctgccacaaactacgttgagttaatgagttgagcaaagtcatccattcagatgaggattacttcctttggaaagttatcaccagaaatgagataaatggcatgtttggtagctttgctcatccttatctagcaaggtcagtggacaaggaaactgggttgccttgcttggtttggtaatggacacacaagtcagtgttccccattttttgatgaaaagacaattcagctctcctctcctagcaatgatttcattgtgcattagcaagggtagccaaggaaccaaacacacctactgcccagctattttagcaagaattttgtgctaccgtgcaacacctgatttagaattacctcctcaggtaaacctgagtgacagcatatttgcggtttttcattgaatagaccgataaagttgctacatatcttccagttcaaaggcaaatttaaaggttgcttttgaaggcccacattgaagaaaggaaaaaaaaataagcaatgactcggtcttaagaaactcgagaccgcagtagaagcatgatgcagggaaatt

SEQ ID NO: 649 - DNA, 1501 bp, Oryza sativa
ataaaatgagtatacaaggaccaacttaattaaattgaaaataaaccatcagctgctattgctacaactcagctacatctatctctttgcatataaaggctgggttttaactatttttttaacaaaaaaattgctatgacccgactgctttggctactgctgctgctacggctgtctgccataggactgtatcatttcgcttattggtggaataagcgaaacaacgtatttacaaacagaaaatattttgtaaataaaacttttatatatatgtgttcttagtaatctaaaagcaaaggttggaaaataaactacgatgaaaaaatcccaaaataaactacaaatttaaggctggaaattcaaattttggcttataaacataagcataagccaaaagataagactgatggtcagcagttaggacaactaatcggagtaatcaccctactctttagttcatccgtggtgtgagagcaagtttgatagtatagccaactactatcttcaaatcatctatagttagtttaatatcaaattcatataatagtttcctataaacatatactacataagtaatattagatcccacatgtcatacacacattacgtcttgtagtatgtgccgtaactggctacaaatctgcagctcgctgctcttatctctcatcatttatcttctcaatatgtgtttatagctagcttatagtctgtacctgctttggttaggcctctatggcgaaaggctgagtttgttttccctctttctcaacttgtgctttcttcttttttcatgcacaaactttctaaacaacaataatctatactcgaatagtaaacctgcttgaaaaaatatatattattatattgttcgaggttttagttaataattaattaattatactctaacgagccaccctatttacggagggattagttattatcaacatggagctacgaacacagcctaaatgggctgctctgccgcaccagccgggcagccccatatcggcccatatctacgatgaatcgtgggcccagttagcgctcaacattgggccgtttcactattaaaggcccaacagagcagcacccaaatcaaaaaaatgttatggaaaggaggcaccaaacgtgggccccacacggcagagacagcggcaggtgccgggagtcccttccggcgtccggttcgcgcaatcttgaagaggaaggagaaggcgagcgaacgagtcgacgacgaagcctccgcgaaaaggcggaggagtcaaaatctccaaccaacgcccgcagccgcagcagcagcagcgagggcggaggcaaaattacgagcgctcacgcccaaatccgcgaattcccaccccttctccctcgcccaaaaaatcctcgcctactcccctcccaaaccctagcctcctcctcctcccctcctcgcgcttccaatggcacggtagcttcgcttcgatcgcctcctcgcccatggatcccggcgggatgctgctcgagg

SEQ ID NO: 650 - DNA, 1501 bp, Oryza sativa
gtcactgcacgattcacaagtcacagccgttgccaactccagaagcaaagaacgaagagaacaaataccttacacagttaacccaatgagaggattttccaagaatacatcctgcatccactacgtaataaatccttaccatagaattccaaacaattattcggtccagtaaattatcatcgtattaaaagaacaataactctgtcattaaatcagatatgctcattcaggggggaaagtcagctttagctagaaaaatgacccatcttttctagagactagacggtgtgtgactatataatcataatctactattatattatgtatatatcagaaggaaatctgcactgttttgcaagtaggggcaaaagattactagctgtgaacctgaattaactgttgtgaaattgccctacttagatccgagattagcgtgacaaatagataatcgcatctaagctttcaatggtaaataatcgcacaagggagatgagatgaggaaagagaagaaattccttaccgcattggccctggttcttgacgggggcgacggcgcccttctccctccagtcgacggactccggcagctcctccaccccgtcgtggcggtacctctccccggcggcgcggctcctctcggcgaccttggcgccgaggaaggtcgcgcggaactcctcgttggtgagatcggcgaagcggttcatcccgaggcggaacccgccgcgctcgtcggcgcgggcgttgtgggcgtcgacgaacttgaggttgtcccagaacacgaggaaccggcgctcgtgctcgccgccgagcgcgttgggcgagccgccgccgttctcggcgagccagaggtcgtacgcggcgcgcgcctcggcctccgtgggcccctcctccagcccccgcgccccgtgctccgcgttgtaggagatgatcgacatgtccggcgccgcggtggccgcgccgacgatgagcagcagcaggaacgcggcggcggcggcgcgggcggccatggcggcgacgtggagacgagcgtctctctccaacctcttcgctttcctcctcttttcttttcctcctttttttttccttcttcgttgggtttgtggttttttgggcttgataggctcgatgcgggtgggatttataggcggcggatgcgtgtttgggtcggcgactggaagaggagtttgggtttgggaattgggatgggatgaggtgagggatccaacgccgctaactaacaattctgatctgaattaggttgctaatcgtaacaattcctatcttaattaggagcgaaacagggtggatattctcccccgaataaaaaattttccatggcgaagtcgatcgggtaaaaaattaggaaccgaatcctcaagtaattagtactataatctagctcgtggtaactggtaagacacctcatcggtgtcgaccaaatccgttggatcgtaaataaacaaggcagattttcccccccccctccctttctcatcgggta

SEQ ID NO: 651 - DNA, 1501 bp, Oryza sativa
gggggggggggggtcgggcccgagggtggtgtgttcgccctcctctttgtctccccgagggggtcggaccgctcccgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtgaaagtggaggtaggtatgggccgtcccgtcagaaggtgattcggatggcagcgatacaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggaggggggggggaaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcacctcatcccatcccaattcccaaacccaaactcctcttccagtcgccgacccaaacacgcatccgccgcctataaatcccacccgcatcgagcctatcaagcccaaaaaaccacaaacccaacgaagaaggaaaaaaaaaggaggaaaagaaaagaggaggaaagcgaagaggttggagagagacgctcgtctccacgtcgccgcca

SEQ ID NO: 652 - DNA, 1501 bp, Oryza sativa
aagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaacaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccactttcaacacacacgctcacccgatttcccgcttcgccgccggcgctcgcatcggtcaagtcaactcgacgcccacacacgcaccggccatggccgcggcggcggagcagcagcagcagcagcagcagcaggg

SEQ ID NO: 653 - DNA, 1501 bp, Oryza sativa
tgaccccccggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctatcggcgcccgccagttggaggcctgcgctggaggctggctcggaagtcggaggcgcgcttcgtcggcgaggggggtgtagaaccagtcgctcttccagtcatcccacttcttgcggaagacgcagggaatgtagcggttcagcaccggcccccgcggctggaagtagcaaccaccaatcactgacggcggcgacaccggctgtacggtgaagaaccaccggaacagccgaagagatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagaccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaataaggagttagggcgcaagcggcgaagacaaggggaataatggcgagaggaaggaagcaaatctcttcctcggcgactttatacccttgccaacgttgtgcccggctcctcgtttctcacgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccaagggtgatacggccgcccttctctttgtctccccgaggggtcggaccgctcccgtctcggccccgagggccgaggcgcaccgaccccttgtgggttttgcgccgcgtatattgggtaggtgagcatagcggggctcacctaaccacatttattgcggtttggacgagcgcgtcacgc

SEQ ID NO: 654 - DNA, 1501 bp, Oryza sativa
gtattgtcaatccatgtcgagagggattacgattgatagtgagatgcatgagggattgtggatactcaatcatgtaaacgttgatcgatcattcttctttctgtgcaagcaactcttaccacctaatgtggttagctgatcaagcaacggcaatgctatttcgattgcaggactttcacaaatttcaagcagtcaagctaaaaccgattagatcttggcatgattttttaaaaaaccttcccatgttaaaaccaaaatcaagcatgggctcttctaattatccaatttgaatactgataaaactattcccttcgtacctcctaagtgcaaaatcttcacctgattattaatacggaacaggatatggactgtggatcgattacagaagagaggatgggtgaatcagtggatctgcccactatgctacaccactcagaaaacatcgacgcatcttctcgcgcactgcaggttctccaagcgaatctggcaggagatccaacgctggattggtctagacctcgacatgtagaactggggcaaccgcacgtccgtagaggattggtggtatcacctcatgctgaggttgccgagaccgaccaagacgctgaagtcgttaatcatcctcattgcttgggagttttggtgcgaacgtaatgcaaagattttccaacacgttgacaccataccaccaaggcaccaaccattattgcaaagatcaagaaagaagcggttacatgggtgagggcaggggcaaccccactagcagagttcatattctaggaaacgcggactaactagacttttttcttttggcttttgctctttgtccctataaatatgttctatcaatatatactaggcaaagcttttgccccttttttttgaaaaaaaatctaattggttgaaaatgaatgagttgtttgcattagaatcggtgtcccataaacaattattatgttgtattaaaaaattttagtcgtataaattttacacatattattatattgtaaacactaattacattgccatatatttaaaaaatattatcttttactgtatcatcataaagtttctctgactaccggtcccacctgtcatcgacctgcgctcgtaaggcagccgagcagggcactcgtgtcgtacaaatactagtgtgtaccgcatcgcactgaaatcacaaccgaacccaccacagattcaaacgggcgaactcaaaatcggcgatttaaacggcaataaacgggtgaaattttagtgcatttgctcctcattcccgtgagtccgtgacccaaattaaatgcctttataattactgccctccgattcaaaccaccaccgttggatcaagggctatatatatatataaataaaagcttctttccctcttacgtcggcacacgtcacgcagctgaccgcgcaaaggaaaaggaaggcggcggcggcgggaggaggagaggataaaaatcccatcgccgcggcggcttcgagggcctcgaagctc

SEQ ID NO: 655 - DNA, 1501 bp, Oryza sativa
tcccccaacggacggacaggaccaccgctcttgctataaaattcgctttgcaaatggtacgcatcttgaaagttggaaggcctacttagttactagttatataatataggtctatttgaaactaaaaacttgtgaaacttttctagagcatatacgaaagcctgaactaacatatctttatatgtatatattaataaggtcatcaaggatgtctctatgtcggtcggtgcgtcgtctgtcactgaaaaaataattagtcataaatctcatggcaatttagagttcgagaggagaaatctaatattgatacgagaaatatatatagggtgggttttaagggcgcatcgtaagaataaaaaaaaccacatgattttaacatgaatggaagtataaaatagaaaattgtacaatacaataaaaacacaggaatgatcatttgattaaaccgtaggaaaaacgtaggaatcggatatgagagagagattcaaaggaaattttcaaagagctttgagctcttgctaagtttcctccaaaatctctataatattgtccattccataggaattccgaaggatcgaataggattcaatcctttgattcaaaggcattcataggaatttttttctatagtattgaaatcctccaaaattactatatttttccttcaaatcaaaggagcccttagatatcaatgagccactcctagttgaaaaatgaaactttattggggttaccaagtcgtttgctggtttgaaattttgtgggtgatgattgaaaccatatttaatcatcatttactttcttggaaatttccaaatctatttgcacattttgtttaccaaattggcaggtcagggacatgctataacttaggtgttttctggtgcacccaaaaatgtgcttcatacgtagtatattcgcaaggaaagaattaagtacagaagacgttgtaggaatacaaaagagaaagagacgcgactccaccaaatccatccattattgccaccgcgcatgacgtgagaggaggcattaacactctagctctagcagtacgttgcacaaaagcaaccccattaactaacaccgaaaataaaatttgttgcctctgattaattaaaaacataagtttgtttacattggcacataagaattaatttaaaatcaacttagatgggattgtatccttcatttatgatacaattcagaaaaatgggtcgggaaagagagatactccatccatcctagaattaatataagtatttttataattattttttataagaattagtgatgagtgtaaaattaaatagaacatagttatgattggttgaaatagggaagtatttgaagaaattaaatgagatacattatgatctgtagcacttcctagattttagtcgttagaaattgctatcctttaaaacggaaagtacaatttatttggttaaaagcaaagagacgataaaaagatgaaaaataactagaagttcccaggagaatt

SEQ ID NO: 656 - DNA, 1501 bp, Oryza sativa
ggatgcatgtggtggaggcatggcctcgtttgcgtggagcttactttaggattaggattagcactagcttaggagtagctgctagtatgagtcaaccttaaactcgaaatgattaacgggtgatgataaagccgctccctaatgatgctgccccgcaactgtccagcaactatctggatctctcgctttttctctgcccctctccattactctatttcctcttcctcttggcactttggccttctttaatttattcagggtctaagatatttttgatgtgttttattttctacgactttaaatgtgagtagttgtcctagctcttaacacctttttaaaatgtaattctcctgggaacttctagttatttttcatctttttatcgtctctttgcttttaaccaaataaattgtactttccgttttaaaggatagcaatttctaacgactaaaatctaggaagtgctacagatcataatgtatctcatttaatttcttcaaatacttccctatttcaaccaatcataactatgttctatttaattttacactcatcactaattcttataaaaaataattataaaaatacttatattaattctaggatggatggagtatctctctttcccgacccatttttctgaattgtatcataaatgaaggatacaatcccatctaagttgattttaaattaattcttatgtgccaatgtaaacaaacttatgtttttaattaatcagaggcaacaaattttattttcggtgttagttaatggggttgcttttgtgcaacgtactgctagagctagagtgttaatgcctcctctcacgtcatgcgcggtggcaataatggatggatttggtggagtcgcgtctctttctcttttgtattcctacaacgtcttctgtacttaattctttccttgcgaatatactacgtatgaagcacatttttgggtgcaccagaaaacacctaagttatagcatgtccctgacctgccaatttggtaaacaaaatgtgcaaatagatttggaaatttccaagaaagtaaatgatgattaaatatggtttcaatcatcacccacaaaatttcaaaccagcaaacgacttggtaaccccaataaagtttcatttttcaactaggagtggctcattgatatctaagggctcctttgatttgaaggaaaaatatagtaattttggaggatttcaatactatagaaaaaaattcctatgaatgcctttgaatcaaaggattgaatcctattcgatccttcggaattcctatggaatggacaatattatagagattttggaggaaacttagcaagagctcaaagctctttgaaaatttcctttgaatctctctctcatatccgattcctacgtttttcctacggtttaatcaaatgatcattcctgtgtttttattgtattgtacaattttctattttatacttccattcatgttaaaatcatgtggttttttttattcttacgat

SEQ ID NO: 657 - DNA, 1501 bp, Oryza sativa
gcttgtccttcatattgggggtatgttagttattcttttctgcatatttgagttttctctgcggcttcaagacttcaactgacaaccagattggtgtacttattcaggcatagttgatcggtctatgtaaagttgtaaattgtaatgccaacatgttcgatttattaatttcgtattttcttgccaatgtacagtatgggtcgtctgatgtatgtacatgtaaatggctgtaaaacattcagcaggtgatgtacagagtcttggtttgtaaatactaaattgaagagttattttttccagttttgctgtatggatcaaccggtgaaatatgtatatcgattttaatcaatgcatttgatttctgtgtattgctttcctcctcagttgtttacagtaaggtggttgtgatatctgtttagtgcttgcagtttcctccaatgctgtttttgtagagtacattgcaactttttttttctctgctcccttcatcccaaaataagttaacataatatgagatgtaatatactttctatatcccaaaatataagtgattttagttagatgggacacatcatattattatgaatagctttgtccaatttcgtagtgctaagatgttctatcaaaattagtagaactaggatgttctaaccaaatttatagtgttagatgtgtcccattcgatcaaaatcctttagggactctttggatcgcaggcatggaaaaaacaaaaatgaattcaactacaaaataaaggattgcaaaatgcatgaaaacatatgagtcagatgagagggataggctcaagggaaaatcttcaatagattagagctcttttcaagtttccttcaaaatctatataggattgtccatttcataggaattttaaaatgataggaattcaatcctttatttcaaaggcatccatatgaaatattcttatatgattaaaatcctctaaaattgttgtttttccctacatatcaaataagttcttatattttagaatggagggaatacaagttgttaagattcgtagtatatgttacatcatatactatgtaaattattttttttggaagtaagtagtgttgaatctgagttatgctgtgggatatcgtcgatgcggactacgtcaagctgacgtcatctccgacccgacctcggtcgggctcgggaagtcggtatgtggttgcaccggctcgtggtgccatcgggtcgaaccgcaccagcacgcgacaactccgacccagtcacgtcctcgtctcgtctccgtttcgtgttctttcttgcgggggaggccagaccagagcccaaaaccgtaacatacacagctctctcgccgtctggtctcttctcgctcgcgcgactgaaaggagcgcctcgactcgcatctcgccgccgcgcagctaagctagggttttccgccaccgccgatctcgcccccgcccccggccagccatggacgcctctctcatgggcgccccctccgccgcagcgg

SEQ ID NO: 658 - DNA, 1501 bp, Oryza sativa
ttgctgctgcagctggttgcttgtcctcctcgatcatctctgcttgttgagtcctatatttgatctcctcattggagccgtcttctccttggtccacaaccacttcaactaccttctcctcctcgccgccggtttcctctttagggccctctcgttgcttgacatcaccatcttcctcagctgcagcagcggcgccatcgctggcttcgcgatcgctgccgccgccgcgttcttctggccgtcttctctctgcctccagggagagatctatggcagctctcttcttcttggatgacatgctcctggcctctttctggtaatcttgtgtacctttgtctctcttggtacagctaaaatggggaacggtcttaaatcctaatgctacttctcccgaggcatctaagtcaatgtctgggtgtctaagacgtattaaaagggcaatgaggagggaagactcctccttaatcctattatcccatgtcatctcatattcaacaaaatatattgccttgacacacatgaatgcgtatatatacacgaccttctacacctattgatattttttgggggcacacatgtcagtgatgaatacaatatgagggtttttacgactcgagatgaaatatcaacgagatggattaatctgaaggagtagtgtgaattgtgaagtgcacggtggtgtgatccaaatgacaagggataccgaagtcaagtgggggcttggtcatgtgcatgatgggagagagcgcttctaacgctaaggggattagtattgtatggagcccaggtcaactcttggaatttcttcagggccgctatcatcacgcaccttagtttccccattaccaaaatgacagattaaaatgtgagctatatatacattaatattttcttttcatatgtataaatctagcattctagttgcacaatgtcaactttcaatgccatgtttagtacttttatagaactcgctcgcgctataaattgaactgttgacttgtgtatgtgactataatttagtatcaagtggctcgcaagcacttcatttcatggagaatatagctgtctacagcaccttaggaattgagtaaaacaacatgcaaatttttttttgatgatatatatgtgttagacaatataattcgttcatgacctttatataattcttatgtaattaaggagtgcccttgattgaggttgctagctagcttgtatgcaaacctagcaaaacccaaaaattagttagaaaaaaaaacctaaggtgttaccattttgttttctaaacgcatgcattaattgtgattcacaacacttagtgtatatatatgcttcgatgtcttaagtcggacctctgcaatgttgactcatggcatgccatcgtctgcatcctgtaaggtgatagccatttcagtgccttaatctgatctccttctatagctcaccgatgaccgaagatttatacagtataatggaaaactaaggccggactagcagttgcgtc

SEQ ID NO: 659 - DNA, 1501 bp, Oryza sativa
tctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctcca

SEQ ID NO: 660 - DNA, 1501 bp, Oryza sativa
tgcatatacattacattagcagtgagattaattaatagtaagaacattaattatccataatatgtaattaacattcataatatatatatgtctgttgcattgctggtggtaatgagaatcttgagatctattccaagtccaacgtccaattaaaggagaacagcttatatattagccagtttttggttccaacaaccagttgacctcaatcatcatgacgatcgaagagctagagaaaaaaattatcaggatcaaaggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccg

SEQ ID NO: 661 - DNA, 1501 bp, Oryza sativa
actttttagatggagaagaaagtgtttttgtcactgatttgagttgaaaatggtgaattttgaaccaatttgtggcataagaaaacccttttgccaacctccatccatgtgttagcaatcatggtaggaggatcaagattgaagtaaaacttaaagaagccctttgcttcaaatacctttcttgtgctggttacttagcatgttcttaaaggatggaatccttggcccaattgcagtatcaattgattctctctaattaaaaagttatgtgttgttccttgtttctctttaattctggtagatctgggaggggtcctgacatgctccatgtgggccactggttttccctttatctcttatctggctcttaggtgtgacttttttaatgggtattgtagatcacatctaatgtgcttcattgatttgattatttaaaagcctttggttgttgctattcgtttgtttatgttcctacccttctgtggttggatcccataaagtctacctgtgacttctgctgccttggttgcttgttagtcattgttgtggatcttaagtttgctgacttggtttaaggaggaaggctgctgcaagagtaaagctgcaattggttggtaatgttgctcatgagtttttcttgtataattgcaacaaccaaggaggatctttttgtttgttttccattttgacattgtacaatgccagtttgctacttcttgcttcttttttataagtttgcagccttagtttagtaagtttgcttggtttcatatgcttgatttgactcacaaaaatgataactgtgtggatgcctcttttccttgtttgattatgtgattatatcagggtctacattcactgcctctgtggcggggttcatccctatcatcatgttaaatattaaactttcctccttatgccaattcaatggagcagcaaatggtgattccaatgccaacagaaattgctgcctttggaagttggacagttgtgatttgtgttttttgtttcatgattttagttgcgcccttcaactatccatccataaagctgtgttcatttttacgttgccttgtgtgttctgtttgacaaatgatgaaaatgaccagataaggaatcaggaaatgttttgacttggccaaggaagatccatctgtgcagctcctactgacccccacccccaccccccaaaaaaaagtcctcaacacattcttgacaaagttgattaatctttttcccttttgttttgctaaattgtaatataaagaattaaccttgtacatattttctctctttaatgaaattacactactaggcaaagcccttgtagttttcccagtcaaaaaaaaattgtaatctaaagaaggttaatttctgtgtttatcttgtattttaatatccttgcagatccctggcctgtttttgtttataagaaaacaactgtatcaacaattcatgcaaatcacgttatggtttctttctggacaggtttccgaagaaa

SEQ ID NO: 662 - DNA, 1501 bp, Oryza sativa
attcaccttatgcatgtcttaatcataagcaatattatttgtatcattatattgttatagtagatgcacttatcctattcagtttgtgaagaatcaccatttcattataagcaggcccatagatcccccaaggccccaactcatatgcttaataaatcctaaaactgtaaagagcagattagggtggcaaaatactaaaatatggccaatgggtagctcttgtcagtgttccattttcttgcgaatgcgaaatgttgtagacaagctccaatcctctcgattcggaaaatagagcccttgatttgaaaaccatgtgaaatcattctcagccaacatcagtcaattttcattaacagagtttctgaattggtaggcatgacaataaggcatattatactgatgataagcagtaaatatgaccatcgagcattgctacacagaaaagaactgaaaatgacaagaaaacaacatcttgatacattgtctatatattcaccagaaaactaggtgtataatacccactcttcggttgcaaaattacaagaaagaattgagctgcatagttatgatatatacattcgagaaactaaagactgacaaatgaactattgaaacataaagtcctaaaccatcaattaactacagaattgcaatccaatctacaaatcattgcaaccatctctctcgtactgtttatcaacactggagaaaaatacaggcgcagtaatatgcatcttttgtatcgcacgccacaacaccatgcatttaattggtgataaaatcacatccttatcaagctttcaacttgcaaagatgataattcgttcatattcactccacagtgtattctacccgctacttgcatcaactaattgacactctgcagtatcccgtttggcaatttttctgcatcaccatcgatgtggcaagggcatttccagataagcactaccgctgatgtgctccaccatggtggactgtaccagtgtaccagacaagcagtaacaaatgtctacgcggaagtagcgaaaacttaccggaaaccgaacgccacgaggttccgccggtccgcgccgccagctccgccggcatgtggatggcgcgtgcggcgtagaagggggagagttgggggggagatttgggattggcggatagcggatgccgccatggcggccggcctcgagccctcgagccctcggctcgctcgctttggatgggggaggaggaggaggagatgcgcgacgtcgcggcgttgtgggttcgtgttttgggcccatatccatggtgaggtgggcctagcccatcgggaacacgcgagccttgcgcgttttgggcccataacaaaagtgaggtgggcctggcccatcatgaacacgcgagccttgcgcgttgggcctggcacgtgtgcggcccagcccgtggcagcgcggctaacctggtcgcctctcgccgccggcgcggagcgtctcagcgataacccaaacgatatcgatggcggcgg

SEQ ID NO: 663 - DNA, 1501 bp, Oryza sativa
ctgtacggaaaccgtcggatccgaatcaagcggtcaggaactcaggatcaccgcggccgagtggaaactgtccgtagatcgctatcctgatggctcgtagtcgtacatacaccgttggattcgaatctcgcggccagggtggtgcggctctacgtcagccgcgccgtctccttcgccggaaatccagagccgcgtagctccgacaccattgccacttcgctcgagagctgaaagctggcacatctagtcgtcggctgatcactcctggtggcaacaaccaaaagaagtgatcgataattttattcttggctgctgatgaattcagtaaatcggcctggccggcatggtagatcgatgccgtgccatggcggagtcgatgtgcagttacactgaataaaaccagtgtgcagttgtgcatttggtctgcttagagcaggtgcaatagcaggctataagccagctataaacacatttcgaaaaaataaaaaaagagagagaatgacagcggggctacagatttataaccagttgcagcacagacttcaaggtgtatgtgtgtatgatagatgagaccaaatattaattatgtagtatatatttataggtaactattgtatgagttggctattaagttgattatagatgatttcaagccaacagttggctataggacacaacatttttctttttcttttttgaaaatgacacattttcctaagaacatgcacggagttctgcctgtctcaggagataaaggaaaccgaaactcatacagcaggattcacaggagagcaaggaaggtacttcggttctgatgcactggagatcgagtgcagatggtgctgtgaaagctcttgaacagcaggaaggtacagagatgtttggctcagctcaccttgaatatatatgcataatatctgggttgaccttccacaaatatccagatcaatggcacaaacgtgataaaattgattggaaaatcatttgcaacacaagatcacgcagtgtaactggagtggacttcatgtcgatccaagccgacacaattggtagttgacacaatgatcatcaaattctcaaaaaaaaaaaaagacaatgatcatcagacccaggcacccagcctttcattttttttctaatcttcccttaaaactacaagcatccaatcttcaactccattaccttaaaaaaaaaactaatcttcaactattattatattaccaattaaactattacacgcttgagttgcaaccatttctgcagtttcggctccacgacgtgcatggctcaaaccccgccaaaagctcacctcgtcgtcgtcgtcgtcgtatctctcctcctcgctacgtgcgaggcacatcgcgtgcgcccacgatgccacggccgcgcgccaccgtcctccacgtcgtcgatcatggcgaccttataaaactcctccgccgtgcgggcctctccctcaatccagtattccactaccgaggtcgagcaatggcggcgacga

SEQ ID NO: 664 - DNA, 1501 bp, Oryza sativa
gcgtgcgcgcgcgtgggcgtgggcgggtggtgcttgacctcgatcgcctgcgcggttgagtgcgccacggcgtcctcgtcgtcatcgtcgtcgccaaggccagcgcctccttgcgcctctcggcaagccaacctcgcggctcgcgcccacgccgtggtggcccatgcgggccgcgccgctgacattttcgccgtacgtgcggccgcggttcgatcgccgttggtgccaggttgctcgttctctcacgctggttgtttgtacggctcggctaagctactccctagctatgattcccccattcatcgtaaccacatcttctaaagtattaaatgatgcgatttatacaaaatactttttatataaaagttttttttagaaaaataaatgaatctaaaatttcaagtttgtactccctccatcctataatataagagattttgagttttttttacatcttttgaccacttgtcttattcaaaaaatttgtgcaaatataaaaaacaaaaagttgtgcttaaaatactttagataataaagtaagtgacaaaaaataattctaaatttttttaaataagacgagaagtcaaacagtgcaagctaaaccttaaaatctcttatattatgggacggaaggagtaatacattaacacatccggctctatacaagggtttgtctacctagataatcaaatgttattatattttacaacaaagataatacttaattattcgtgcattaatgttttgtttcatttcgctcgccaaaaaaaaaaaatctgagccataataagctgattgtttcattaatgtgtctgtttcaactggtgaagtcggtaagagagattttcttcacaaagttcctcatggtatacatacagtatgtatgaagccgcaaaattacataggtaggtgaacagttgccacggttttcccaagtttttactggattccacatctgcaaaagggtgcgaattgcactgtgttctcatatgtggcaaccttgacacacagatagtagtaacagctggtagaaaaagcaccaaaccactgcatttggctgagacaccaccccatgttgccctgtacctgtagaactgtactacttccagaattatacttgtatttatacagtgacataccagtatggctacggacgacacacggtggaaacggctatttacacggcgtcttttcggcgggtcccaccatgatgctcccgagctccgcgttgcggaggcacagcgccgcccggaacacgccgttgacggcgtcggacagccggtccaacggcgccgtcagctcctccgtccgcctctccacctcctgcaccgccgcccgcagcgccgcctcgtcgaggtcgccgtcgccgttgtcgagcacggatttgagcttgccgacggcctcgtcgacggcgtccacctcgctgggtttggtggcgagggcggcgagctggatggacacggcgttgaaggcctcggtccacgggaattcgccggagacc

SEQ ID NO: 665 - DNA, 1501 bp, Oryza sativa
gcctccgctcctccgatccgcgggctcccggtctcctctggtggatccgcgatggaggagcagcagcagcagcagccgctgctcgaggtttgcccgtctccccctttttcttttgccgcgtgctttggcggcatcgccttgtaggggttccgtgctgttctagtgctcttgcgtcgaattgggtccatgattgggagcatcattgcgcctgatttgcaaccgtcggctctcggtcttgcctaagtttcgcacccatctttttggtctccgttgccaacacgcgagggaatttctagcctataggataattaataatgggtcggggcatcgccctctacttgttatgtagattgtagaggtgttttttttgttttgttttgttttgtttcttgggtaatctgcgcatccagttggatcatgagcttggggtttatccttttgtgagcttgggttgtctattatcactcattcaattattgggttattttgttaaaggagacgtctgatgcttgatatctggattatttggagtgccaaatgctctgggaagtaactgatatccgacgagtaaccctgctgtagccttataattgatacgctttggtctggatggtgatttggctttagccttataattttgttggtcggcccagacaacgagtctatgaccatgatcttaagttgtaatgcaattcagaaacacggatattatctgtggtaactgacatgatattttacaactatgtgctccgagaatcactaatgtacccttttttgttggtaaaacttctgaaacaggtactagcaacttaaaataaatttaatttgtgttcagaaagaacccagagataggcagttagcacagcataatcagtaaattgtgttgacattgaacatcatttataatacatgattgcagttttgttgatttagatatgactgctaaaagctgtgcttactgtgctacaatctcacgggagaaaatctgttataaagaattgctcttgaataaaattatgtgctcttggctcagtagcaagaatgatattccctaagtttcttgactgaaatgataaacaagtcaaggttgtgagttacagtttgctgattggaaaatgatatgatgagttgttttaagttggactaatattctctacagtaatgcgctaattgcaattgtccttccatttaggtagagcaatgtgtaacatctataccagaagatcatgaggccacttgttggggatgtggactccgtctcatttttgcaagttatgctcctgtttttaagtgtggctggtgtggagcaatcacataaagtaaccaaacttcacgaaaacctgacagtgtatgcttttctcattggaggaatttccgggacaggttctttgtgactgtgctcatcctcttcatgctcttcgtcatatgtaggttccgagtctattgtcatctgctttagataaaactttccatcttgatctctccatgtttatttgtttat

SEQ ID NO: 666 - DNA, 1501 bp, Oryza sativa
ggatgggagtgaatatttttaatattgcgatatactccctccgtttcagattataagactttctagcattgtccatattcatatagatgttaatgaatttagacacacatatatatctagtttctttaacatatatatgaaggtggataatgctagaaagtcttataatatgaaacggaggaagtagtgataccaactaaactcgaaaagatgaggggcggcaagtagacttatttccgctggaatatgctaccggatggtgctaagcccatgcagagaaacttgaccgagtcgcactaaaaaggaataagttcacttcatgacccttaaaagagacccgaatctaatccatgaccctaaaccgcaaaaccggatatcttcacccccaaactattgaaaccggtgcaatttgactcccttggtggttttggatggcggtttcgctgacgtggcgctgacgtggcagtgttgacctagtctgtgtgctgacgtggcgctgaggtggcatttcaattaaaaacatatatgtgggacccatttggcattcacacacacaagattgtggggcccactaacatgtgggccccacctgtcatctcttccctttcttcttcctctcgaacctcccctcctcctcccttctctctttttgttctacctctccacttcgggcgtctgcggggagcgagcggcggtgggcggggtctgaagcgacgcgaccggtgggagctgaagcggcggcggcggcggcgtcgagagctagctggagcggcggcggccggagctagctggagcagcggcggcggcggtgggctggagttggcagcgtggggcgtgggccggattggtggcggtcggcgagagctgaagcggcggcgagctagagctacgcgagagaggacgacagcgccgacgccgacgagatcgagcggggggacggtggtctatgggccggctacagcttcggatccatccgcatcgccgggatcagagctcctcgtcgccttcctccaacacctccctgcatccatcctcgcatcgcgcgggacgtcgacggcggcggcgggcgcgggatgtcgacggcggcgggcgcgggacgtcgacggcggaggcatcgagcgggttgagcggcggctccggcggcgtgcgggcgagcgcgagtgcgggaggaggcaccggcggcggcaggtgcaggacgtcgacggcggcggcgggcgcgggacgtcgacggcggaggcatcgagcgggtcgagcggcagggctccggcggtgtgcgggcgagcacgagtgcgggaggaggcaccggcagcgacaacatgagctcggcggctccgcttctcccctctcccttccggccctcacgcgccaccgccgcctctcgtgtaacccaccacctccgttcctccctcacctgctctcctctcctctcctctctccacttggcaaggctgatggcgaggctaccgccgccgccgccgctgccgctgctctggcccacccg

SEQ ID NO: 667 - DNA, 1501 bp, Oryza sativa
agctgggcgtcgaggaggctgtagtacttgaggccgctcccggagtcgagcacgccggcgttggggcggaacagcgcgtagtcgagggagatgacgtcggcattgccagagtacgcgaagaacgggtacgcgttcaccatgaggtacgagccggtctgcgcgaggaagtcgagcatgggcttcatgaccgcctgggcgaggtcctcccggaacacgccggccgacggcgggtacgagccggcgagcgcggtgagcgcgatgggggacgacaccttgacgggcttgtcaaggctgagcctcgccagcgcggcgtgcacgttggtcatcgccgggacgagctgcgccgtgaggttcttggccgaggcgaacacctcgttcccgacggcgatgccctggatctgcgtggccgggtagtacgctgcgacgttgcggcgcacccaggcgagcgcgtacgacgggcgcgacgccgcggcgagcagctgctcgttgggcagcgcgaccaccaccttgatgccggtgttggccagcgcccgcagcacggtcggctcggtgtcgtacagcttcacctgcgcgatgccctgctgcttcatcagctgcaccaccgccgccgggttgggcaggtcgttcgccaccctcccatagttgatccccaccgtgcccgcctctgtaaccaaaccaacccaacaatcaaccacactactctccactaaaccacctgcattgccaaatctctcgttacctgaagcggacaggaagagcagcggcaatgcgacggcgaggatgagggcgcggaggcgcccgggtagagccattttgctgctcttgctgctgctcactgctgcgcgggcgcgagaggcagcagagcaagacggcgacgagtcgtgtagtggagagcgtggtgagtggtggagagggggggaaaagggcggggatttatggttgggggaggtgaggcgctgtaaagtgggccagccgcacgcgggcgggttggttttgggtggggaggaaatggcggggatgttgggagatgcacgtcgcgctcgcgtcgggttcgtggcgaagtgggtggtgcggccgtgcgagcgagggagagcgaccggcgcgccggatgaccgttgtctccgcctgcgcggcgggggcccaacgaacgtacggagcgcttgggctggctcggggttaagtggttagttgctggctaatcaatgtcgatgaatgagactgtacttgtagttaagcgtgacctaattgctctcatcccaacggctccaaacttgttcctttctcggacgatttaatttcctgagctgaaattgttggacgattttcctgagctgaaaatgaaccgaaatgtgggtgtggtagtttctggcatgtgggaccaaaatcattctgggctttgcaatatttatcggtgttcggtgaacatgctccacatagactgtggccctgtttagatgggactaaactttttaagtccctatcacatcggatgtttgaacac

SEQ ID NO: 668 - DNA, 1501 bp, Oryza sativa
caagctgtgccgaggctggctgaccattattgagagaggccttgacccactccggccatcgcacatttgcctggctaacctcgccattgcaaaccgagtcaaggttcaaagctagctggaactcctgagctagctgtctctgattctaattaagctgtcaactggctactagtcggtgccggacttcatgccggtgatgataattcggcaggaatgaaattaaatgaattacatgcatgcacgttcctcggttcctcctgctatttcctcctgagaaatcgaacccaatcgaattggcacatggaatgccgagtccaaagaagtttctggcgaaaaaaaaaaggtaaaacggctagaagattgtgacatctggcttggaattcggttgcattctggacagtccaagtatgcatctagaagagaagataaattttgattagatgaaagtatgaaacgcctcgaccaaaagttcatcacttttctcttccaactgttgttttctggatgatttgggtcaatttcagcggttgatgtttgtttcaaaatattctgggtgggatcttccgcggcgaaaattaggtacagtgacagggtcaaacacaagtgctactacgtgttcatcttatctacgtgttccaggatgtagctgcaactgcaagcgcggaaaaagggtcaggcgcggaaaccgtaggttaggagagaaaggtatcgaggctgggaaggagagtgtcaatggagatgatggcaagaagcgcactcaaacccttgcagaaaagaggagggaagatagtggaacgagagaatgcaaccgggaataggagaatttactctatgccactggattaatattggtacagtcttttctgtttcattaaggaaaaagaaaatctagcaaggattaatgtgacataactgtataaacattcagtaaagaatttccgtttacgaagaaatgttgattaatcgaccaaggcttgcagcaaacgaaacgtgctcgatctaatttggtaattacgtctgtatattataaaccagtaaaccactgctttgatcccaagaaagtgattactttaaaacaagtagacgcgataggtcattatctagattcaggacgccatgtcagcgtgcatgtcacctttgcttcccctttcttcagatgacaacttatccaagccatccaagcactcttagcagccgcatctccagacacaaccgatgtcatcaagcccaataatcaaacaccaaagcataaacgacgccgcatcagacaaactaaacgcgacaataaaaaaaaatcgaccaaatcgcagacacacaaattttccacagtttcaggctcgcaggcagctcgccacctccttccttgcaaagcaaatccaaccaatcaaatgaacgaagctatcccccaccaagaaaaacaaaaaacaaaaacaaaaatactacacttcaccgcttgcgtacacgaccaagaaaatccgaaacaacatgcagtccggctcga

SEQ ID NO: 669 - DNA, 1501 bp, Oryza sativa
gggcccactgacatgtgggccccacatgtcatcctctctctccctttcttcctcctcccttctctctttctttctctttctcttttctcccctttggctggccgcgagggagcacgggcggctggagctggagcggcggcgggtgggccagagcagcggcagcggcggcggcggcggtagcctcgccatcagccttgccaagtggagagaggagaggagaggagagcaggtgagggaggaacggaggtggtgggttacacgagaggcggcggtggcgcgtgagggccggaagggagaggggagaagcggagccgccgagctcatgttgtcgctgccggtgcctcctcccgcactcgtgctcgcccgcacaccgccggagccctgccgctcgacccgctcgatgcctccgccgtcgacgtcccgcgcccgccgccgccgtcgacgtcctgcacctgccgccgccggtgcctcctcccgcactcgcgctcgcccgcacgccgccggagccgccgctcaacccgctcgatgcctccgccgtcgacgtcccgcgcccgccgccgtcgacatcccgcgcccgccgccgccgtcgacgtcccgcgcgatgcgaggatggatgcagggaggtgttggaggaaggcgacgaggagctctgatcccggcgatgcggatggatccgaagctgtagccggcccatagaccaccgtccccccgctcgatctcgtcggcgtcggcgctgtcgtcctctctcgcgtagctctagctcgccgccgcttcagctctcgccgaccgccaccaatccggcccacgccccacgctgccaactccagcccaccgccgccgccgctgctccagctagctccggccgccgccgctccagctagctctcgacgccgccgccgccgccgcttcagctcccaccggtcgcgtcgcttcagaccccgcccaccgccgctcgctccccgcagacgcccgaagtggagaggtagaacaaaaagagagaagggaggaggaggggaggttcgagaggaagaagaaagggaagagatgacaggtggggcccacatgttagtgggccccacaatcttgtgtgtgtgaatgccaaatgggtcccacatatatgtttttaattgaaatgccacctcagcgccacgtcagcacacagactaggtcaacactgccacgtcagcgccacgtcagcgaaaccgccatccaaaaccaccaagggagtcaaattgcaccggtttcaatagtttgggggtgaagatatccggttttgcggtttagggtcatggattagattcgggtctcttttaagggtcatgaagtgaacttattcctttttagtgcgactcggtcaagtttctctgcatgggcttagcaccatccggtagcatattccagcggaaataagtctacttgccgcccctcatcttttcgagtttagttggtatcactacttcctccgtttcatattataagactttctagcattatccacctt

SEQ ID NO: 670 - DNA, 1501 bp, Oryza sativa
tcttcctcctcgctccatctcctccccctagctttcggtagtagcttgagtagactccccgtagttagccggcgccgccccgaccgttgccgtcgctcgccgtgtgctcgccgccgtcgccgcccgagctccgtaacacccgctcgtcgccggcctcgctcggcgtagttccgcccaatccgacgctagcatcggattcccgtagccgcgtggatgctctcgccgccgggaattggcccctcgtgacctcgtcgccgttttccccttttcccgccgccggttgccgccgccgcgattcgccgccgtcaagctccctccggcgaatccgagccgttggctcgtctcccctcatcacgtgcaaccacccggtgtgctcgctttcgccgatatcgccgtggttcgctccgccgctcgccgctgttgtccgccgtccgttccggccggcgtcgtcgtctacctcccgccggcccgcgtggcagccacgtaggcgccacgtcggcgccagctcagccgaggtcgggacgggccgaccccggtcagcccctcccgtgcgcgcgttccaccgcgagccgtgaggctgcgcatgggcccgccgcatccgttcctccgcgaaccgcgcgcgtgcaccgcgtcccagccccgcccgcgcgcgtacgccgcaaactccctccgcacggtgagccgagccgctaacaagcgggtcccacccgggaccgcgcgcggtgagcccggtccaccggctctctctcccctcccctcccgcgcgcgcgcttgggccgtcttgggccggccggcccgttaagctcggccgagccgctccatttaccttgggcagcgccctagccgcccgaggaaaagtctgatttccatccctcttttcttttcttttcttttcttttcttttccaaaaaggatttaattaaatccttttcctttagaccaaaaatccaataatcttagaaattcaatatcttcccaaccgtaaatctgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctctagcaaggcaagccacctttgaacatcttgagcctatatttgaaatttaattatgttgcttgaaaaatattatgcattgataggatcgcacttaatcttttgtcccgtctgcaagacagattggcggacttacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaac

SEQ ID NO: 671 - DNA, 1501 bp, Oryza sativa
gacactggtcatccgctccaaaaagatcctgtggtagctagtgtacctggctgcctttgtgtgcagtcatgcgttgctcgcctcatcgcctgtgtggccgagagactttactgaccaagcaattcaggtcggcagagtttgttacgtcctccaaggagaggaccatgcaattgcatgttgcgaaagcagaaaactggagagaccggggcacgctgtcggcgtcatgctacaagcgttcccttgcgtgtatgcatcgtccacctagtcacttggatgagagatttgaggggaacaaggctacaaaagtacaggtttgttatcgacaattatttggtctaagtgtagctgaaaacagtcgcgcgtatagcacgtttgattaatgctcagtcaccattttgtttcggtttacatgctaacaaaagtagggtatatcacgtcgttgaagtttacattttgtaacactcaatccagtagtccagtcaataaagaattttttttcattaaaaaggtgttttttttaacttattgtagtcacaggtggtgtttggatccagggacttaactttagtccatatatttagacactaatttagagtattaaatataaattacttacaaaactaattcaataaatgaaagctaatttgcgagacaaattttttatgtttaattaatccataattagagaatgtttactgtagcatcacatagactaatcatggattaattaggctcaatagattcgtctcgtgaattagtccaagattatggatggattttattaatagtctacgtttaatatttataattagtgttcaaacatccgatgtgatagggacttaaaaagtttagtcccatctaaacagggccacagtctatgtggagcatgttcaccgaacaccgataaatattgcaaagcccagaatgattttggtcccacatgccagaaactaccacacccacatttcggttcattttcagctcaggaaaatcgtccaacaatttcagctcaggaaattaaatcgtccgagaaaggaacaagtttggagccgttgggatgagagcaattaggtcacgcttaactacaagtacagtctcattcatcgacattgattagccagcaactaaccacttaaccccgagccagcccaagcgctccgtacgttcgttgggcccccgccgcgcaggcggagacaacggtcatccggcgcgccggtcgctctccctcgctcgcacggccgcaccacccacttcgccacgaacccgacgcgagcgcgacgtgcatctcccaacatccccgccatttcctccccacccaaaaccaacccgcccgcgtgcggctggcccactttacagcgcctcacctcccccaaccataaatccccgcccttttccccccctctccaccactcaccacgctctccactacacgactcgtcgccgtcttgctctgctgcctctcgcgcccgcgcagcagtgagcagcagcaagagcagcaaaa

SEQ ID NO: 672 - DNA, 1501 bp, Oryza sativa
tataatttatctcaacattagacaatcaggcatgccaaacccaagcaatgagctgccacataggcaaattaaacatttatttcttaaacgcgtaattgatatcacatcatcgaagtttcatcaacccgctgatgacaaggcgcaaggagaaaccatacctttctacacccgcccagtcgcttcaccacgatttgccgtgtcgtcagctgccatacacacaaaccccaatccaatcaagggttgaaaaacccacaaacaaatagaacctagaataaatattatccaaaaatcatcacaccaatcagaggatcagaccaaccttcccaggattggcaggctcggccgcatcgcgagcggcggaatcgggggcagcagggccgacgagcggccgcttcggtccgggggggcggcgcggcctggccggcgacgaccgcaggaacttccacgcgaacacgacagcgatggcgaacccggcgacggccccgagggatccggcgctctggtgggggcacacacacgatacgagacgagacggggaagcccatctagggttagggttcgcgcgacgcgcgtgtaaaaccgaaactacgacgcgatgtttaccttgtggtggaagaggaggccgacgaggtcggtgaggcggcggttgagggcgcgggagacgcggcgcaccagcgagacggtgtcctggtcggcggcgaggcccggcattgcgcggggtgggggtggggtgccgtacggcttggcttgacttgcttctgccgcgtggttgggcgaggtgggggaggtggtcgtcgggggggtgggtgaggaggtggtggaggattggggaatcgccggattgggaggtggagacgaggggaggaggaggaggaggagaccgcgaaattgcgggggcgacgagaggaagcgaggcggggcgtgatgagactgatgtgcttatcttcttggcacaggaagccacgaaaggactaatccaagaatttcttttttgtttatttggccttggccgtatttagatccaaacttcagtcctttttcatcatatcaacatatcatgcacacacaactttttagtcacatcatctctaattttaactaaaatccaaactttacgctgaactaaacacagcctagatccaaagtttttcttcaaactttcaactttttcatcacatcaaaactttcctacacacataaacttccaactttccatcacatcgttccaattccatttttgatatgaactaaacacactcgttccatgatgtttctttaataaatgttactttaaaagaaactattttcttcgttaatattatagcatcctatactacgtgtctacgtagaacacatcatactacaatctgaacggccgagtattagtttttttatattttgtgtcgggatagtattatttttttttctttggaaattcagaataaataaatacggtattgttttcatgatcaataagtgccgattcagatttttttttagt

SEQ ID NO: 673 - DNA, 1501 bp, Oryza sativa
ccatgtcaaatttaatctttcgtttactctagtgtacatttagtgttcctggaatatatgggtagtgctagatagtagttttgagatgccaatatgcaagcttggttggcatagattgatagataggcttgtgttgggctgtttttgcctgggatccagtctattctctatgtagactatgggcaggatttccatctaaatttcggcccaagtactatttttcacagttttagcggagggcattctctatagtctatacatacccatccagaatttaatcatataaaagcctagtagtttgagaaatgattcgattgagcaaaaggctagtcgagcctagcaacaaatggaatggacaaaaggcttgagcatttagcatgtagccattatataccatctcgtgctgcttgccacgtcggatcatgatggcttgcactggaaaggccagtctagcctttaggccatttgagtgccaagcagcacacacacatggcactttgatgagtctttcctcctttcgctgcctggcaatcgtggcactttgaggtgatgtctcccttgcttaattagtaggcacactgacctgcctgtcaaagaatgatatgattactcgatcgtagtagactttttttgttaactaggatgcctgcaccattaacctccactaatcggggtgtaaagattcatcagacatctgagtcccagttcagatagcattaacctccactgatgatgctagtggtgtcgcctcatgtcagtgtatgtcaccctgcaatttggtcttccctggataaaagctttgtggaagatgaatggataaaataagcataaaaaaatgaaacaagaggagcaccagatgaaaactcaaaactatactgtcagtctgtcatgattgatcagcattgattaaagatttttttctggaaaatgtctatcataataaccaacagaaatactttgtgatgaattgagcagtcacaatgtgcactatagattcttttgtgataagccccaaaaaagaaaaaaaaaggagaacgatgctatcaggagaaccatgtcgtggtctgcactccaacaaagtagaaatgctgtgttctttcagaaagaagtagaaatgctgtgcaagtggaggaacagaatcacatactccattttctccccggcatttctagtccaaagtcaaaacaagaacaagaacctttggatggtccaactaaaactttcttggaaacgtacggttgattttgatcgatggcccagcacccagaatctgaacttctgaagcttgaaagaacacgcataattttcagctggaattggtttgcatcattatttcaaaccttgaacagctgcaactgtaaaacattgaccagcggcttaattacagtttgaacatatagcaaatcactaaacagtaaaaaaaaagaaacacttgcctgtggcaaattaaagaaaattagcaacgaatcaaggaacccacgtgaagtgaaagtgaaatgca

SEQ ID NO: 674 - DNA, 1501 bp, Oryza sativa
gggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattga

SEQ ID NO: 675 - DNA, 1501 bp, Oryza sativa; identical to SEQ ID NO: 634

SEQ ID NO: 676 - DNA, 1501 bp, Oryza sativa
gcttactagcttaaatacaagtattatatcttcaatttggacttgctccggatacatgcaacatgaattcatgatcatgggtctattttatatgctcaaagactggactatttattattccccgtaagggttatcaattgaatacttgcgccagtcgggattcaattgttacatctattttagagtatcccataagggataaccactcagatcagaagctattcatatgagctacgcttggtctatattacccggaagatttattactcgggagcatgttatatgcgtcatcctttaaagggcgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcatttgattggatacaatatcattgcttttcgccacgtaagtgtgcatttttattgaccaatattatggcttaggctgattatatgttgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcctatataaggtgggcaggaagccctctagggggca

SEQ ID NO: 677 - DNA, 1501 bp, Oryza sativa
cctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgtctactcacagctttaaacctagggttatgagattgctgaatgtaatgttcaaaagcaggggactccccaaagttcaggggtaaatcttgtctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaacggaggttctcgatctcttcgagccggtgtgtgtcgaaacacttccgctcgcggttccggaaaatccttccgaagctatcgccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttga

SEQ ID NO: 678 - DNA, 1501 bp, Oryza sativa
gtacaacagaatgagtatatcacatgaattagttggagtgagtatgtcacatgaattaattgcattgatagcaccgcacaattagattcttaaccaattcattcatatgggcacgttgatccacccattccacagcaagccctggtccctctctgcatcccatcaaccaattctgggtgttccatccagttggaatttgttcacggtgatcactgagaaggtgaaattaaacaggggacatattctaatactatgaatctggacatatatctatccagattaattgtatagaacgtgtcacatctaatcctagattcgtttttttcgggacgaagggagtacaaaacaagccattagtgttggttccccaaccgacacacatgtgttctccccgagaaaaaggacgggttgataaattgacaaggttcatcgagctgatgctttgagttatcctcaatatttatatccatggcaccgaatccccacccacatttacacaccagggaataaaaacacaataatttccatatccacaaatcaaagataagaacaaccacatcacagataagaacatactatttacattcactaggtgaaaccccgcgcattgccgctggaatttagtataataacaataaaaaataacgtgtaagatagctagataatatcagattaagtaaattaatgtggtttatgataatttaaatttaaatagtatgtagaatgatgattcaaacgtaaaaagtaaggtggtatgactttatagaagaagaaaagtaggcagatagtttggaccgtagattaatcatctaaatgctaaaaacaattgatgtgatatgacttaattagaggaaaaaaagagaaagataatttggaccatagattaatcatttaagcactaactaagtgaggatgaactatataagtatataggatatcataaaacataataggatatacattgaaatattatgtgaattatgttggatgataatttaacatgttgtatttgaaaagctcttaaattataaaaactataaagatatatcatgtttgcatgatgtttaaatgtgatgattgttagtggataatgatgtggcatcttgttaattagtggatgatgatgtggcatctttgcatgttaagcttaaggagttagtgggggataactttatagtaagataggattcaattattcaacaaacaccatcgataacaccaaaaccacatcatgcatcaaaaaaacctttgctatattacacattcaacagaaaaaaaatataacaaaaccggactcacattacactatgggattacttttctctgcttaagggtgataaacagtaattagcatggtgttagaaacttttatcggcgtcattagaacctggtaaatatatagtagctccgcccctgatatcgagataccatttataatacctacttcctctcgtcccaaaatactccctccatttcacaatataagtcattctagcatatc

SEQ ID NO: 679 - DNA, 1501 bp, Oryza sativa
acttttttccttttgtcttactaaatgttatgtgacatgatgggagcctaatatcctatatatatgttcaggtaatggactaattaggtctaagcattgaaggcatgaatcatgcataatgcattttgggaaatattgcattgaccgattaatccctatgatgtgacatcagagatgagttgatctcattgaaatcaacttaaagatgatatcattggattggtgctagtacattattagtactagctatatgccttatatatatgatatatctactctaatgagctaatgctaacaagccaaaaagattatcagctaagggtaagcactttcagagtagtgctagctgcaagatcaaaagtgatctgataattagcccactagcaacaatatgcaatatattactaaaatgaatctttctatcaactgccttaaaagttcatgcttccaccaccatatttcttcctcatttttcccatcttcccaaaaggaggatacacattggttcaagttgctttcatatgctcggtagcctgctactttgtgagatcaggcaaaccaaaaaaaagctaatatatatagtaattaattcagattgttgactgtgatgtgaaaggtatattgtcttatcgaaatatataacatagttgagaatcaattaggtgtacatatatatatataagaaagtaaaataaaagctaggaaaagaggacgatgaatcatgcagcatatcaaaatcaaataacacatcgcactagctaactgccttgcgtatacgtaggtgcctacaagcatgtaatttcaaaagttctgaaaaaagaataacatttaaaacgggtagcaaaaaatgaactggtagcataacattgggtttcctagcttctctagctggatactcaccagcagcttctcaatctccagcttccctaaatagagccaactcatatagaaggacaattagattaatcacaggaaaactatggtaaatcaattatttattaccattttccagctgatgaattgaacaatcaaatttatgaagatatatatagaaagatgatccactccatgcatcagtccaaccaaccaagagatgttgggattaaagttcttttttttttcttttcaaaagagatgttgaaactaaagttgagactttgatcatcaatttgtagtagagggacaagaatgaaacagctctactgttgggactgttcattatgaaagcagtgttgagatttggatgtgatttagggtgggtcatctctaagctatagcctccttgatccccatctgcagtggggctaactctgaaactaattctggtaccaataaattcagcttttctctccttctgaagagcatacatgtgattggtcattttcatctattgatgctcacatttttcattaactttcagcagaaaatcttagaagatgatattatttgcctttttgcagcttgtggtcggttgggaatctgacctattcgatgtgaagag

SEQ ID NO: 680 - DNA, 1501 bp, Oryza sativa
gtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatatggaatttatttttgaagtggttttggaaatgattggaatttacaggtgaatctacaggatactgctgttatttcatgtgaccggtcagaccgggctgtgtatgccggtcaaaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaaggttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagt

SEQ ID NO: 681 - DNA, 1501 bp, Oryza sativa
cctgtgcagaaggttaaaacggtaaaaaaaaaatcccttgcactcttgtgacctaccattgctaatctctttagatacttgtattttggtcagtaattatcattattgttatctgcactgagaaaatactgaagtgtaagccattttcagctttttcagttgcttataggcttcagtttctgaaccaagaatgcagcaaacaaaacaaaccaacatatacatatgagagtactctgtgacacaaatatataaattagtagcctaaagtttgcattagatcattgcagtgaagaatgaatccttcatctcctccccttgtacaaaccataaaattttacatatctcatcatcaattactgtctctgactctcagtctgttgcattgcatcgcattgcagccaacctcttctcctttcttcagcaaaaaaaaagtagccgcgaagaaagaaagcgagaaggaacgaacgaacgcaagaaaggagagagaggaaaacacacacgcacacacaaatggcgaaatggtgttgatcatcatcatctgcacaagatctcggtgtcggaggagcaggagcacatggcggcggcgtcgtccttggccttggcgttgccgttgccggcggcgacgaggcggagggtggcctcgaaggcggcgacgtcgcaggggatccggagggcgccctggtggcggaagccgaactcctcctcggcgtcgcggagcagccgctcgaacgcccagtggccgaggtactccgtcgggatcacgaaccgccgcatctcctcgccgacgtacaccgcgaacgaccccttgggcacgccgctcctcccccccggcgccatggtcgccagcttcttccacctcttgagcagctgctgcagcctcacgatgtccctgatcttgttgctcgccctgcctacaccgccaccctgatgatcctccattgctgctgattggagtgaggtgttcttgagcagctgcaggttggttggttgaatggtgggaaggagaatggaatggaggagatgagatggtggtggtgagggtgagaatttataggaaggagggggtttgctgcctctggctgtgagccgccgtctcgtgagctctcgactcctttttcggttagtttaactgtacaaatcgatgcttttttttaatggtagagattaatgattcttaaacccggtttgggagcttaaaattctgagaagcaactaatacattttttggattctacaactgctaaaatctatattgtttggaggagctattatagtagaagatgcaattgtcagaaactccacccttagttttttttgggaaaattggaaccatgccattataattttacaaaatttaagatatgtcatcatgacccacaagtcattgatttatgtgggtcttacatgtcattgagatacctgtttggcagggctctctacctgttacagtacggcagatctccacaaagatgaatctcctctgcagtacatacttgtgtca

SEQ ID NO: 682 - DNA, 1501 bp, Oryza sativa
tcttcacactaggaaaaagttcaggagttgtctggttcattgaacagaaaaaatctatcatcgttgtatagcaataataggagttcttgagcaattgccttcacccatacaccacagaaaccaaggcaaaaatattcattttctttatccaccaccaactctgcatttctttctgaactgtaaacaaaagcccatgaattttccacatcacaaccagcaaatgagtgatcttgtacttgagagaatcaattgccatacccacaatcttgactgactgaccatgataggacaacacccatagaacattcagcttaaattctactcaatctgtcacaaaatataagagattttgaatgaaagggatgcaatctagtcctataaatctagatagagaatatatccatattcttagtgctagaatatgtcgcatccatccaaaatttcttatatagttatattttaagatggaggaagtattagtaagtactaggtaccaagataattgagtatttgaatgcagtaaatctgtcaatatgttcagatggggtagcatttctctttcagttttcaccaatcaccttgacccacatcatgtatgcttcagttatagtgatcccgtagtatcaatgtacttcctccgttattaaatataagcatttttcggttgattactaaatgttaatattaagggaaaagatttattttcaatcacctggttggtcaaattttaaactgcttgaattcctctcctaatcatctgattggctgaaaatactttggttcccacacattgaaatcttataatttgcgaacgaagggagtagtaaaattataagagtaaaagaaaaaaaaacaccttttcatttgtgcagttggaaacagatcctctgcagtaatgccctatgacttcaagtgattgacatatggaccccacacgggttgggcccatatatcagtgacacaagtatgtactgcagaggagattcatctttgtggagatctgccgtactgtaacaggtagagagccctgccaaacaggtatctcaatgacatgtaagacccacataaatcaatgacttgtgggtcatgatgacatatcttaaattttgtaaaattataatggcatggttccaattttcccaaaaaaaactaagggtggagtttctgacaattgcatcttctactataatagctcctccaaacaatatagattttagcagttgtagaatccaaaaaatgtattagttgcttctcagaattttaagctcccaaaccgggtttaagaatcattaatctctaccattaaaaaaaagcatcgatttgtacagttaaactaaccgaaaaaggagtcgagagctcacgagacggcggctcacagccagaggcagcaaaccccctccttcctataaattctcaccctcaccaccaccatctcatctcctccattccattctccttcccaccattcaaccaaccaacctgcagctgctcaagaacacct

SEQ ID NO: 683 - DNA, 1501 bp, Oryza sativa
taatatgaaataaagggagcataaatcatgcttaaattactttgaatgataaaacaactcacaacaaaaaaaatataattacgtaaattttcttaaataaaacgaatagtcaaacatgtgacaaaataacaacgacatcatctattaaaaaaaatacttcagtacctttatataattatacaaaagttttaaattagtaaatgatcaaatgatttacaaaaaatctaacatcaacgtttattttaaaaggagtagtactctatagtagagcaagttcgatagtatagctaactgctaagtctaaattatctatagttaatttaatagttaatatatatagtagttacctacaaatatatacttatagtgtactgatacatggtctgatacttggggctcatagctagcgcgtgcgcgcggctagcaagcacctccccttaagactttaactacatctattaatttattagttaatatttaacactaatgatactagtagtaattagaaaagattctgaagatttttaagagatttttttactaacagattgaaaatttaattttttaagttagatttgaaaacttttgatttaagtttcaaattttaaagtcaaattttgaaaactttcaaaatccagatttgaaaaatttgaaaacttttaacttgagatttaaaaattttcaactcgagatttaaaaactttcaacttaagattcgaaaactttcaagtctagatttgaaaattttgaaaactttcaacttgagatttgaaaattttcaactcgagatttgaaaactttcaactcgatattcgaaaactttcaagtccagatttgaaaattttgaaaactttcaactaagattcgaaaattttcactcgagaattgaaattttcaaggctagatttgaaaattttcaagtcaatatttaaaaactttcaactcaaaacatttgaaaaaagcacatttgctattggctaggaaatagtggggatggtggatgcatcgagtttgttgctagagtaaatatagtatgagagagttattagcttttcttggtcttagtgtacctatgaaatatatagatcaatttggaatggagggagtacttaggtgcagaaggaaatgatataacttttccccccagattttctgttacttcatgttttaggtataccaatatttttgtgtacttggttgatctgtgcactagcatataacaattatccggccatcaaaatggatgaattttccatttcatcatgtgaaagacataataactggaaccttatcaaagacatatacttattagttattgcatgaggtagttaacagaattgattgctttcattccccagctttcactggtgatgaacttcaacttcttgtatataatctttttgatgctgcagttcatgtgatgtactgatttccttctggtcattgaattactatcatattgtattgttttctttaacggggaacagaaagggataccctt

SEQ ID NO: 684 - DNA, 1501 bp, Oryza sativa
aatctacattgttctgaaatatgattttgattcttctgaaattctagaagaagtgcattcgtgggtatcataatttaaacattaccgcaatgcttactgcaataaatactaaattggtttatgattttacccaaacaaggaaccatatctagtagtggggaggttgaagaaaaaaaagcggaagaagacaaaaacatcgaccataagccataaatgtatatgatttgtatataaatgtctttctatttttcaaaatgaagctccacgtaaaattgcgcgaaaacatctgttagacaaacataaaacccattttttcatactcacgtgttatccctattttaaaaagttttaaaaaaggttttaagggaagggtaatatatgtcaatttgtgattatactgtttttctgaacggttagactgttgccgatgttttatacaaagaaaaaaagtgtcccactaattagaaaacgtaaccaaaccctagtgtctaattaattagaaaaactgagcgaaaaccacaactacaacaccgtcaacgcggtattatctccctggattatagtgttaaaaccttgaactcatttttggtcaatgtaggtggacagagatccgcgatgctgtatctgcggttttatctccctggattctgcccaaaaagaaaaattaaaggtaaaagattattattagtgctaataagttggagacgtgtgcgtcgtgctagctagagattagacacgtggacggtgatgaggcgatcgagcagttgcaaaaacacgcgtgtacaccaactagtagtagtagttaaccataatccatatcctcctcccttattaatcccctcccccaaaatcatcaatgcaaattaatctcccctcttcttcttcttctacctccttttgggattaatcactggtaattatagatttataggtgattaatcactcggcattgccattagcggtggcggtgatgcttgtcttcgtcatcgtccacatctcgttgatgcgtgctgccgactgccgagtgtcaccgaatccttaataaatactcctcctcgccaccttcgtctcctcctatccccgattcgcacagccaatctcttcttgcttcctcctcctcctcctccagccgccgccgccgacgacgattcttggtagagagattcttgcgttgttttacctgcgtcttgttcttcttgggagttgggtggatcgattgatcgaggttttggaggttggaagaagtgtgtgttgtggtggggggtaagtgagatggagaactgaattcactgaactcattttctttccttttttttttggtctgacaagaagtaaaaattcctgaacctgaaaccaaccaaaggacaggttggtcgacacgccaagattgcttttgctgctgtgtccttctcactcttgttcttgttcttgcttcttcaggtttgtagagagagagagggcaaaggcacgcaaagagggagagagtgaggagagatggcgg

SEQ ID NO: 685 - DNA, 1048 bp, Oryza sativa
ttaaaatggacagattggaaaccctttctcttcggcatgtaaaatggagtggcagattggcacataattagttaattattagcaacagttttaaaaatggattattttaaaagcattttttctatataacttttttgaaaaaacataccatttagtagttctgaaaattcacatgcggaaaatgagggatagaagttgtgaaagggaagaaaagaacacacccttaagatgcattgtttcctttacaccaaaacaaatactcaaagaaaagtcatagctaaaattatttgttgaaaaatttatatgtttggtttatcatgtgggcaactattttggtatatatagaatagttttgcaattaatataggtaaattttgagttgtaatccaactggtaagggcatatttttgtttgtgcttctgccacattttcaattccactattccatagctgtgtaaatacaaattcttgaataaaaaagttgtagctgtacagctttcttcgtgtttgctgcttttatgttccactctttgggtttcggatattttacaacaatttgtgtatgatacgggagcaaatccgagttaaaatccaacatttcaacaaggagagatctgattcgcttatagaaagctgtgttgcaatctagatagtactacaatttaatggtattatatgagagtaagcatgttctataataatttacaatttttgcacttttttaaatgaacagttttagaactttttgtgtagacaaggtgggtctaagatttggagacaagtttattggtattatatgagagtgagtataattccagcttgcaacttgtagccttctctttttcttgaataaacagttttagaactttgtgtagacaggatgggtctagatttggagataatataaagtccaaagctttatagaaaagaaaaggttcagttttgttcttgtcatctgacgtcaagtgacaaggacatttcaaggcatcttggttgcttcaatactaagtgttcagtacaagcatcctacgtaacttcagttatttta

SEQ ID NO: 686 - DNA, 1501 bp, Oryza sativa
cgcgattctagcagaaaactgcaatctatccatccgacatctaacgcaggacgtcgcaggttgcaagccaaaaaatcacctcgtggggcgcgagcagcgggagattccgccgcagcggcggcgcccagtcgtcgcccccgccgccggagatccccagcgccgccaccgccgcggcgccgtcgccgtcggaagccatcgcgcgggcgtggcgtggcgtgtggagtcagaagtgggggagcaacaaaaccgtctcccaaatcgctcacaaagtcgcggtttttatatttttttttgcggaggaatcggtggataaactgaatcccaaatcaattaggagtagtaactgcaactcatcccgatcgatccgtgaagatgatggtggtggtgggcgcggcgcggggcccacatccaccacctcggcgacgagacgagcatccgaacaacgggtgacgcggtggcaatggcattccccggctttcacgtgagcgctcgcggcggcgggtgggcccgcccccacggcgccgggtgtcggtggtggccgccgccgataagccccgtaagacttcaaacttccaaaaattattccgtccgatcaaatgtttgggcatatacacgaagcactaaatgtgaatgaaaaaaatcaattataaattatacagattgcatataaaattacaagatgaatcttttaaatctaatttcaccatgatttaacaatgtgatgctacggtaaatatttactaatgacgaattaattagacttaataaattcgtctcgccatttacatacggaatctgtaatttgttttgttattggtctacgtttttaatatttcaaatatgtgttggtatactttaaaaaaaattggcctcacgaactaaacacggccgtactagattttatctagcatgttttactgtattttggtgagctagtagattttagagcaccttttttaaactgttactccctccgggttgataatacttgtcgttttggacaagggcacggtctccaaaaaacaactttgaccattattttctattataatatatataaagtgttaacaaatatataaattttattaaagtacttttcaagactaatctatatatgtagttaccatatttgaaagataaatattttaaaaatgattcataatcaaagattctaaagtttgacctcacccttgtctaaaacgacaagtattatcagcccagagggagtaaacaatgttatatcttttggaaaaacaatatgtaaaagttcttttaagatataaataaatacattttttttaggattattgtaattaaaacttaactgatcattatctttcacgttttgcaagcgctgagttcatcctcatctagattcagacatctgtcgcagactcacgggttctaatctggaatctcaaatcatttacaacagcatattcgaattttccaacatggcatcacttggcacctcacagttgcaaatgtaaacaggaaaaat

SEQ ID NO: 687 - DNA, 1501 bp, Oryza sativa
gcggcggccgaagtggcaaaaacggcggcggcgggtggtctgcaaggcgcggagacgattggcagctcgggaggggtcggcgaaatggggaaaaagcggagagggtccctgcgccgcttaaatagggggagagagggccggacgtggccggaagaggcgggattcgccggccgacgtgggggagtggggaggagagagaggcgggattcggttttcgaatcccggccatctcgggcgcgggcgcgagcgggagagagaggggaatgggcgcggagggcgcggcgcacgcgcggacgtggccgacgtggcccggggaaggcggagacgagggcgcggcggcggtttcgggcgcggcggcgcgccgggatcggcgggaggagggagacgggaccgacaggtgggccccacctgtcggcgaccccgagagaggaggcggcgggcggcctgggctgccggactggtcgggctgggcctcggcctgtggccggcccagtagagaggagggggaggaaaagggaaatgggccgacggcccatttgacaaaaaggaggaaaaagaaaggaaaaaagaaaaagaaaaggaaaaaggatttttccctggaattaaaatattgcttgctcaattttaattggttgaaaattatttctagagctctgaaaattccactaaaaatcctgttaatgaatttcgacatgtagaactcaagaaaaattccacatgtccaatccgattattatttgcattactttcttagggttttctcctgatttcacctgcattttcttggggtcatttgtaaattcaatttttggcttgggaggaaaacttcggggtgtgacatcacccaagagctaaaagtccacaattactccctccaattgctcctctctctctcaccttcttgttggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcccgtacgtcagtgactgtcaataatattcttgagaatattatttctataaaattccataaaccatttctcctattccagaaactccaattaaacttccaaaattcatatcttctcaaccgctcttccgtttgactccgttcaacttccagtaattccgtaaaattgagatctatttaatggcactactaattagtctaaataggatctttcgtttggtcctttgtttaggttttcgattgtttgcgcatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattatagaatcacacacttaacttgcttggcctcggtttgca

SEQ ID NO: 688 - DNA, 935 bp, Oryza sativa
cccgacacatcgtgaaaactgctagatttaaatattatagatttatgtatacataatcaacgttttcaattgttcattcaaagatgctcacccaaacacatatgtaagcatgcttggtagtaacttgagcaacttaattaattaggcactctctcagtatctttatttctttaatggattaagaagagcgataaaattgagaaagaaagttatgattggctgagataatgtagtaggtggtgaaattaaatagaaaatggttgtgtggtttggttaagatgatgggtatgtgaagacgtaaatatattttgagataaattttgaatgctaaaggtaactatatctttttgacgatgggaggagcaattaacatttttttctatcttctagattagtgatgaacgatcacatttagaaatatattacagatgaaggatgaagaatcacattagggaaggatcagtgcgggtggttatgaaatttatctccagagagcgcgaaacgttcagaaaaatattactcctacacaatgaatgtgcaattggtcagtggtaaactgcaatgtgacaattaggtgaatcaaatacttaacaatgcaccaataatttcagatattcgtttggtttttgacttttgaggaaacagaaggataacacggtagcacaaagaaccaatacgaagagtttgggctctctgactattcgcatatacgaattgtttaattcttcaataatatacacggttcacagtaatttatacagagatagcaaacagagataattaatgtggacagttgaaggtcttaattatatagtttgtgctggtttgcttactttggtagcagcataacatagatcaaccggactaggcatcctgggtaaggttaaaaagttaaaaaaggaaatagttaaaaggcctgcagtggtcatttacaa

SEQ ID NO: 689 - DNA, 1501 bp, Oryza sativa
ttttgaattgataataatgatttggacttaaataattcaaggtaaagagggtgtcgttaaaatagtttctctgtttaaccatagtttaactaagccaaacataattcatcagctaagccaacctaacaatttcagccaataaaaatcttgaatcaagcaccagcagtccaccaacgggtgtagcaccacctgcatcaattcaatcattttatctgccagaaaatgctggtcacatttgcaacttcctagcagaattgtggttcatgatgccaaaaatgaacccaccctagctacattgctctacatttttttttgaagaaagagagacaagatcgtccccctttccattttcgaaactaagttacttagctacattgctgtacatgaagctaaagatgaactccaaagtttcacaaagatgcaacaaatgcttttgcatcaccacaacaagaagctcatcgtccaggaaatcaagtagcagcagatagcaatgtgaagcaatcacctcaagaatctcccttgcccggtccatgcatcgccggagcggctccacgatcctcacgccggcgagctcctggcccttcgcccactgcccccgcacctcctccaccacctcgtcggtgatcccggccttcttggcccgcgcccaccgctccttcccccgcgccgcccgccgcagccgctccagctcgccggcctccagctccgtctccgcgcgcgtcggcacccgcgtcttcttctcccgccgcagcaccaccttggtctcctcgtccctcgccgcggcccacggcaccgccctgcgaatccccttcttctcctcctcctcctcccgctccggcggcggcggatgtatcgggaggtggaaggggacgcgcgcggtcgcggtgctactgctactactaccaccaccaccattggggctgggtgtgcgcgggtcggagagctcgagggagcggaccttgcggatgattccgaggaccgcgcggcgggtgcggccgccggggacgccggcggtgaggggcttggcggagccggggtttcttggcgccggtctgggcccacggtgctgcttcggagccggaggggcctcggtggcggggtccggcggggagacggacgtcgaggggacatgcgggccgtggagccacggcggcggggtcggcgacggcggccgcggggacggggagaagaggtgcaggggaggtggcgccatggcgaggcgaggagttggggagaggagacggagaatgagaggcggatgtccgtttggagtgtgggatatttttttttctgggcccatctgtccgtgttcagcccgtatattgcaatggaataagttcatttcaggtacctcaagttgtcgccgagtctgaacttcgcaatactagataaaacatgtctcctcagcttccaaaaccaatacaaataaggtctcaacatagtttgaacgacggttttggctgacatagcacttacgtggcgctgacagggcacttcaagt

SEQ ID NO: 690 - DNA, 1501 bp, Oryza sativa
agcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatca

SEQ ID NO: 691 - DNA, 1501 bp, Oryza sativa
taaaattatgtcgacacatgctatagtcgatttttttagctacttacacagtaattacacctcacttacacccgcttacacctaacttatatatataattagtatgtaatttttgaatttacatatgtaattttaggatttacatatgtaattttgatatttacattataaatacactaaaattatatacgtaatttagagacttacaatataaataaacgccgactattttttggtgaaaaatacggcgccataaatatagctacaccttaaaaaaaagcttatattctaataaaacagatattagaaataattatcatgaaaggcataatctcctcgaagaaaacccaattccaatcatcaacccatcgaatcgattccacgctttgcatgtgtagaccacacctttcatcctccaccgttgagccatcatttccgcctcacccctcccaaacaaaagcccccaacccgatccaccctccccctccattgatcacccccgtccagtgccagtccactccatcgcagccgtccatcatcgtatcccgcacgaatctccacgcgctcaccgcacacgggaatcccacccgcacggaatccaagtcccatctaaatcacgcacactgaaacagatagagaaagagagagagagagagggggggcgaggcggcggcagccatggcgacgctgccgcagcggttcaagctgctggcgacgcggtgcgcggcgggggcggcggcgccgagcccgtcgcgcagccccgcgccgtcgtacgccggggccagccccgggtaccgcctccgccgccgccgcaggcgccgcggcggcgtcgacggccggctgcggcgcttcctgtcccgccgcgtcggcgtgggcggctgcggcgggggtggtggtggtggggggaaggaggcggccgccgcgcgggagcaggaggagtacaggaagccgctcgtgggccgcggcggccgcacgctgcgggatctgttcgtcgcgtcgccggaggcggcgcgacgccgcggcggcgatgacgacgaaggtgggggcattggcggcttcaggtcgggtcatggcggcggaggcggaggcggcggtggaggcaggaggttcggttccggcgggctgcggagcctgctgatgcggcggagctggcggccggtgctggtggcgatcccggaaggcgagggccggccggagctcgccgtcatcgaggaataaataacgaacagcaggagcagcaacgacggaagagaagagatcaagaaaccctgaagaggacatggattcctccactgtccccatcttgttcatcttcttgctctgtttcttgcgtcttcttcttcctctctttggtttcttcttttcattagttttgatccacttcttgttgtaggagatttgccgctgtgaatatggaataccaaatcaccaccatcacccaatcaatcaatctgaccccaaattgcaaattcgctctagttttactctgcatgcatcatca

SEQ ID NO: 692 - DNA, 1501 bp, Oryza sativa
ggtctaacattgttttggaccgaagagagtacaacaaacctattccatctgttctaactataagcatctctacaatttacttaccacagttcaagtatttcaaaacaattgaatatacagaaattcattcattttcagttaatcaggcgtttgaaaggggaatgttagtaatttaaaattcaaaattaggctaccaaggtgacaaagagaatggagtaaattgcacccacggtacaagaacttggtgtagatgcgtgcgatttagtgtaagaacttgaaaaatgagtagaattgtatataaacttgacaaccacgtgcattttagtcaaaaatattgatacacaccttggattaatcctggtattataagcttaactgctagtagatcattggatcaatttcgtgttttgccatgttcataacccaagataatgaatatgttgattaatcaaatcgctcggaaattatgctatttgcatgcacttaattttgataatcatatatctttcggtttcaaatcgatagattattttattattataactaacaaattgaaagcaatacataatacatgtagatccttgtcgagatggcattattagctgctttttttatattgtataaaaagtatggtgtggaatattgatcttttaaccaaaatgcatgcactagccaagttgttgtacctatatactcatttttcaagtttttgaactagatcgcacccacctaccaaatttatttactgtagacgcaattgactaaatagggtaaattggcttaaaccttaatatttgctaaacaacctaaaaacggattagctaaaattatgtcgacacatgctatagtcgatttttttagctacttacacagtaattacacctcacttacacccgcttacacctaacttatatatataattagtatgtaatttttgaatttacatatgtaattttaggatttacatatgtaattttgatatttacattataaatacactaaaattatatacgtaatttagagacttacaatataaataaacgccgactattttttggtgaaaaatacggcgccataaatatagctacaccttaaaaaaaagcttatattctaataaaacagatattagaaataattatcatgaaaggcataatctcctcgaagaaaacccaattccaatcatcaacccatcgaatcgattccacgctttgcatgtgtagaccacacctttcatcctccaccgttgagccatcatttccgcctcacccctcccaaacaaaagcccccaacccgatccaccctccccctccattgatcacccccgtccagtgccagtccactccatcgcagccgtccatcatcgtatcccgcacgaatctccacgcgctcaccgcacacgggaatcccacccgcacggaatccaagtcccatctaaatcacgcacactgaaacagatagagaaagagagagagagagagggggggcgaggcggcggcagcca

SEQ ID NO: 693 - DNA, 1501 bp, Oryza sativa
gatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttcacaactctgttctgcgctaattggttgaccgtgagaccttttggccagcgtagaacgactactacctgtttgcatgtggtcttacggtcaacgtgcatggcaggatgtaagtaaggtccctgactcctgctgttaacagagtaacaggaacagggcttttccggaaaagcccgcattcatcagattgaggcgaacgtgaacaaacgtttttaattgaattcagattaaccaacttgttaatgcttgttcaattcaaacgtaatgctaaaaaggggcctaacacaacatttaggagtgttgataagagtgtcaccctattagtactgatttattccctctgtttcgattaaaaataatcgacgtattgtagaaaaccaaaaattatcatcgtcgtacttcaaaggcagcacccgacacatctcgcatatgcgcttcgttttcttatcctcgccgcttcgtatgccaaaaacctcgaattttgttgagaattaatattatttttatggaaaatcgcaaaagtagtggccaaccggggaaaatcgcgaaagtaggtccctgtcgaacgggtgcaattcgatagggcacctatcgaacgacgggcagtcgacaaaggcatgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcattcgacaagccggtttaaagccccgtccacccaggccgcgagttcgatttgttttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaatagatacaaaggtgttatattttatttggattattaaactagttgtttgttactaatagttgtaaattagtacacggcaatatagtataagttataatagggtaattatcgaatgattaaatgattaaacgtgagactatttgtcatgttttatcagga

SEQ ID NO: 694 - DNA, 1501 bp, Oryza sativa
tttagaaaatttgctgataaatatataacaaaaccgttttttattttcacatgcatttcctattcatataattacaaaacaagatagaaacataaacgggataaaagcttttgtaggcaaccaaacacgtccaattataccacccaaaacagcacggatctcatggcgttggaattactccatcgttgatcattgtcactgaagggagaccctagcttagctaggtaagggtaaggtagcggtagcgcctctatcaaaaggagcaaaagaaaacgaccgttcctccacgcatgagcatgaactgtgcgagtctgggtgaacagcagcaatgaggagtgaggaagaggattcatgtgtactggcgtggagagcgaccggtgatgggtgatggggtgagggggcggcgtggctggcacgtgcttggttgggttgggggcatccactctttctttctttgtttttcttttcttttctttctttttaaggaaaaggatagatctcttcacactctcatcacctgtactggaccatcttttgttaaaggcgaattcaagagagaagccaagagaaatggttggctataacaaaagtaccgggggctaagcccctggatctagagtgtattttttttcaaaaaaaaaacaaatactccttttatcccaaaatataaaaaataaccaccactaacacaaaaacaaaaagtaaatttaatcacctcatcaattggatcacctcgaaacatgtaaataattatgtgattggaagtttgatggtagatgatttaaaacaaagcaaatttaaatgagctagttagtactatatacatgactgcgtgccatatattataagacatggagaaaaataatagtgtctttatattttatattttagaatggaaagccagagtacttggacaaccaagaaaaataattggtgtcggacaattaaagttgtgttcggaaccccttctctccatcatgtaaaatgaaatatacattggcgcataattaattaagtattatacattggcgcataattaattaagtattagtttaaaaaacctgaaaatagattactataatttttaaagtaatttttctatatattcttaaaaaaaacacgccctttagtggtttgagaaggatgtgcgtataaaacaagtgagtagaagttagaaagatgggggtaaagaatatggtatagatccttatcaaatccacgacttaagatgactacaactgagcatgtggttttttctttcgaataccagatatataaaggttcagcctattctaaactgatactgtaagtctaacatcggtgtgttaaacagaggagagaaagttcctcgtttttcacgcgcgtgcattttgaactgctaatcagtgttttttgaaaaaaaaaaatatagaatttttttgcaaaaaactatattagtcattttctagtttaaaatagttaatcacacgctaacgatatacctcattttgcgtgcattatc

SEQ ID NO: 695 - DNA, 1501 bp, Oryza sativa
catggcgcaagaggtcgctttttggcgtcttgcccatattcattgtactgtgccctatcgtttagtgttttttttttgtttttttttttacggagggagtacatcctgaccgcaagttggtccactgtcagctacggcacaccagatcccagccgctcgtgtcaaaattgcacccgtgcgtctaggtgtccgcgtgatacggggccccacggtccaggccacgaccgggcaggctcctctcggcccggctggcaacacacgtctcgctgccacccctggcccaccatcccgcagggcggcagcatctcctgaccccacactccagtcacccgccccgccctaaaacccactgcgccggggcccaccccgcccccgcctccccgccgccgcaccacgctgctcctacgcgttcttcgtcgagacggcgacgtgagctctccaagcgcgcgctctcctccgctataaaaccaggcgccgcgtggaagcttctctcctcttgctagccccaccccctcctcctcgtcgtcgtcgtcgtcgtggtctctcctgctccggcgaggcgaccccacggccgccaaggcgcgggttagctgatttggttttgatttgatctgatttgatctggggctgcttgcttcgcggtgcagcccgtcgtcacggtgggtgggggggggggagcgcaatggacgcagagaccggcccggccgcgccgcaggtaacttcccccaacccgtctccggtggtggatcggattctgctcgatttcgagaaggggctgtgaatttttttccccatctgttcattgttgggaggagttgttttttttttttggataaggcgattgggtgggttgtgtgttgtgactccgcgagtggttaggactccgatgtggtcgtcacgccgaggtgataacgcgcgcgtctcgattttgctcgcctttttaccgtcaggaaggtctcgcgtttgattccgagagggttctcgttcgattttgatttcgcgatttcaagcggggtgcggcgagttactgtttgcaatcgaatacgagacggtgcggtcgtgctgatcaatccggtgaacttgtttcgcttaaattcgctgaaactgagaaccagcttggttttagagccatatgtagttgatgaatcaagtcaactgtgcttttggttggtgtttggttggggatggggttggctagtacattagtattacacatttttgctgcgttgacgcattggcatcacattttttttattgagacgtgtacagctaccacttttaatcccgacaattctaaatttgcgtgatctatagttgttggtttttcccctcgacaaaagagtagtctaataaaagtatgagctaccaatatcaaattaataatctgtttaatacatgcccagctaccaatatctgctttctctcttgttttacatactggactgtactgatcggttctcagtaatagttactattcacaatcacagggtcggcgtactga

SEQ ID NO: 696 - DNA, 1501 bp, Oryza sativa
gcgggggctcaacgccgggctggtcggcggcgccatcggcgggatgctggtcggcaccgagatggtgtccgacgcggcgttctaccacgccggctacagggccgggctcgccgaccgcgacggatgggccgtctactaaaccgtcgtcgccatggctgcaggtgcagcgccatgcatggtcggtcggcgaagatgcttagctgaataaaagtctctggttttctttttttggccttttgagattagctcaataaaagtcgatgaaatttactttggctgagagtttgtaactcttcctcttcggctagtgaattaatcgacttgttgtatatattttgttactggttatgatgtaatatatggccacgaaaatccaagaacatgacatgctcattagaatggcttttgagaaattaaaaaaaagttcgaagaaaatctttgaaaaggagtcgggagttcctgcttttttattatggaagaaagaaaagaggtaacccaatttgttaagaaaaatcggaccctaaaactttatcattgtacgattaacttaagaaaaaccggcaagaatctcaatgaagaaaataacaggactactcaaagacggcataccactataacctagcacccttaggactaaagtaccgatataagtcatcgttgtcaagcttaaagtataggagtacaagcaactccgacttcctattacaaacaaaagccaacgatcacctaatgtagggagcgtgcctaaactctaggaccatgaaagaaaaaccgcaacgacgcatctaagaaggaaaatttatggtgccggtgacatcgcctctaaggaagaaaggagggaaatataaggtgccaatagacgtcgatgtcaaaggctttcatccaatattctccctgccaactacaccattcacaagtgcctcctctatatcaggaggagttaaatgttatcattaccaagctcatcaacccacccccatccatggtcatgacctagtctcgttggatttgtgcaccgctcccgactggctttctacaacattatcgctgccaccaacccgagcaccaagagtcacttagagccagggaggggagagtcgaggcctttgccgtcgccttccttgcaaccacagtggtttccggcactctgctccggcggtggtgagaccccgggcggcaaaatttaaatttgaaacagtaaattcgataaattcgatcaaaatcggttcaaatttcctggctcccaaccccgatatctcactcccccgccgtcgttgtgaaccctgctctgctgttcatcagttgtagacaaattcggactctgttccaaaatcccagtcgatcagttaatccgagacagttcagtatagtgccagcaaaatcagctaaactccgtataatagcaatcggaaacagcaaagcaagcaagcaagcccgaaatcgacatgcttaccaacacgagttcgagtccacttccatgcacgaagctatatatacatac

SEQ ID NO: 697 - DNA, 1501 bp, Oryza sativa
acacggtttctagcagtgagaggagttctgatgcacccgggaaggaaagactcacacatgcattaagttataattatgtttaaattctcacatggcagtcctaccgacggcgacaccactgtagacacccgcctcgcggttctaccaatggctgccccaccgtagagcccctgcctcacacatcaagaaaccactatgcatggatactgcctccgctcagctatctattccactaggtctatacccatacgaaaagtgcggttgtacgggggtcgtttcatgcttaacttcatggctcggtccttaattgaccggggacggtactagccttttccggataccacccaaatcctccgtccgccccagtcgaaaacagttgtttaattttatttctcctttcacaaatcatgtcatcaacatcatggcaatgtggcgctcatgtctccacatgccgcagctcaattaccttcccaaaggtaattgcctaagcatttagcatttgataaatatgagtatgcatgattctagagtagcatttctaagcatttgtcatacttgactagggactcctacgtaatcatggttacaagggaataagggtaaacaataatcaaggtatggtatattcacaaataggatgttcatcattgcatgcaatcttatttgtaaataaaaataatttcgcaattgggatcaacatgttcaaagaatagtgatgacttgccttgctcaaagtcttgcgggtcttgaccttcgcttggatccgcaactctctcgggctctatagttacgtgcgaaaattgatttgaattcggttagaattcaaataaaaatccaaataaatccaaatggaagtcgaatgcgagagtcgattcttttatattaactttactatccacgaactagggcaaactgtcacgccctgaagttcccctttccagctttaaaatttgttaaataaatcacctaaagaaattgttgaattaacctagagctaatcctcaactaataaatgcatttaataatcaaattcggcgtggtggaatttttcttgagttccccatgctccaatacattaacaagacttttagtggaattttcagagtcttggaaataattttaaccaattaaaataagcaaagtacaatattaaatcccaaggaaaatcttttcctccttttcgttttcttttccctccttttcctcttcttgggccgccggcccattctctttttccctccccctcttcccgctgggccggccgcgggccgaggcccagtcaggccggccgcctcctctctctccccgggacgccgacaggtgggccccacctgtcggggttgtccccttcctccggccgccgcccccacgtcgccaccagcgccgaaaccgccgccgcgcccacgtcccgccccctccgggccacgtcggccgccccggtcgtgtgccgcgtctcccgcacccacttccccctctctcccgctcgcgcctgcgcccgaga

SEQ ID NO: 698 - DNA, 1501 bp, Oryza sativa
ttcgacacatactaaatgttgtgatcttttgatgagtaatttactttttttatagctgtaggaattggtggaagcacagttggtttgtttctgctcatcatcattttaggtgctcaacaataggcaaccaacttgcggtgttaccatgaagcttcagttgatgttgagtgttgtcctgcaggttgtaaccaaattatgactagcttgtaccttgtagtttcatcatattcctttaaacatactgatagtatctgctcacaaaaatattgtgcttgcaatgaattaagtgttaaaatcacatacctataatctatgtaaaagatgcacaacaccaatagtttaacgatagattgacatttacaatcctgtccatttcaactttatttgctgcataaatatgttgttggataaattatttggttcactttcatgattatgagaaaaatactaagagaacaatttagattgtttacatgtttgttgtgtttttagtatggataaatcattacttcggttttggcaatcctttttgtgtttccctgtcattgagatgtttgattgatttcctcacattggtctaagattggtacagtacctgctggtgctccttcggttaattcattcacagattacaccactactgcattcatccttacaatttaaacatacgccacaaaaataactccattaacttattttattcacattcagaaaaagaaaattaggaggggacgactaatattgttgagtagttcaacgccacaacattattggctctcaatattgacactaaaattgtatttttgcagcacttctcgagcaactatgcataagtggaagcaattcatcgtaccaaaaaatgtgccttctatttacacatcaacaagaaggcccttgcagtaaaccagcaatgcaatcctctgaattcatggggaaaaaggtcaattactgcaaaggcatccaaaccacattagaatttagccatctgtaatatagtcgtatgtgctcatctagcagaactgttgcaatgctactgctataaagctactatgtactgtatatcctgtcatcgtacacatggcaagttttgttatgtatttactgtcctcaatctgtatacatcatttagttatacttatacatgtccttcattgaacttacaaagaacattgtttcaactgcctacctcaacttatgtaatcactgattctcctaaatggcaccactggtgcagcgtgcgaagcacgcgttcgcctcaagttatattaaaaactttcatgtgttcagattaaattaaaggtttcaccgattcagaactagtgcaggtttcttttcgtgtaagatatatatacaaaatggattacgaattactcactcatgttgttaattaattaattaattaccttgcttgactcggtgggatgaagtcgaacatgtcacctgccacgtactcaacaacaccgtcggccgggacgtcgccgaccacacgggcgaggtccag

SEQ ID NO: 699 - DNA, 886 bp, Oryza sativa
atggataaaacagagccctctccctcagctagtactagaacacccattccataggtcctagatgtgatgattacctacaaaaccttaatggagaaggaaatccactcttatctgcgtcggccacctcattgcccttattcgagtgttgtttgagcttcttaagcttccctctagtcggcctcatccttccggaggaagctacccatcggatgtctgatgctaaaaaaaaatcggacggtcaaatattgcagttgaccaacaaatgaaacattaagttatatattgtgaaacaaaaaaattagcaagtgaaacatttaattattttatgaaacatgatgaagatacacgttgaaacatgtcgctgccacgtataaacaacaagtattaacggattgaaacatgtgttttcttttatcaaaatataatcatgtgatatcttgttgtaaatatttaattaaaacgaatacaatggtgtgattggatcatatattggataaataatttaagagaaaaattattttgaagcttactaaaatacatgcacgtgtgcatggatgagatggagagagaggagagagagaagtagcgggcagtttcaggaatgtaatgaaacacactgaagacgcacattgaaacatatcactatcacgtatgaaatatttagttttaacggtttgaaacacatatttttctttcgacataatataatcatatgatatcttgatgtaaatatttcattggaacgaatacaacagcgtaatcagtttgtagattggataagtaatttagaagaccaaatatttaaagagatgaggaaagaatgaaaagaaatagctaggcatacatgttacagtgatagggttcatccgatctgccgatttgcagc

SEQ ID NO: 700 - DNA, 1501 bp, Oryza sativa
ccccggtcaattaaggaccgagccatgaagttaagcatgaaacgacccccgtacaaccgcacttctcgtatgggtatagacctagcggagtagatagctgagcggaggcagtatccatgcatagtggtttcttgttatgtgaggcaggggctctatggtggggcagccattggtaggaccgcgaggcgggtgtctacagtggtgtcgctgtcggtaggactgcaatgtgagaatctaaacgtaattataacttaatgcatgtgtgagtcttcccttcccgggtgcaccagaactcctctcactgctagaaaccgtgtacgcctagagtgcatgaggatgtaaagttcatggagcgggtactgccaatgcgaggttatcgaaaagctttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactccgctgccttacctacttctgtttttggaatgtattctagaccgctcggtccgatgatttgagactatgcctgcgggcttatgatgtaataattcgcactagactctcgtgtatgtgcatttggtatttcagctatgaactcgtgtataccagactacttgatccagggaaatggtactgattacacgatagattcctgttataaaaacaggggtccacagagttggtatcagagccatacgactgtaggaaaagaccaaaaggcgccccaccccttttctaagattggccaagggagaaattcccatttagtaatactttcaaaaataaaaactctatgtttacaaaactctgtacgattttcatcttactcttaactactttcttcacaaaacaagttttactctcagctgactttgggtttttcttaaaattagatggcagatcaagattcacccaccacctgggaga

SEQ ID NO: 701 - DNA, 1501 bp, Oryza sativa
aaattttatcttgaaatattccttgatttggttttaatctaaaaccttctttcgcctaaaacttcctttatttaaatttagtttgaaaaaccctttttactattatgaattatggtccaagaaaccatcctatactgtgctagaacctaaaccaaagcaattccaattttattggaattaattgttaacccatcctttgatcttaaacctatcatttgattctcgatccaaatattcgagtttctccttttaatctagccaccattttaatccctgtggcttgattccctcttcggcacaagaaatattattattacaaatattgtgagtaattgctcttgtgctaagagaatagactttatccctccgccccaaattcaaaacctcatttagcccatatctaattctttaaatttcataccacatattttgggctagaattctatttactctattccctccatattccctccactcaaaaatattcaaatctagagccatattatttatggttttgaatattttgaatttctatttgagtatattaaataaactcctcaaaccaactggagaaatatttcttttggaaattatattcaaatataatttccttctaaactctctctcagtcatttttccttcaaattcaaattattcaaatcctttttcaaaatctagccatccaaattcctctaaatctattatttgaatctctaggaaaattagacttcctccttttcaactttgggcagaattcttcttctctctcgcgcggcccaagtcggcccatagcaagcgcgcgtgccgtgcacgcgcacgccgccgccaacgccttccgtcgccgctaaggaaccggccgccgccatttggtgcgccgtcgccgttgtcctgccttcgccgccaagttgcgccgccaccatcgccgtgccgtgccctccttctccgccgtccaactctgccacggccgccacgtacgcgcgccgcaaatgtcgaccaatcggaagacaaagccggcaccgtcatcctcctctccacgccactgccgccgtgctccccttctccttttcctccgaaaccgtcattagccaccgcctttagtcgtctataaatagacggcaagactcgccattcctcttcagaactcaagctctgagatctttttctctctctcctcccatggccgatcgtcgacatcgtcggtcgatctccccatccgtagctcctcctttcctctcctcgcaccaccggcttcgcctccatctggcgagtccgttttttccctttcccctcttccctacccacttcatcaagccaccacagccacttctcttgccgccggagataagctcttctactcgctgttccggccatctccctcgctccctctgcttgccaccgacctccccggatgcgcagtgagcgggaacatgcgtggccgatgacgtcgccgccctccagccaccggagcgccgccgccccgctcgccttctcctctctcttc

SEQ ID NO: 702 - DNA, 1501 bp, Oryza sativa
aaggggccagcacggcaagtgctgcacagacagaatcaagaattgtattagaacgaatttgatcgattcagttgcacactgttaattcgcaacaaatcaagatttattcccagctcaattaacattaaggatttgcttcaattcgtagaattgcgtattagaaacagaacaaacacaataatccggggggacgagaaggaactcacaggcacgatcggtcgctccggacgagtggggactcgaacgcgcacaacctcccaccgcaacgtcatctcgttgccgatgttgacgtcgacggagacgccgtggtggcgagacaggaaaccctggttccctcgcaggtagcgcccggacctgtcctgcagaaggacgacgctgccggcaatgtccgtgccggagcatccgataggccgccacatgatgtcgtcgggctcagcatcatctcggtcgcgctgcgccgcctggagcgagcagcaggggagcgggcaggaggggagcgggcaggcgcagcgctcctggtcgcggtcgcgggcgtcgggggctccggctccgaggtaccggccgtaggcgccgcgaaggagcacgtagcgcgtatgggacgccccggcgacgagctcctcgacagcccacaccgcgttgggcaaccaggcgtcaccgtcgcggacgctgccgtggtagacagacctcccgtcctcgtcggcgtggaggaatgagccacacggccagagccgcagcgccgcaaactccacaccacggaaaacctccatcatcgagcgagcgagcgatcgatgtccgtgcggtggcgaggcgaggcgcagcgtcgcgtcgcgtcgcggtggcgaggcgaggcgagcaggagcgagcgagcgcgcgcccggtggcgagtagctacccctcggcttctcgcttctcggcgtggcgtggcgtggcttggctcgccgctcggcgggaggcggagcggaactttggtcgagcacttggtgggcgaggcggcgcgcgcgcggtggcgaggcgccgaggcgagggcttctctgcgtggggtggggtggcgtggggaggaagaagtagccgtagcggagggagaaaagtttgttacgtctctggctttctgctcaccgccggcatttgaaccgggcgtggccagagggaggagacgtgcattcacggggttgtgggatggacttttttgttcgggccatccttcttttcttctttgggctgggcttgaagggttctgttttcttgggcttggtgggtcccacaaccactattcactttttttttgaaaaatctgagcctgttttctggtcccactgctgatttttctcatttactccgagactgtgagagagagagatatatatagtcgaagctctaagagaggcaggggagcggcgatgtcgccatggtgaaagggaggtgatttcgccggagcgacttctagacgattcgatggtgaggagctcgttgtcaacggagattctctggtgagtacttattc

SEQ ID NO: 703 - DNA, 1501 bp, Oryza sativa
tcgaaccgagcgggtgtagagcagatcgatacagacaaaccgaagcaacaaggttgaggcagctttggtggtgtggcaaggaaggtgctgctacggatgggggtgaggtggcttggagtggtgggcgataacgagtgtttcgggggatgacgaggggctcggtggcttagagctggggacgacgaatggcttggcagcgtggagcggggatgacaatgaggtcctaaatgccagatcctctgtcgttgccatcttcccttctcctcacctgcgcctctaccgaggacgtcgctgccgctccatcgaagctctcctgatttggcttcaggatcacatgatctggctagcgccaccgctttggggacaacaaagcagctcagggtggtggcctcgccgatgaggaccacgtgtggatcagcttgggatgaccaccactacctcgaatcagctcatcgtcaccatttttcacagggtgtaggggcgtctcaggaggctatgcctctcccaacatgtagcacgagccgttccttgtgccacccagacgaattctgatgaggaacacatctcacttgggctccacgttcttcacttggcaacgggagagatgtacgtggcgtgaaatctctgatgtgggaggctggggttgaactacagccatgcacactacgaaagcccttatgtttcatagagtctagacggtttcatgctagtagtatcatgcataagcataaacagacatccttcgaactcccaatcagaccatcagcaaaggaggtttcaagtgaaatacactccatgttttggctgttttgactttcgcatgatcacatcaaatccagcggagccgccaaaaacccggtccaacagcgaacaaccgcgcaaagagccaaagcaaacaatcaaaaagcacagaccaaaacccggtcgacaccccgagcaccacccccgccctctacccgggtccaaaattcaaaaccattcgaacccacgaagccaaggaaaaaaaaaaaaggaaaaaaacaccccaagggcaaccctgtcatttcgccccgaccaccccgctccgtcacacccagacggccgccgttagccacgcgtcctcccctcattggcccgcgcctgctgccccgggattcatagcaggcagggccagagtagtagtagtactaccggcacaaggaaaacgaaagcagcaaaagtcacacatacactctctctgctactactactcttctactgctccactctgctctgctcgccgctcccattccctgcggattctatctctctcttctccaattcgcgcgggctcgggcgccgcattggcgcgatctccggattgtgagggtgggggtttcttgtcctggattggcattgcgttcttggtggggggtttttgttggctgcgttttttttttttggcttttctctgatcgggaattggtgttgtgttcttgctttgtgcaggggtttgttgtcgaattgttgggggaattgtggg

SEQ ID NO: 704 - DNA, 1501 bp, Oryza sativa
agagtgcatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataattaaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcggtgtcgatcgcgcagcagcaaagcgggtgctcggtcgctgagcctgatttgctcccttgtcagtcgcgttggttggccttgggcctttgggcccgttgcgacccggcgttggttcgcgcgggcttccttcccaccccgcgttggtgggggcggg

SEQ ID NO: 705 - DNA, 1501 bp, Oryza sativa
tacatgcctaaaatacgagagcgaaattgatataatggtggacttgcagagacaaataatgatctaacaggcaaggtaatcttgatggtgtggcctcatagaatttgagctttataacaatgaatgactattagtgagtcacaattttatagtaaggagggattaataacatcatgaaaatatgaattagctgattttttttaatcgcaaacaaggaattgtggtttgcaactcctatataatttttccaccctaccgatcctaaatggatcacaatcacatactcctataccgcaacccgttttgagccaccggcccaccccaccccccctacgcacaaaacaccgggacgcgaagcggaaaacgagcgagcgagcggggctctccagtctccaccccgactcttcgtgtccgctgcgaaaaaaaggttagaacaccaccccccctcctctccctgatccccctcgcctcccccctttccccccctctctttgctcctctccacgcagcaatccgcccctcgattcgaccagatcggcgcgagtaagtccccgctacatcccgatctggatccgcccccgacctccgcgtgatttccctctccgtggcggtgttttggtcgggtacgtagatcgacgcgtggtggggcgggggggttgtattgtttgggtaaattctggtgcgcgacggcgggggggaattcgggttggtttctgaccgaattttgacgcctgtttgttcgatccatttgttgtgcagtgtcgatctatcgtgtgatgtgatttttttccccctggtcggtgtgtgtcttagttcgagttattcggatgtcgatgggagatgctcatgttttacttgttttgtctgtgctgaccgatagattcgttaatcgttgtgattgatgtcggatatgtttgccaccattgttgatgtggtttaggcgcagtagttgtcgtttgattcctaacagatcattttacgtatttgggagcaatgcgaatttatcaagaatttgataaccgcgttagtatgtaatcaacggcttgtatgctggtatgcagtagtattttatgaacttgtgaaattatagttgcatgtgttggtatagtggagtagatacgtgagaatttactactttgtcttacattagcttacggcatttattttgactatggaggttaggaccatggacccatataacctttgtttatctttctggtttacaagagaaaggtcaagtttgtatggatattagtgggtccataggtttgtaattttaggataatttactctgaatgtgttgatagcgaagttgcttatgtggtgagcttaatgcttttgacttttgttaaaaacaagtcccactgcgttgctttatatctacttatatccgattccatgttatgtaaggatggatcgaaacatgtttaaaactgtagaactaataatatatatttcattctcttaagtatgctaatgcaatttaagcaggagcttatca

SEQ ID NO: 706 - DNA, 1501 bp, Oryza sativa
taaatggcgaatgacaagggcgctctgcattgatttgatgggccccgcgcagcaaccgcggatagcttctgggctaaggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatattccatggattctttatatttagttgatttatctccgatgtttttctttggttcgacgccatttgccaacagtaatgtgagcggaattcgatcgacaaaagatctaccgttgattttagatttttttttctattttgaggaaggcaaggactacgtacaacttaatatcagttgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaatt

SEQ ID NO: 707 - DNA, 1501 bp, Oryza sativa
ccacagtaggagcctatcttgttatttcccataaaagaaaggaattttactgtagcacccgttccgtcgtggcgcttagcgggaaaactatctcttaaaaaccctagttgcgaaatctgtttctttgcttgttgtctagtgtccgtgccatctcagacctcaaatccccaatctattgtcgagttcaatcccgaatccaaatccttcccaaatcaaatccctccgcaaaagtctattttacctccctcgggttcgatgggccgaatccctctcggcccatctccccctccctccccggctctctctctctctctctctccccgctcttccgtgagccgcgccgagccctccctcccgctctcgctgccattcccgccgatgccgcccaaatcgccgcgccgcccgcgcgtgcgcgcgcgccgtggtggccgaccggccagtcgccgccgccgtcaacgcctgccgcgcctgccccgcgtctgtcgcccgtgttgccgctccactccaaaccggtccgccgtcatcgccgtcgtcatcgacccggccccgccaccgccgcgcgctggcttccaagggacggaggctgagccccgcccccctctgctgcatcgctccctctccctcctccttttccccaaagtggcaaggaggcaagcccaatttctctccccctttttcccttttccctcccgccggcgtcatcctcccctccctgtcgccgctttggccgcgaccgtcgagcgctagctccctcccttgaccgtcctaggtcggtttccaaaccaacatcgccgccctataaacccaggcgccctcccttccttttcccctcccaatcttccccgtttttcgcccgcgccattgtcgtcccctctgtctcgccgatcgccgatcgccgaccgccaccgtcacgtgtgccgaaggagtcggtgcacgttaggacgcggaaggggactccggacgcaccctctccttcctcttccccggcccgaggccggagagatcgctcccgtgccgtcggcccatcgtcgctgcgccccgtccgcacggtagtgcatctccccgttctccctcctcaatccatctcttccccttagttttcggtagtagcatgtatagcctccccgtagctagccggcgccgccccgactgctgccgtcgctcgccgtgtgctcgccgccgtcgccgcccgagctcggaagcgcctctcgttgccggcctccctcgatgcgattcctcctaatccggcgtaaggggtggattcccgtagccgtgtggatgctctcgccgccgggaatcggcccctcgtgacctcatcgccgttttccccttctcccgccgccgattgccgccaccgcaatccgccgccgtcgagcaccctcggtgaatctgagtcgttggctcgtctcccctcgtcctgtgcaacgtcccggtgtactcgccttcgcctgtatcgccatggttcgctccgccgcaccgcgtcctccgcgaaccgcacgca

SEQ ID NO: 708 - DNA, 1501 bp, Oryza sativa
gggcaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagc

SEQ ID NO: 709 - DNA, 1501 bp, Oryza sativa
agagtccatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataataaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcgttgtcgatcgcgcagcagcaaagcgggtgctcggtcgctgagcctgatttgctcccttgtcagtcgcgttggttggccttgggcccttgggcccgttgcgaccgcggcgttggttcgcgcgggcttccttcccaccccgcgttggtgggggcggg

SEQ ID NO: 710 - DNA, 1501 bp, Oryza sativa
tctcccccatcttgcggagccgcttcttcttgcgctccccctcgggctgagacgtcggcgcggccccctccgggcgccggccgctggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacacggtcgggatcgatgcagagggggaggatctcctgaggaaggtgagacgcctccgcggagctaaggttcagcaccctttggaccacgatcttgaagtcctcgggagcccaatcccatctggctccctgatgggtccgcatgtagtcttcaggcccagtgtactcccaggcgctccgggcgcgccgttggagcggcgcaatccggcgacggaggtaatcgccgaataccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacgtccatgaagaaatgagaaaatggcggggccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcagcgaaggcaagaggaacaatggcgaaaggaagggagcaaatccttttctcgatgcttttatacccttgccatcgctgggcctggctcctcgtttctcgtgcccactacctcgctccctcgtatctcgctatctcgctcccccgtttcccgtgcccacgcttccactaatcccattcgcccgcttacggcgcttgaagtggatatgcggttgtggcaatcgaa

SEQ ID NO: 711 - DNA, 1501 bp, Oryza sativa; identical to SEQ ID NO: 706

SEQ ID NO: 712 - DNA, 1501 bp, Oryza sativa
cacctgccggcggagcgctccctgccgggagttccggcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtactgccgtcgccgtagacgaggaggcgatgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctcagaaagcacacgctgagccccctacctgg

SEQ ID NO: 713 - DNA, 1501 bp, Oryza sativa
acgtacagtacgtcgatttcagtcaagcaccgggccgcccagtatgcccaatgctttgcacgagcgcgcgcgcgcgcgcggaatcggaagcggaggaacgtacatcgccttctcatccgtcaacttcacgtggcccgcgaagcctcgcctcctctgctcacttgggcgcggtacgatccgcggacttcgccatcggcagctatagcgctgcctgacgaagcacggcggcaagtggggaactcggggcgacgcccacacgggtgacgttgcccacagcggcgcagcgtgacgcccgcgtcgtgatgtcaccgtcgagccagcccagccagccacgcagccggcaggcggcaggctgctagcgcgagagcggggtggggccgaagaggccagaaatacggtcaaatcacgtactacccggccggctaatcagatccgtgcatctgccgtgtatatattgccttccagtagtttcttttgctgataggctgatagccgttactccctccataaaaaaaaaacaaatattaggtttatgtatccaacgttcgttgatcgtccgtcttatttaaaaaaattataaaaaaattaaaaagataagtcacgtataaaatattaattatgttttatcatctaacaacaatgaaaatactaattataaaaaattttatataagacggacagtcaaacgttggacacgaaaattcagggtttgtcttttttttacggagggagaacgtaataagggcaagttttatagtagagatgactaccacatccaatttcatgcatgacatagataattaaattaagaggtgatacgtataataggttatctctaccacacaatccccaatatctctaacactctcatatgtttattgaagtttgtatagaggttgcctcttgcatgagagttgactatttctctctcttccttattctctcctccacctcactatttagtcctatgtggcattttggggtttgtgcttggatgcccatagtacttaccccaagtactacgagtagtagtctactgttagtattgttattaattaatcgagcttaattaccacgggattccgggcatccgggcgtgtgattgaggcgtgggttcacacgcacattgatctcacctgtccgtgtcgcctttcgtccccgtttcggccatccaccatcttttgctgcaggcgtgccgcgcagcgaaattccttgcggtggtcaaaccgatagggtcactgtggcaatcgtcgcgatcatcagagaaaggaaattctgtcttcaggctatcatgtcatgatgcactaatctgtagttagaatccgacccgttgacctatcttggcgacgcctctggtttgatgggtacttgtgttactggcttactgctactccatactccatactcaccccgtgctttactcctcacctattatcttttttactacttctcatttatcattttttttcaaaaagagtatttttttagctttagatctgat

SEQ ID NO: 714 - DNA, 1501 bp, Oryza sativa
aaaaccgactataaaatattataggtgtcggtttatttaaaaattaacacctatatcaaacggagccgagctggcaagccgacctctcggataagattgtgcgcgagtgcgtgacccttatcctctcctccactcgtctctcttctctcccatacctctctctctctctctcgcaccctctccgtcgactccctctcctccactttccatcgtccccctcctcctcccctctccgccatcctcctctcctcccttcctcctcctcctcctcctttcctgagttggcggcggcggcggagtcttctcctgtgggcacgccctcacctcccctcggcagcacctcctcacggcggcagcaccctcccctccatcagatccgagggaaggggaggccgacgcgtgctacctagcggcggcggtcaccgaaacatccaagctggggggcgatgacgacgtggggcaggccgccctcctccagattcggtgcttcccaccggccaccggcgctcgagggtggctggatccggcgccgccactcccaccggtgctcgggggtggtcggatcaggcgaggcgctgtgcttgatttgtttttttttttcttttgctttacctctgatgcatgcaaatagttcgtgtaatttgtgttgtggattgaattgaataacgatttgttcttgctgtggatggatatggaatggatggatgatgattttttcttgctatggatggagaaggtgcatgctcgatgcatcgagccggcttttttttactcgtggaaccacaaaggtgccggtttaggaaccggcacctgtttctcttcacatcagtgccgccttcgtggtgccggttgggaaatccggcacctttgtgggattcccaaccggcacctattaggtgttctgtggtagtgacttccgctggcaatgcaactaaaccgtgttaaacaagatcagcaaaccctcaagatataaatgtatcatatacaatcgtcttcctcacaaattctcctgataaaatagccttctttcagcaccttgcagcaaaatgcttagctgcatgcaggctgcaccgaaacgtgagagtggctcgggattggtagcctccaccatcctggctaacgatggcgttccccagtattgtaatcccaacttgcaaatacatctaatccactgccacccattgtttgtgtccgttgctgcaatttgccagtaaaaaagcatgcccgcatcgcacccggacgcttacgtcagttcaagagcctcaccaaggtcgcaataaacaagaggcaaaacatatataatacactcatagtagtactagagaaactatcctcaaaactaaaaaaaaaacgatatgagaaattgtgcatgcattgagagcaagctagctagcatctgctatatatatatatatatacatatatatatatatatacatatatatatatacatatacatatatatacatatacatatacatatatatacatatacatatac

SEQ ID NO: 715 - DNA, 955 bp, Oryza sativa
ccactatacaatcgtgcaagttaaaagaaaaaccaaaatgtatcttcgttgtacaggtgatatccaccgcttgatttaattatttttgtttgtcgagttgtaaatcaaatttaatcttacatgtttgtctatagacatatagcatcccaaatgtttagcaccgaagaacattaacctatgccacatcgtgtcaagagcattcttagaaatgttgatgtagatataggcaccttatgggcctcactatttaattaaaaaaaatatgttgcactcaacttgtcatgttgttccatcagataaacgtggtatcgtttatgtttggacaattacttgacagttatttatttgactttattatgtacttagctataaacactcatgtattattttttgttaacttcgttaaaaatatcaaaccagtgctccataaaccagttcaacgccagctggcagctgcattactactattgcatgtgttagctagctgtttcgcttcggaaaaatattttctacacttggtatcatgtcacccagatgtatgcatgtagattatatagtataaagcactatacaattgtgcaagttaaaagaaaaaccaaattttatctacgttgtacaagtaaatatccactgcctgattttattatgtttgtttctcgagttgtagatcaaatttaatcttacatgtttgtctatagactcatagcatcccaatagatgttacttttttttaactttttataactatttaagtcgtatagaaataatggttgccatgatatctagataaaaaacctatccgccctctacttctactttgctgctcgctagctctttcatatttttttccctcaataattcagaggcgttatggtgctcttgctctatataaaccctccaagcctctggccgacgatcaagaaccactttgcccacgtacatacaccgacagcca

SEQ ID NO: 716 - DNA, 1501 bp, Oryza sativa
aagcggtggaggagaacaaatgatacatcaatcttgttttttttccccatgcagatcaattcaatccactaaatttgcggaaaatttactttatttctatcaaacaatacaatccactaaatctttgaagatttagtttgcttcctaatgaacgatactaatcacatggagctaactattctcgactcacagaaaataccatatttgactagttatttccccactgctatcgtttacgataattttattttatatcttgcatctctcttaatcaacggtatacattatcctatctcttagtatttcgaagtaccttataaacaccgtaaaagctcggagccattaatcggccgctgcaataatccaatgaaatggaaaagagtccggctgcacgttgcgatatgtacggactccagaaaaaaaaaaaggacaatacaacagaccatctgcccatctgcaaattaaaatatccgctgtttcgaccaatcgatctcttcgtagtaaatctttcgtaaatgcatttgttgagatctatcgccagactaaaagtactaattttgtgcagtgggttgcagtcgcatacagtagtcgtgggcacggtgcacgtgcactgaggttaatgtggaatgtcacgaagcgaggatggagactggtagccggccggtgtagttctcaattggacttttttttttttttttacaactcatggttggagttcagagcagcatattttccatacgaaagagacttgaaagaccgggaaatgaaaaggttaggggactaccaattgagggcgccaaacgtggtcgcgttcactgctgctgcgaaacataccaatcaccagcttgggttagctagtatacctcagctccaaacacgtcaaaattgatcgacggaatgtttgatcaactgtcgttacgggtgctacatttgcgaaggaactggaggtctggagtacaaatctttcgtgccaacgccgcaacgcgggaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaattttttttatattgaaaattatacaagattaaaatctccaagactggtaaaatacaattttattattttttagggtctatttggaatgttaccgtacaaatattttgttagtgccaaaatataagcaagttttggcactaccaaatatttggt

SEQ ID NO: 717 - DNA, 1501 bp, Oryza sativa
tcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaag

SEQ ID NO: 718 - DNA, 1501 bp, Oryza sativa
ctgtagcacactgctattttctctcattttttttcttgatatgtaggccgagtttagatccaaattttttcttcaaacttccaacttttccatcacatcaaaattttcatacacacacaaatttccaacttttccatcacatcgtttcaatttcaaccaaacttctaattttaatgtgaactaaacacacacgtatttagttgtttatagttctattattgtacgtgctctactagcaaaaactgtataggattctactttaccagcattgtcctcggtgcctcctgactcctgagcaagcaaggcggtaaattttaaattttcaaataagttgcactgaacaatgctcaccaaccggaccgtgagggtgtcccagttgctgtgctgcggcgctactcttgccctggttgctccggatcgcaataagttcccccataaatgctgccattcggagtggccgctgtaaatgaaggttgttgcgacgcattgaatacaagcaaccttcagacactgcagacagccgtaggccaggaaccaggagcttttaaaacctctgaccctcttttcctttgtggtgaatttccagagggtttggaaaattgggggtataaaacaaactccgttttgttacactagaacgaaacttctaaaaaattgtgctctactcctactcatcaaaatacttctactagtaagctcaactcctttaaaattcctgcaaaattcctcgaaactaaataggccctaattaaagaggaagatatatacttactatatcatatcatatcttcaatagcgaagccaatgatgtcgtttagtttaaggaaacaaatagcatttttggacgattaactagtttctgtgaacgtcaaaggtagtaattcattgtggagtaatcaacaacagagcctgaagtcgtcctgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggagtcgacaacatgagctaagccaagattaaagctgtaccaccattttttctctgcaagataaaaccatagaaatccagaaagccaagagaaatcattttgtcgattcctatttgttctactcgtagcacattaatagcagcacaaggccccccatctcctctcctctgtgcttccctcactgcgccaccactccaccacctccacctcctctccaaaaacttgccttgccgccgcaaatggacaaggcgccgctgtgatccctcctccccattgcgttctcccgcttcctcctcctccgcgcgcgagatggccg

SEQ ID NO: 719 - DNA, 1501 bp, Oryza sativa
tgctcttgaaggctgttgtgtatccatttgtatatatactgcatgaatcaaccaataattaaattttatcatgcacccaggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtcaatttctctttaccatttagacatttaattcaaattaatcaatgcaattctaatcggcaaaatcaaagtaattgctggtagctgttctcaggagcaataccttgcttctttcgagggttagcatgaggccatgagtatcgatttctttcttgtggagttctttttgcctgccttccgtcttatgtctcacatgcaacagcttggcataagcaatgtatgtcatttgagtctttttctttgtatccatcgtgctgacattgctccatgaggagggcaaatgcccctcctggagaagctttgattgcggtaatcaataaaggaatcgattgaaatctgtgtggttgaaatgaaactgggtatgtatctgaaaaagaaagttcaggctgggctcatagttgagattcaatcggttaggtattctagtgtttcagattcagggaaaaaaaacagctataacatccacagggcttcttacggttttgttttggtctgcccccacacgtcagtgcctgccactgcatcagcagtacacagtcgacaatctctactgtaggagacgtgtgctagcttatgcttatgtgatcttttaacttgttgaagcaatcagcattgggcatggtcaccttaaagtatacctttgtcctttgagcaaagagatggagtgcatataattatgagcaaaagagatacatctaattgtgatctttgggtgttttcaagcaaccatccatttgcccccacgttaattctcgctttggccctcgtgccctgcgcttatatgcatatcacctggactatttactgatataaattgaacggccaaaaaaaaatatactgtagcttcactgcatttttcttgctcgatgtagaggatccgattcgagagtgaaatactgttactacaccaatggacggcgcatattttcttgccgcgagcacaaggccaaaggtttgattgacagaacgtccactttaaaaaacctggttgaaacagctgaaaacgaaacgaattccagcccaccaaacacaattacacaaacacctccgagagctccgaaaccgaaagccccctcacacg

SEQ ID NO: 720 - DNA, 1501 bp, Oryza sativa
tggactccttccatatatgtaatccttccttatctcctcccatgtactcctatatataccggccccctgaggctcaatacaatgtgtccaatattcgcagtatcctctttccctatactatccaacatggtatcagagcgggcgatctagcgccgctctcacgcttccgccgacgccgctcccgggggcggccacccgtttttttcttttttcttccttgtcgctgtcgtcgtcgtcgtcttggagagatcgatcttcacgattgttcttcgtcgagtctagtcgtcgtcaagcagcagcaacagattgcatctcctctgccgacctccgtgcgcggcactcttgtatcgccgtcaggccgcccgtcgtcggcttcatctttagcgtccgttctgctccgccggcctcaccgacgggccctgccgtcgtcgtcgcctccactggccaacgatcgagccccgatggacagacggacgacgcagctcggctgctccacctccggcaccggtctccccctgcaacccccgactcctctgtctccagcaccaccgtcgactggggggacgagctcccggcgctgcttctccgccgccggtcctcgcctaccacctcgcatgtcctgctgagaccatcctccaccggctcaccggacgtccgccgctcgggaccactaggatctgaggccgccagtgccggcgccggcgctcgccggccactaggtcccctccacccggcgccaccccgtcccctcctggagggtcgcggctctcgccgtctcctcgccggctgagtcatcgtcgaccttttctgtctgcctcgccatcaatctgttgcttcatgtctcacttttctatctgtctacgcgtgtgtggatggataggattggggacagggaaaggcattggatggaccggtcaaaggattgctacttgatgactttggtccctgctgtggtgcacaaggtggtgtggacttggcctatggaccatgtgtgagaggatgagctgcacgtgtgagcttgctactgatgctgttctgctgctacatgtatccttgtttttttccccttttcaaaaaacgggtttgcgtcgcccaccgcctcgtcaacatccacgtgtctccgacatcggtgttgactctgcttcaacttcatcgttccgcctcgcgcatattcagcttgatcacccgttcaagcgcccggctacaacgacttatgcaaccgatcatcatcgagcatgcgtctacaccatcaagctttggggtgccgctgcgttcgctcccctcgggccgcagtgccgctgcctgtggtccacacctccactggttgttgcagtgctaagaggcaccctcctcagcatttctacatcaccggtggacttcttgccgctgcatcgacatggagctgcagctgtgctgtcctctcggaccgcagcttcgccgctttcgtcgtcttcatcgccgttcgcacatcaacaacctcgtcgtccgcactggtcatcgt

SEQ ID NO: 721 - DNA, 1501 bp, Oryza sativa
atcttgttggattaatgcaatggctggcagcctgagaccaaactgatcgaccggttgaagaagaccctagtctatgtacaatgggccagttaggatcatgagctggattccaattaagacgggtataagatgaaaaaaaattaacaggggcttagaggttagagccagaggctttcgctgcggcgtccttgtcattgaatagctagttctacggcctcggcgaggcgagaggcgataccctaccctgcgcttgctttgatgtgcttcacacgtgtgttgtcacgtcaggtcaaactctccaacagttgttatcctcaccctagcgattggcagaaacgagtacttatggttttgtgagaggggttacctctctcccaaacaccctctatagcagcacacttactagctatgtacggagtacatacgtacatcttggatactatacacaggtagcacgtctggttcatcaagtcaagattcagagttgagagcagcataaaaggagccataggttcatatcctgccctattcaagagaggtcgatatggagttacgttgtcggggcgagatatgtgaaagattcggcttaatttgtgcgtgtacgctaccaaccaattaggcaacactgaacatatttattcgtttcttgcatgaccagtgaccatgcagtataggactgtatgaaaaaatcgagttgagctgaattgaagacaccacaccaccagccgtcccccgttccgtcacaccaaaggatacccgtatctttgttgcgtattgatcatcgccatcaggtattcgatcattatcagcagatgggcacgggaccgatcgatttaaggggagacggccgaaatacgctaataatacatgcccccgagtcgtgtacgagtacgacccttcgctaccattgctttgcgtatagcacatgtccatgtgcgtatactcccaacgcaggtactgtgtgtcgccagctgctctcgcagccggcgtatcgtacgtactttgacagggctccctgaggaatttgatgactaggatgctctaatctcgtgacaaaacacaagattagcctcatgatgatccgcgaaaagtaccggtgggaatctgaacccgatcgatggagaacaaacagcgacgaggcaacgacgtagagaacgtacctacgctcgtcgatcgatcggcagcgcatgcaggatgagtaacatccgcgacagggatcaatcggcctggtcacatacacattacatcaattaagattctgttagcacgttttttaaactaataaatgttatgtttcctgtgaaaactttctatatagaaattgttttcactacaaggatttctatttgttgcaatggattataaaattgttgcaatatctaacaccattactacgtgagaaaaatatacatttattaagtttgtaataattaaaaattaattaattctatgctaatagttttctcgttttacgtatatcaacttaatctttatctgcttc

SEQ ID NO: 722 - DNA, 1501 bp, Oryza sativa
tcggcagcaaggaggcgacggcggcggcggtcttggcggggcggcgggcttggcgctcgacggtggcgaacttcttggcctcccctcctctcgcatggcggggacgagtctcgaagacggcgtggcagcgacgagtctcgacgacggcgtggcagctcgccagatccagtggcgacggctcgtccgggcgcggcgcgaggatggctgcggccgtagtttcgtcgccgccaccatggtcgtcgccgcgctgccctcctcctcaggccggcaacgcggatctggcggtacggggcgacctcggagcggccagcgagctccgagcgacgcggaggcgacacgcccttcctgtcccccacgaccgctggcgccgctcactccaatgccactcgcaaccggaggctcgagcgcctcccctcctcctcctcttccggccctgcaagggcggcgcggccggcgacctcggctcccacggcggcgacccctctcctctggctctcctccgaccggcgtgaatcgagcgacggagtggccggcgagcttcgggttgagcggatcgggggtggtgtggccggcgagctccgatggcagggacgagaacgagctcgacggctgcggacagcgacggcgggctaggcggctggctggagggcgacggctggcatgggaaggagggcgatgccactcgctccacgacgcgaaagcagcgtcgtctcccagcttcattcgtcctctttttcgccaagaaccaatggccatctttggacactcgaaccttattctggtgggcctagaagtagacgtggcgtgtgccctcctgctttgccgatgtggaatggcgagggagaatgacacatcagtaaatggccttacggcatcgccgtctccctccggcttcggcacatggccctcgtaggttgcacttactcgatttatgacaaatttgtgcacataggtataaaccaaaaagtgataaaagcaaaagtgttggagtacgtcagtgctagtatctatttccgtccaactttggtggcaacgccgtgacacatgcatgcgtttggtttcagatacggcctccactttcttccgttatagtagtatttaccactactgcctgacaagtgatttactagtattttccttttgaaaaatcaaacaagaagtttcattacacctaatagcaggtacaatagcaggctattagccagctataaacatattttaatgagataaaagatgagagagaagagcagcggactacatatctgtagccagctgcagcacggactccaagacgtaatgtatgtatgataggtgggaccatatattaatagtacagtaagcaactattgtattaattggctataaataaattggagctagtagtgggctattatattaaacttgctctaattaaacgaatctatagtcgatgatagccaatccaatgggacactaattaactgatttacacttatcacctggagtcctggaagtcttagtc

SEQ ID NO: 723 - DNA, 1501 bp, Oryza sativa
atccagacagatgcagcaacaaaaaagaaaatcccactttctgaatcaaatcaaatcaaaaacatttcctcaatgaacagctgcaaatcgagcatccagatttttctcccgcggaaagaaaaaaaaatcatctccagctgcacaaggatgaacgagcaaagtccctcaaaaagtgacccagatcaagacgggcggtgaaatgataggataggtcgggcggtgcctcacctgcttaagcgatgaggggaacatggtccgctcgcactcaagcggcggctgcacgatggagaccgcggcgtcccgccaccggctgcaggcgcaggcgtagaccaccacgtccagccgcggcggccaccaccgccgatgacgtcgcagtagacaggcagcgacacgagtgttggatagtatagggagaggaatattgcgtaacgtggatcacttgtattgagcctcaggggccggtatatataggagtacttgggaggagataaggaaggattacagatatggaaggagtccacacaaatcaatcctatcctaatatgactctaactaccatatactctaacatccctccgcagtccaagcgtgagcagcgcggacacttggactgaagaagaaaccaacaagagtactcaatacggatgataaccctttgtgccgtagtcgatgtagccaaagcgaagggtgcgagggagctgtggtcgatgaagctgtgcgtagagtagctgtggtcgatgtagtcgaagtcaggaagctgatgtcgaggtagccgagccgcagggagcgcatgaggcgccgtagagtggtcgtggacgcacgggaggggcgtcgtggaccaaggtgcacgaggatgcactggagacgaagatggtgacacaatcgcggcagtcgtgaggaagatgacgccgaagagccgatgtagtcgaaccgtgaaggacgagacgtcacatagggtttgccagaccccgggacaactcgggacgaatccgcgcgccggtgttgccaataccgcgcgggcgacaggggaccaccatgaatcatatgccaatgttgcaggagactagcagagaaggcctccaagacggtcgcgacgcgagaacagcgtagagggagaattgccggagcagcgcgcagttgccggagaagagcgaaatgtagtcgagggagatacggcgacactggcgatgaatcatgctggacgaagacgaaggcctagtagtgagaccaacggcctggatggcgatgttggtagccatgtagaggtagctgcaccaccggcctagagtggcgacagtggcagcttggagatgcggtggcaatgctcgaagtcgaggaagaagaccctgagcggctgacgatgaccagtgcggacgacgaggttgttgatgtgcgaacggcgatgaagacgacgaaagcggcgaagctgcggtccgagaggacagcacagctgcagctccatgtcgatgcagcggcaagaagtccaccggtgatgtagaaa

SEQ ID NO: 724 - DNA, 1501 bp, Oryza sativa
gatctgccaacacttctgacgacggggttgctggctctgcttgtgtaggtggcaaggacgaatttatgaagctatacgagcagcggccatgtgagagccatctgattacatttacagccgctgctgccccggtctgtgaggccagcagcaggaggcgtcaatgcgatagccggctagctagctagctctcgccttttatttactgcgtacgtctcgatcgtatgcatgcaacattgcaacatcgcgtctcgtacatgcgctgtatgaagcaagttcttgttgcgatcaacaggggaaagaaaatggccaatagtgtgtgcatgcctgtatggtgcgtgccgactgttgttgattacgtggtagctgttcatggcagtggatagaagaagtttgttggcaggtgaaaattaagtgcacgcgaactactcgctacattttccactgatgtctctgcaccgtcattcatttcagaatagcgcgcggctattcggggacctgctgtaaatttttcctctcctttttttgctcaccagatttctccggtggtcaacagggtttcccaaaccgttggggctagggttaccgtgccccggcggtaagcacggttaccgcgcggtaaccgcaaaaaaccgtacaaaactgtgtaaaatttatcaaaaattcaaattattttttaaatttatttgaatttaaagaggttaccgcggtatttatattaccgtacccccgcggtaagcccgataaccatgataaccgcgcggttaccgacggtaagtcgaaccgactggtcaccacaagatcaatgcagtttaatcagtgcacttccttaccattctcagccattccaaatttcgatgataccaccacgataacacaaccttaccattttttataattctaaaactttatagtctacaaatttttttaacaaattagactttctcaaaacttatttcaaaacttgaccgtgtaaaaaaatttcaaccaaaaaaagaccatcagttcaacgccagggacactggccctaaggttgtacataccaacgccagctacgttggcgttgatcccttgcccacatggagccgaggacaatcccctcgccgacgtggcagggtctcaacgccaacctatcaaaaaaaaaaagggacaaaactagtctcaacatttaataaggtattaaactaaatactacatatcttcaccttaccttatcaaaatttaacattgccaaagtttagtaggtttttatttatagtaaagtgaagaagccctataattcaataaacatgtatgcgaactgccaaacgtagcaacaagcagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaaagaactagacgagcccggagataaa

SEQ ID NO: 725 - DNA, 1501 bp, Oryza sativa
aggggcacgagcagaggcacggctccggcctctccgacgaacgctcggttctccgagccggacttggatagcagccggatctcgtgcacgacgcggttggcggcatctggggagaaggagacggacagcttcttcacaaggaacgacgccgtcatgcgcgccgcctcgagcgcggccttgttggcggccaccgcctgggcctgctcgctcttgctcgcctcgcaggcttccatggcgacgccgttctcccggcaccacttggagatgaggttcttgagggccttgttcgacacgagctccagattggccaagacctgccctgtcttggggcacgttgacttgccggagctgaaccaccggtcgatcgactcgcgatcgtacgtctggccgctcgcgacgacgacggggtcgcgcattagatcgagagagattgggcaccggaagtccgacggcggcaccgggggctcgccgtcttcagcctcgacgtcagccttggaattggaatctgaaggccgaggcgtggcgctgaacaggacgcacttggcataccggaggaggccgacgagagcgatcatggaggccgtccatttctccgaggcacggtcgccgatctcctgctccaggctctcgatctcctcgctgcagctcgccgggtcgttgatgccgacctccaccaggatctcctccagcctctcccgctccggcacgatctcccgctcgatctcttgtatcagcgacagcacgctcgccttcagcgcctcctccgactccggtgccggcgagcaccgccggcactggcgcgacgcgagggcgaggacgtcgagcacgtcgtcggcaagccccagctcgacgaccggcaacaggtcgagcagcgtggccaggtcgtggttgagctcccgcagctccgcctccatctcgtcggactccagcagcagccgcatccggctgcgcgccgagcaatcggcgacgatcgccttgaaccgctgcagcaccaggagcacctcccgcaggcacagcgacgccgaccgcggcagctcccccgcggcgccgcacagcagcaggtcgtcgaacgcggccgccagtagcttggaccgcctcgagatggacgcgaacgcggcgcgcaggaacggcgcgggcgtgtcgacggcggacaggtcgcgcgccaggcggtgcagcggccggagcagctccccgtcggacggcgacgggggcggcaggaacaccgacgaagagccagacgacgacggcgccgccgccgccggattaccagccattggcgcagtaaccacaaccaaaagaaaaaatccttagcttattagtggagtaaaaccaaacggaaatggtggacacgcagcggagagctcgaaaagagagagaggtttataaacttcggaggcggtaggcgtggcgtgacgagttggttgagagctggaaggaatcccctagactgattttgcctttttccgtttatttctattgtgattgttatgcatcatgtgct

SEQ ID NO: 726 - DNA, 1501 bp, Oryza sativa
aagtatatgtggatgtgaatttctacaggaacgaaatttgtggtagattgatattcttctaaaggataggtatattgactcagggagattgaaaaggatattttatggactaagggaatatttaggtggagatccaaaggaaaagtattggttctgggaaaaaaataaaaattggtatttcatgtgtttggttagagatcaaaaggggagtatttggtgggagataaaactagatttgatggtagtgtggtaagctctaaatgaaaaggtattaactctaaagagattgatatttcatgtgctctagagatggttgagcgaaaattaaaagggttttgttcggtaaaggagtcaaaggaaatataatctagagccaaagttagagattaaataaaataaatagaaaggttttgtaaaattaaaaagggattttaaagaaagcttttaacttagcaaataaagtttagactcaagtcaaagaaaagatcaaaagtgaaattactgaaaggaagaatcgagaagagcatgacttaaaatatttcgcaaaaaattttccctaaaaatttaagtccattacatcgtggtacggcgagccggccgcccggtggggggggggggggaggagggaggaggggatgggatggtggtggggttggggatgtcaaggggcggtgtgttgcttatgacatgctcgtggtaggacgaaggagggacccaactcggtgacaatggagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatattttttttctttttgctgactaggatgaaacatcagcgaaaccagatattcgtattgctatggtattcaaattgcacggctttgtatagtttagggtaaagattgctggtatcagagataacgaatgtcaaacaaacttgagcaaagttgagggattgcaagtgaacttattccatccaataaagacttgtttgtggactttccaaactggcccaatttaaggcccaaaactatgaggttctcatatttcctgggcttcccagttctcaaatgctcaagaagtaacgatgccctgacaagtgacaaatgcccattgagcaggtaccgcgttgcgaattttttttatttctaattttttttattaaaagttttacaaaaataattttccattttgaaaattgacggaagtagtcgcctaccgccctctgggagggcgatttttaaaaatcgccatcccagatggcggcgaaaatgacgtggcagacggccgttcgctctcgggc

SEQ ID NO: 727 - DNA, 1501 bp, Oryza sativa
gtggggggggggggggaggagggaggaggggatgggatggtggtggggttggggatgtcaaggggcggtgtgttgcttatgacatgctcgtggtaggacgaaggagggacccaactcggtgacaatggagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatattttttttctttttgctgactaggatgaaacatcagcgaaaccagatattcgtattgctatggtattcaaattgcacggctttgtatagtttagggtaaagattgctggtatcagagataacgaatgtcaaacaaacttgagcaaagttgagggattgcaagtgaacttattccatccaataaagacttgtttgtggactttccaaactggcccaatttaaggcccaaaactatgaggttctcatatttcctgggcttcccagttctcaaatgctcaagaagtaacgatgccctgacaagtgacaaatgcccattgagcaggtaccgcgttgcgaattttttttatttctaattttttttattaaaagttttacaaaaataattttccattttgaaaattgacggaagtagtcgcctaccgccctctgggagggcgatttttaaaaatcgccatcccagatggcggcgaaaatgacgtggcagacggccgttcgctctcgggcgacggctgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaaacgaaagagagagaggagagggcagcagaaggggagcggcgaagccctgctggttcgctcacttcatcacaggtttgctcccatatatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 728 - DNA, 1501 bp, Oryza sativa
ttgtgatctagcattcttttttatactcagatgcatgccgccttaaaatatatagtattatcataatttccttatctctccaaggataaaacacaaaaaaaaaatctgataattagaaagtttgatgagaattaattcgattaattaatggcctacagaagcagtgcatgtgtgagagagtatcgatcacgttctaaaaaggccctaattaattcatcaatctcctttattctgtttgaatattcaccaccaccaggacgtattcctgaccagattaaacatgaataataaatcggatattacatagtgtattaatcaacgtcgtataattaaggcataatcatccagaaaaggtgacgtcattgcatgcagaggcggagatgatcatatcactgaccggcgacggggatctcgatggcgaactcggtgtagcacaagacggagagcatggcggagacgccggagacggcgtaggagagcacgacggcggggccggcggcgtccctggcctcctgccccgtgagcacgaagatgccggcgccgatgacggcgccgacgccgaaccaggcgaggtcccaccacgtcaggttcctcttcatctccgcgccgctccgccccctcacctcgttcacctccaccgccgccgccgacctcgccgtcggccgctccaccagccgcggccccgtctccatcagcgccctcccgtacgcgccccagctcgcgaacgactcctccgggaacaaccccccgccgcctcccccgccgccgcagcacccccctcgccgccgcacctcgccgccggccgccgcctccgccatggctgccatttcagaggaaggtagctgcgcgcctgcgactaggtttagccagcgagatcgcggctgcgagtgtgcgtatatatagctgatgagtagggggggggggttacctgcgggaatctcggccgttcgattcagatccaacggtcaggaatcttcgtctgcctgataccagtccacacacagccccggagggaatctcggccgtccgattcagatctgcacctgccttgattccaggtcaagtctgtggtgaatctgttgggcgtcaagattcgtgctggggtgaatattgaatattccctgggcccaccgttcgcagctgtaaaacagcacagacgagacaggctagcagattctggcaccgggcggttgcatcagtttccttttttgtttgtttttattttattttgggttaattacgaggggaagacgggtacaaaattagtaagcagtttgtgggagaagccacacggcacggccaatatttgaaaaacagaaggtttttaagctgtgtttagttccacgctaaaattgaaagttggaagaaattaaaatgatgtgacggaaaaattggaagtttgtatatgtagaaaagttcgatgtgacggaaaatttgaaatttaaacatggcctttatcgaggattatattatcaaggattatatttgaaaaactggattt

SEQ ID NO: 729 - DNA, 1232 bp, Oryza sativa
cactacaagacgttttggatttttaatggattcatgcatgaatttaatttatgtgtgtgcttcatatatgtgtctaaatttatagttaatccacacgagggatagaaagaccaaaacaacttataatatggaatggagcgagtactgccaccgtctcaaaataaatttatttttcatacatctcacacataccaatacaaaatcaaaaagactatataaaatacatactttaattatcaaatctcaatgtaactatttttcactttatctactcttaatatattccatatttttataaactctgatgcaatgattactctaaaaatgaacttgtgtcggcacaaatgtaaggagataaattaagggcctgtttagttcgtgaaaagaaattttttggatgtcacatcggatgtttggccggatatcaaaaggggtttttggacatgaatgaaaaactaatttcataactcgcctggaaaccgcgagacgaatcttttgagcctaattaatccgtcattagtacatgtaggttactgtagcattttatgctaatcatggactaattaggctcaaaaggtttgtctcgcggtttcccccccccccaactgtgaaattagtttcttttaatatatattaatgctatatgcatgtgtccaaaaattcgataggatatttttggaaaaaaaattggaaactaaaccaggcctgaacttattgtgggacaaagggagattttaccacaatcattgcatccgtgtttggaaagtaaaatattaccgggagtgcataaagtgcgaaatatttgtatcgggatttggataaaatatgtgtattttgttttttattggtatgcgtgggatagtaggatgtgtgaaaaataaactgagattagtaaatatttggatctatttatagtctaagttgtataaaatcataaattttttgatatatgagtatcacggttctaaaattttacaaaaccataccattaactacacgcaacacagagtctcacaagcttccagcagagtagctacgcactatgtgacccaacaatccaccatagaattccaagaacgagaacgaccttctctatcaatatattaaaaaaaaaaagggggcaagggccttctcttaggggggaaaaaaggaacgaggatttaacccaacactgtctttttcttatccagaccgagagtctggttaacctcgatttccacatataaattaga

SEQ ID NO: 730 - DNA, 1501 bp, Oryza sativa
atagtactacgaatcttcacagaaatcgaaccaaaatctcttatgttttgaaaggatggactagtcaatagtcgtcgctattgtttcaacaaaaaagaagtctatataattcatgcaatttttgtgcttttgtcttgggaagatgtattgtaaaggcagtcgaaaaagaaggaaaaataagttgcacgttaccaaagcagttctctttttgttgtatgcaagtgtagcgaggccttgtgcaaacagtccgtgcatacaaggcttggttttctacgactttcagcaatgttaacttggagtcaagttttttagaccgcattgtgcacacagctacactgcaatatttttgtttctccggctgattcctgtatctccactgtgtgctctttctaaggatatagaagtagaactattccattcagttcgtaaacggttcgattttcacataatcattctatatataaattccttataaagaactatatattaaatatattttacaactttttaattctagttaatttatccgtttgtgtcgttgaatagttatcacaaaatgattcagctattcccaaaaaaaggctgaatcattgtagtgaaattttcgtatattatatgagcgaaatccagtttttcaaatataatccttgataatataatcctcgataaaggccatgtttaaatttcaaattttccgtcacatcgaacttttctacatatacaaacttccaatttttccgtcacatcattttaatttcttccaactttcaattttagcgtggaactaaacacagcttaaaaaccttctgtttttcaaatattggccgtgccgtgtggcttctcccacaaactgcttactaattttgtacccgtcttcccctcgtaattaacccaaaataaaataaaaacaaacaaaaaaggaaactgatgcaaccgcccggtgccagaatctgctagcctgtctcgtctgtgctgttttacagctgcgaacggtgggcccagggaatattcaatattcaccccagcacgaatcttgacgcccaacagattcaccacagacttgacctggaatcaaggcaggtgcagatctgaatcggacggccgagattccctccggggctgtgtgtggactggtatcaggcagacgaagattcctgaccgttggatctgaatcgaacggccgagattcccgcaggtaaccccccccccctactcatcagctatatatacgcacactcgcagccgcgatctcgctggctaaacctagtcgcaggcgcgcagctaccttcctctgaaatggcagccatggcggaggcggcggccggcggcgaggtgcggcggcgaggggggtgctgcggcggcgggggaggcggcggggggttgttcccggaggagtcgttcgcgagctggggcgcgtacgggagggcgctgatggagacggggccgcggctggtggagcggccgacggcgaggtcggcggcggcggtggaggtgaacgagg

SEQ ID NO: 731 - DNA, 398 bp, Oryza sativa
actattttggcttgttacggaagctgaaaaaaaggtactccctccgtcccaaaatataacaacttttagcacttaggatttgttacaaaatatagcaacttcttcaccaacattccattcccaaccaatcacaaccctccaccattcacttttcccacctacctccacttttcaaccaattacaacctcttcctatttaattctacacactttcttaataaccgtgtctaactctaaaactacttatattctgggatggagggagtaacaaaaagaataaatattacgcagcagcattaaaactggctataattatgttctggttatgttgttattcctggagttgtttatcttggtctccaaatataatctagagaaagtttatatgtatgttacct

SEQ ID NO: 732 - DNA, 1501 bp, Oryza sativa
gacaggtaatagggttttaaagaagtaaggtcaactcctttattccattgcagatgttgtgtttctaatgctgatcaaatggatattgttacatatgagttgatttcaacgattgttacttaactagctttggtgagatcagcatttgacaggaaactttaccttgcattctgttttgctttaattaagaagtgcattctgcaactgaaaatacttcccgtacgttttcggattaaaaaagctatgcaggcaacaattaccccgtacatttcccttaatgtgaaaaatttattcattcacctggattgaaaagctcagctggtgcggttggtaagtactactacatcattttgtgtttaaaagcttagtaaatcagacattttggttccttagccggcaagaaagttgatgtttatttgagtgatttcaaaggtgatgttaaggttttcttttcttgtatgtagttgaagtcaactcttgactaaatttgatatccttgacctgaatttgctagactttagactacgtgtgtggcactgtggtgtggtgactaatcaatcagttctcttccttccgctatgttgtgtgttgtgtcaagagttattctatgaacttatctgatgattctttgcattagctgtagcacaatcttacattcttatcatggctgaatgaattgtgaattctcttttacttttgcatgatctttttagtacttataatttcactttgatatataggttcttcccagctccctacacatgaagttgtcttggaagttggaaccactgatgctctatgtaaggctgacttagttaaggggaaaacgatgaaagcttcagctaattaatcagctcctaaattctgagcacatataaagccaacccacactatggttaccgaagtttcgaaattttaaggttccgttgtttttccaatgtataccacattatttgtattggatcagaaagaaaatttcatttccacaaatagtcattgtccgactccaattaacaccgatgcctgaatatcccagacaattagtgtatgaactctgaaattgggtatgagttctgaggtgtatatcttcctctgaattttttcctccacttgtaatttatagattatacttctaacagtgatcaggagcactgtaaatttcttactttggattactagccatggatttgaatttgatgctcgtactatatgcggcacaacaagtagtcactaattaataatagaaatcaacctgtaccaggtacctgatctgactatctggagtgcagcacactaaaaatgaggcttctgaagtctgaactacggatagatgaaattaaatcacactagaacgtttggaaatatataacaagtgcatgactcgatctctgtggtttaaacatgcatatgggctgacatggaagaaatcaagctgcacaacgttgatgaccttactgaaactttaatatttagatagatacatatgcagcctgttcgacct

SEQ ID NO: 733 - DNA, 1501 bp, Oryza sativa
tattaattagtgactacttgttgtgccgcatatagtacgagcatcaaattcaaatccatggctagtaatccaaagtaagaaatttacagtgctcctgatcactgttagaagtataatctataaattacaagtggaggaaaaaattcagaggaagatatacacctcagaactcatacccaatttcagagttcatacactaattgtctgggatattcaggcatcggtgttaattggagtcggacaatgactatttgtggaaatgaaattttctttctgatccaatacaaataatgtggtatacattggaaaaacaacggaaccttaaaatttcgaaacttcggtaaccatagtgtgggttggctttatatgtgctcagaatttaggagctgattaattagctgaagctttcatcgttttccccttaactaagtcagccttacatagagcatcagtggttccaacttccaagacaacttcatgtgtagggagctgggaagaacctatatatcaaagtgaaattataagtactaaaaagatcatgcaaaagtaaaagagaattcacaattcattcagccatgataagaatgtaagattgtgctacagctaatgcaaagaatcatcagataagttcatagaataactcttgacacaacacacaacatagcggaaggaagagaactgattgattagtcaccacaccacagtgccacacacgtagtctaaagtctagcaaattcaggtcaaggatatcaaatttagtcaagagttgacttcaactacatacaagaaaagaaaaccttaacatcacctttgaaatcactcaaataaacatcaactttcttgccggctaaggaaccaaaatgtctgatttactaagcttttaaacacaaaatgatgtagtagtacttaccaaccgcaccagctgagcttttcaatccaggtgaatgaataaatttttcacattaagggaaatgtacggggtaattgttgcctgcatagcttttttaatccgaaaacgtacgggaagtattttcagttgcagaatgcacttcttaattaaagcaaaacagaatgcaaggtaaagtttcctgtcaaatgctgatctcaccaaagctagttaagtaacaatcgttgaaatcaactcatatgtaacaatatccatttgatcagcattagaaacacaacatctgcaatggaataaaggagttgaccttacttctttaaaaccctattacctgtctcaatctagtatagataatcacataataaagcaacgtggaagttgcataagcatgaacgttattacatgtccaagtctagtatagttaatcacataatagagatacatggaagttgcagtagcatgagctagtatcacctgtcccagtctagtactctagtatataatcacataataaagagacatggaagatgcagaagtacgaacaagtaggttcaaaaatagtgccacagcaactagcaagtgatcaccatacctcca

SEQ ID NO: 734 - DNA, 1501 bp, Oryza sativa
ctccaattctacgcaatatagtaccgtagaagagtgtgtggatcaacaggataacaataactgactttagacatgtatacacaaatgaaatgttggttcggcagaacgttgcgcaaaggatgaaaggaatttccaatgatgggttattattggtacctcacaatcataatacacagaaaaacttataagatgaaaacagacctctatgtaattagctatggctgtcttgtatgaccctgtaggctcattcaagctccttactgcctctactatgatattgtctagcctgcaggaatgccacacgaaagtaaacgaactggcttaacaaaaagaaggaaataccaccattatccatacattagactgaggccagtaccagagcattgggggcatttacctcgagagggatctcttggatgaagtagacgttgcaagaggcacaggctccgcaacatcatcatcaccatctgaagttaccgcggcaatagctgtagaggtagagtggccttcatgcttaggagcggatcttggcttcttaacgacgggcgctttcaccctgtcgcgggcaccggacgcgttcacggttacgttcatgttccgccatttgtcctgcaaccaaaaccaatcaatccatcaggaacaagttactataaaacttcgtttccctgaagcaaccggactcattcagctgtaataaaccttgaggtcaacattggagcggtagcgcaggacgttgctgaagtctgggtctttgagtatggtgcgccatttcccagccccgtgctttgcgatcccggccttgagggcggactcctcctccgcggtccatttctgcttcggggcacccatattatgctcaaatcaacactaagctacttcttcttcttccaggggcgggtccagcttggggaattttacggggaaacagacaaacgaactgtttgttacttccacagatctacaagagaagctagggttcacgcgagcaagcaaattcgagacaaaactactcgatagagagagagatgaatcggaaacagatgcggatcctcctcaccaggatgcagcaggatgacggcggcgacggcaagctcggcgagaggggaggagggcgagaggaggggcttggcggagcagccgcttcgagcccctcttcacccgcaactcgagcggggggatggggaggacggggaaggcgacgatggacggcggtgctgggcgggcggcctgggaggacggcggcggcggcggcggcgctgggtgggcgggagtacgacgacgggtcgacggcggcgttgggcggggagggatggggagagggtgagagagaggggggggcgggacccacgccgatggccagccgtcctccgtcctcctcatcttttcgattataattatcatccaaatttaaatttttcaacttttaaatttagaggtgattttggaaaaaaaattcaccgtagtttatttttcagtcagtacgtttataacgttaagaata

SEQ ID NO: 735 - DNA, 1501 bp, Oryza sativa
tttgcgcatgctcgcggacgcgcttagtgtcacgattaattatatatatgttcatcactttctatagtaaaacaataaatgggtatttgagttgaaaatttcaaagtttgagtagagttcttaaattttttgttgaaaaaggttgtattacaatgtttcactgaaatttaaaagataatcataaaatgacagcgaaatcataccaaaaaaatttcaaaactatcccaataaactttcaaatataaattttagataacttcaatatattctaaatcacttataatagagaaaaaaaataaagaaacattcgtttcatacatttgtatggcatgtaattaatccccaacagttggcgacgagaacggatgatcgaacgaggggcaacagtgatgatagagctagaggagagagaggtggacggcaatcggcactatgatgagcgaagtttggcgaggaggacaacgacgaccagcggcaatgagaaggacaaaatgcggtgcaatgcgtgaatgaacagtgaagggatgcaccgatttggttagtcaagaaaacatctgcaaatatatactccctccgtcccaaaatatttgacgtcgttgacttttttaaaaatgtttgaccgttcgtcttattaaaaaaatttaggtaattattaattcttttcctatcatttgatttattgttaaatatacttttatgtatgcatatagttttacacatttcataaaaatttttaaataagacgaacggtcgaatatgtttaaaaaagtcaatggcttcaaacatttaggaaaaaagagagtatatataaacaagtgcttaataaaatacagttactactcaacaaatgcccaggatgattggttagtcaagtctagtccagtttctagcctatgctggtcaagaaaaacaaataacctgtactccctgcctgcgtctagatggaataatgtcatcatatgagtcctgtaattagataaaataatgacgagatcagtcaagttaaacaccaaaccccaagaaagttcggtgtatgtacgtgtgtcgtacgttgacttggtctaccccgccccatactgcaagcatgcacaattattgcacacatgcataagaaactttttttttatctctcgaggatgtctcttagatatttacatatcacttaaataattataaaaaattaagaatatatattaacatgcgatatatcactatataaatatacaagttcaaatttaacttctacatctcgtaataaaaaaaaccaaattaaactacaactagttaacgtatatttataattaaatttgttttttcgttgcaagatgtataagttaattaaatttaaatttgtatatttgtggaatgatatatcacataataatatatcttcttaatttttttattactattcaaacgacttgcaaacactactctcgaggatcaaaatccactccccacatgcacctgcatctactgccagagaagagacgacgtcgag

SEQ ID NO: 736 - DNA, 1501 bp, Oryza sativa
aaccaggtttcgtacacacatggtgtacgtattgtagtatatcttctcaaattgcaaagtttaaggtcagcttagtagcggagccaccacccgagctcgacatttatgaattggtgataaaatttctataacaaatactactaattatattgaagtttgttcggcccaaaaaaaattctagctttgtcattgggtcaacagggttcacaatttcgataaaaactggtcgaatttcgtgaaatttcaatgttttgacacggcttgggattaagtttcgattggaatttcgaaggttaaacaatagatttgatcaaaattaagtcaaaatttatcgaaaaccgtgataatgataggactcgaaatttagtggtcaaccggtaatgtaaactctggggtcaactaaacaattaaacttgaaagacactggctggtccaagttaaagctagagtagctggcgatcccgtgagtttgcatgctcctccagccatgatccccgatccatagcaaggctagctaccaatctaatctacgagaaggaaggtgatggagagcaacgacaacgaacgaacaaagaaacagcagcacgcgtgcatggcccaacccatggcagccaccgtctcgatcgatctctgcctgccttgtgggacctcctggtcaaacaccaaagctcgacaccttcatcatcatgatttcgtgtcccagcaatgcaatgccatgcaatgcaaggagatgttttgaatcttaattttgcggttctgcttttaaaagggcataccctacattgaaatgttcgaaattataaaagggcatactctattgagagttcaagcagtacttttatatactgcacgtcttccgtgcatcaagtgtaaacaaatactccctgtcccatggaaaataaatttaaaaccgaatagaatatattctaatactacgaatctggaatctgaacatatgtatatccaaattcatagtagtaagatgtataacatctggtattaggttaattttttatgggacaactacagagagagtaagattgagtttggaaggagggattagcatattcttagttaaatgttagattaaaaaactagaaaaatatattaatataatttataaagcaaactctaaatatttttaaaaatatatataccgtttagtgattcagaaaacgagggtgtatgagttcagaaggaataaagaacacaacataaatgttcgtagcagatatacacgtgtcagatattttccaaatgaaacattatacacatgtgttcagcggttatactacttaacttgctaatggattattacggggtgtgcttcaaaatctcataaacgatgcaggtttgtgtaaagaataacaacgttggagttttttttttcaaagaacttttaaacatttttaatcaatttcccgattgtatcgatccgtttcccccctaaagtagaacaaaatttactagtatatcgtttctgcccttttcgttcctagct

SEQ ID NO: 737 - DNA, 1501 bp, Oryza sativa
agagccactcctctcaacaaatcctcacacatcgtatattttttgtttgatatacgacggacaagcgttcaatttcagtttctttctctggctctctaaattactggtcaattgatccacaagagtagggattgtagtactctttggtgaatctgtcaggctggttctcgattggttggtgagactaccatttccctctgatctatgaactcctttattttgagtaccacttgcatcatagtgcattgttagtgttcgaaaattctctctctcccccaaattttcaacaaagtcttagttagtaccaacctcttggcttctctttgccccgctaattgatcaatatgttgtattgggcttgtcctaattctctctcaggaacaaacaatgttcctagtatttttttggaaaaaactactgtcttggcgcattcgtccaaccacactacagattgaattggctggccatcctttgtgcaatattttatcttccgcaaatatctttgcttgaagcatgagcattactgtggtgaagcattagcattagcattagcctttactctccaaatcggactaaggggctggggatgcaaccctgaaactgtatccagtatgaagatttcgctacaaggctattaatgtagaatggacagttggaccttctttgtttcactcattctacaaaaaacaatgtagggtcgatatgatattaatggatctaagcgtcttaacaccattacaattttggaaaaaaaaagggaattgccatactattaaaattttctgttactgaaaagtttagaaaaagaaaatagaaataccaaataacagggtacccaacttgcattagaaactgtctcatctattaactgagcaaaaaaaaaagcgaaaacactaaaactatataacttttgaatattttgtcttaatcctccaaatacgtgtggtcaatcttgtatcttttgaagtatttgccatactagaaatatgatatgagatacattgattcaaacttcttctgggaacacctattgagagggttggaagttgtacactcattgttacggtaatttacttttatacttttctgtaggaaatgctctttctgcctaacccaaaagtgaacgacactgttcaaaactaaaaattggtttgcaagcacgtagtactaactaaccatactgcgtttttcagtcgtctcctggctcatgctttaagttgtgtgcaattcaattattagaaatgcattgaggtactacttgcaacagacttattcttttgttaactattatattatttttaaacaattacagggacttgggccaagttcaatggtcactaaggccgctctatatataccatatttgaattatttgttgtgcttattgttaagaatgaatttcatagctacattgatgatatttagtgtgtaatgttcttgaacagataaataagaacgcttcaaggtggaagcagcaatgctggtacaagttatcttgaca

SEQ ID NO: 738 - DNA, 1501 bp, Oryza sativa
ccaaagaggagggacgaaaaatagacttattttaaaaaaggcccgatgggccacccatgccttcggaccggcacggcacggcccgacagctggtgggccgtgcctggacgggaggtgcagcccatcggccggcacggcctggcacgaagtgcctatcgggtcatgccggcccgatgactgctgggccgtgcccagccatgcctgggccgggccgtgctgggcgggccctttggccatatatagagttggccattcctaaatcccctgtctccgccggttcagccactagctgcgcgggcgcagtcgtggccccgtgtctccggtgccgtcacgccatggttggcacttggaagccttatgccctttatattgcccacgaaggcccaaatatccaatccctgtcaaccagcagaagcccgaagcccatgttttcaggtagaaatggaacaagttcaccaccaagtttgtttgacatcccttattctaaatattagaaaccttcatcccctaaactatacataactgtacaatttagatccatagcagtttgtatgcccggtttcgctggcatggcattctattcagcaaagttaaaataaaaaaaatatgtggggcccgcgccaccaacatctttctctcctttcttcccaagcaaccgccccgagggggggggggtgaggggcaccgggaggagaggaggccggcgagcctaggagggagagggcgagagaagcggccggaggaggtatggacagtgccggacgactgctcgacggactgcaggaacctgagcaccttcttccagctgccgctgcacctctccaggagctccccgcgcgtggcgggccagggcccatggccgcgagtgccgcacgtgcgacgcatagtcttgacacggcgtgctcggcgagcgggcagagcacgagacatgtggcctcaagcctcgcgaggttcccggcggcgaggcggccggaggtcaggacctccccgataaggtggctgggtagctcctccatcgaaaagcttgcggcgccttctccctcatcgccatggatccacccctccttctgcgatccccgcctccacgcgatgaaatcttggcggtcttggccatggacgacgacccgccaccgtcgaagatgccggtgatgaccgggtgactaggtgacccggcgagcagcgccatcaccatggatagccctgcggccgtcggtcccgtcctcctcggttgccgccaccgtctggcacgatcatcccaggctatttctcgatggctgggtactccagaggacaccgtcttggggtcacaggtaggcgctcgttgctgcccaactgcagggagccccggctcgccacgctccgaccatgcctccacatcgccaccgcagcgttcgatttcggccgcaccgccctcgacaggaataagttcacctactgtcgtgagccttccttctttagttatcataggtgtgaacactagagagggggaagaagaggccag

SEQ ID NO: 739 - DNA, 1501 bp, Oryza sativa
attgtggctgctgcttacggttgtagaagtatatataagagcaatgggaaaacttgagaagactttgcttgcttgtcataataacaaagacaaacgactagcagacctcccaacaaggcggtcttaattcatttgctccaccatattatattactacggccctagattaaaactcttcaatataatactagtatttcgcatgataatatatagatgtggcacggatcgttatgtcgctacaaaaaagcttcgaatctgcacgcatgtggcttcgtatctccagttctccaccccctgcatggtaacagtctagtgatattaaagggcaagaacagttgaacctactaacatatatatactcgctctggcactgaaaaaaccaacttctgggacgtgtttgaacaagtactttttatcccagattcattattgaaagttgatttttgggacaaagaatgaataagtgatcagaataacgacataagatgaaaagaagtggagaagaaattaagttaaggaacgatgaaaattaattatagaattaatatttgcactaactatatatttaagttaaggttgtatttttccttgacggtaaaatgtatttttctgatggtttcacgctcatatatatacactagtacaatagctatttttctgtgcggtcgaatcggtttttgcgtgcggttgcttcacccgtctagaattaagggtctgcgaaaatcgtgatttttttttgcgggtgacgcatacgcacgggaaaataaaaaatcgaaacaaaaaaaaagaaaatcaaaaccaaaaccataaccctaatccaccgccgccgctgccctagccgaggtccgtcgccgtcgcccgcgcggtcgccggcgacggatccagacgctggaagaccgctgccgtcaccgccgccgtcgtcgcccgctcccgacgttggatccgtcgcccactcctatcaccgacgccggatccgccacccccatgcctcctcactgctgccgatgccaccctcccctccggccgttgtccccgtggtcgccggctgaagacgcccctcccctccgccggatctccaaggggagggaggggagggggaggagagccaaagggagagggaggagaggggccacgcgccgccgctgtctccgctggatccgccgcccccatgactccccaccgccgacaacgccaacctcccctccgggcgtcgtccccgtggttgccagccgaagacacccctcctctctaccggatctatcaaatcattattttatatcaaaattttcaaaacacgttgtttaatataaatgttacgcaataatattctctaccagtaaattccaatttatgatctatattaactaattttttacattaattactgaacccactattttatactatttttaataaaaatattttgatatcggttttcgcttaaactgatggacctattaactagacctattaaggacctattaacacgcatgccatatct

SEQ ID NO: 740 - DNA, 1501 bp, Oryza sativa
tccctatatatataaagtagaagttaactaaactgctaattagtttccgtttccaccatcaattgatacataggaaaagtgctggcttgttcttgggcactcgatcacaagagaaaaattgggcgtcccatggctacaggcagtgcccctctttcactgtgaatagcctgcacacgccagcccctctctctctcctatgcatgcatgcatgtgtgtgtatcgctctaacgagtttcaaatattttcccttaaattagttattatctcacatatgatccaattacacccatatttattaaattactagaaaaaatatccatgcgttgcaacgggaaaataccttaaatcacttagatccgtactttcctttctcaaaacttcggcaaactcaatttgaaaatttgaaagcgaattcaactttcccttttgaattactttcttcttttactagtctccccttgtttaaaattcgtttaaattctcgtatatcaaaattcactaaagatacaaaagtccatataatcacacgttgtgaccgatgatggatgaaaaacggaagcccattaagatttttctacaaagtaggtggtgaagatattccaggagaaaaacaagataaaaagaggagaaaagagaggagattgaaaggagagggagataatcaagattatcggcacaaaagaaaagaagaaaaagaaaacgaaaaaaaggaagagaaaaaaacaagctgattaggggaggggtgtgcgtggcgcccaagtgtaggagcgcgagatggacggtgggatggtgttgggttggttgggttagactgggagagagagggattgggatgggatggtggtgtttaatagttattctagactcacgtgcgtggaattggatatgggtgacatataactagcttaaaaccaacttaaacacggatgaagcaccaaagtttcggctgaaacatcttcaatttttatatagtagagactagaaaattaaaggtgtccgtgcgttgcaacgggaaaaactaatgttatgataataattatagttattttatagtttcatgggaattaggatatggcatattcatggacataaataatgaattaaatctatacctaattctatatcatgacaaagaaataattacatttttgttgactccatttagctagaaataatttaatatgaagaatgaaaacatatttcaaatttaagtaatttttaatggctaaaaatagtgcttgaactaagtttgttaacggaaaaatagtttaaatcggttgaaaataaataaaacacaattagtctcataattagaaggatgttgtgaccggcctgttaagtgcactgggcccatgtgacaggtcatggcacaagtcgacataggtgcgctgagagtcgttggattcgatagaacggttaggaacttaggatcactcgtgatttagataaacattgcctgttaaaaccctaaccttaaattcattcctcctctctcccaccg

SEQ ID NO: 741 - DNA, 1501 bp, Oryza sativa
acttttaataatatctaaaatacaaaaaataattttacagaatagcatgaaaagtatgaaacgaactatttaggtttttcacataaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctacggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccattttaattatatgaaatgaactgtagcataagcagtattcatttggattattttttttattagctctcaccccttcattattctgagctgaaagtctggtatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttca

SEQ ID NO: 742 - DNA, 1501 bp, Oryza sativa
cgaggacggcgccggtgccggtgttgaggaggcggttgcggaacggcgccgccgccgggggggtctcctccagcatgatccacgacctggggaggtacttggggcggaggccgtcgccgacacgtgggtcctcggtgtgctgcctccaggggctgcacacggcgcggaagcggatgtagtccgtgacgtcgttggccagtaggcgctcggcgatcagcatcaccaagcaccccgtcagggttgaccagtcgctcctacaacattaattgtgaggaaaaagtgcgtacaccataaataaaaaaaagatgcagatacaacaaaaacaggtagaccataaataaaaagatgtggatacaacaaaaaggggtaaacctataaataaaaaagatgtagatacaacaaaaaaaaaaaagggtaaaccataagtattaaacatgtaaacacctatctactaagaaattacctaaggaaaagtggttaaaccataaataatcaaatatgtaaacacatatctacgaaggaatcatctaagaaaaagtgggtaaaccactaagtatgtaaacacctatctacgaagaaattacttaagcaaaagtgggtaaaccataaatattaaatatgtaaacacttatctacgaaaaagatacctaaggaaaagtggttaaaccataaacaccaagtatgcaaacacatatctacgaaggcattacctaaagaaaagtgggtaaaccataaataccaaatatgtaaacacctatctacgaaagaattatatatgaaaaaagggtaaaacataaaaccaagtatgtaaacacctatctatgaaggtgttgtctaagaaatccatctaacaaagaatcgcatccatctaaaaatggaattgtctaaaaaaatccatctaaaaagaagtcacccgtgaatctatccaaaaatgaatcatctagagttcatctaaagaagaaatcattggaaaatacatctcgaaaaggaatataataaaatagatctaaaagaagcacctaaaagttgaagaacttaccccatccgaagcgtttcaagaggatcttcgcgactctaagacatatttgacgagctgagcctatggcaaaggaaggagctcgacaaaacctagagccttggcggcggctgtgaagaatggttgagggcgaagagggagggggattatttatggtatagagaggagcgggtaggtagtagagatagggtatagaggatggagcgcgtgacggttcactttgggctgagacccctgtaggataggaggccgattagaggggttgactaggcggttttaaaacttttggctaaaaccgagttttgtatgcggaagcgtaaatcaaaacggttttgcacaattcaaaatctaaatcaactaatctcaagcaagtgcactaagaagctagcctatgttgagatttgcaagcctagggtgataatagcgcaaataaactctagtatgtaaacttgctcaaagtaaatt

SEQ ID NO: 743 - DNA, 1501 bp, Oryza sativa
cgagaaactccatggcccaaaaaagcccatcatcaactaaatcagacccaaaagcttcatctagaggtcactgggctggagccgccgccacacacgtgagtctcctaccctccttcctcctccggtcgtagcggcggcgcccagcggccgcgccaccgcgtcgtccccccgccagctgcggcgcctcgcctggtccaccggcggaggggccgtgcggcgccccgcctctttcgcccgcggagaccggggaaagcgcagttccgttgctatcagcggccttcgcctctgccctgagtaggcggcggaaagcgcggtggctaaggactccaactgcagcggcgtgttccagaagtatcgcggaaactgacgccttcttccgggagcaactgagcaaagggtaactttttttttgttttttttgtttttagtgagcaaagggtaactgaaatcatgactcctaattcagcttgactgctttcaattctcgagtagttgtgacatctagcgtgattatggctttcctacatcttgttttggtttgtttgtttggtagtagtagaagccaagagcatcgtaaagatagaagcgagatttggggaaacttactgttctgtaaagctggagaaacgtaggttttatcttcctttttttttatttcctttttgggcatttcaatccttagaatatcatactaattgaaggtttagaggtatgatgaagacttaattaatgctatgctttagtgatcatggtgttcttttaaataataagtgttgatcctagcttatattgaaagctaatagtaatagcctaatatagggtatttctaccaaaaaaatgtgatcgtgctgcttaggaaacttaggagctggaagttttgaatattactagaatatagtgtatccttattcctgaatcctgaaggttagctaccactttgtttgaatagctaccaccttgtttatcttctgtccaaccttggcgttaatccaacacaactacgcaagggatttatgatggttcgaatgagttgtgtagtgcttatttttgtgtgaggttgtatgactctgcttgttgaagtcataacatttgacatcatacagtttggctcgcactgcattcaatagtcaatataacctttttcaaaagaaaaagtcaatagtaatggtgacatcctaatttctcttacttgatgaagtggaacatgacgttaatgttagatatacccataaaaaaattgtaaagtttcaaacgtctagagtacgtagtttagtgaatcatcatttttttgttttgctttgtttgacgtgcaacacatttttgttcataactcagcagaagttctgtttgcacttttccatctctcgtttctttgatattaatatttttgtcttgttgcatttaggtatgcatacattttcttactgagcaaccttttggaatccctctctaaggaactgtttactgcaacatctttaggttcttattaataccatggatc

SEQ ID NO: 744 - DNA, 1501 bp, Oryza sativa
tcaaggtgttgaaagttgtagagatagcccctctaactccaagactccaagagtatattagccaagtcttaaaaggttcgtattcctaaatatgttaattcttgcgtaaaatacaatctatattatcgtacaaacaataatattgtgccttacagttataaatataataatgtatagttttgtcgcccaattgtgacaaagaaggaattctgtcttaaaattttcagtaaaaacaaaacaatgaaaaaaaaaatcttatgctgccgctgaattgagctcttcaactatgactacgtaatgagctgcagtaaaatataacagtggcaaaaaacaaaacattatcacctttgccggttgcaattgcataatcagtatcctccttttttctcttttctcgattgcgcccgccctgccaaagtgccaagtgcgaaggttttactactagcggttggcacacaggatgacgcgtagtacgtctccggtcatatccaactcctccgtcacgagcttacaccccccaaatccccaatacctcaacatccctctcgccagttgaccaagacatttttccagcaactgatgtcatgacaacatcaggtgaagccacgaggatatcatcggtagcctggccccaaggcaacaaagacttgagccgcatgcagtgtcgacggcacagaaatctgccgcttcttctgccgcgttgcgcccaagcagcactgcagcagcagccgtgttcgcctgcaggtgagctcacacgcgggcgccgtacgtggagcgagtcgcaccgtttctgcggcagtcagcgccgagacctcgcggagacgcggacgcgcgtctgaaaaccgccaatctcccgccgcccctgccgacctcagcgcggcctgtggatttgggaggaaaataatgggcgcagcacgacgatttcggccgctttctgcctccgcccccgcccccacacacaccgaccgcgatcagcggcgacgtccctatcgcactactagtacgtactcctgcgtggcatagcgccgtagccattgtttcggcctgctagctgctgtcatcgcctgatcggtcgccgtgtccacgaaggattgaggttaaatgcacggtctttttatcaaaaaatccagtgactttggccgtatttagttgttttgataaaaaaaattgacgtgtactggtaagtatttgaagtattaaacgtaaactaatagcaaaataaattatagattctgtctataaattgcgagacgaatctattacggaaaagtatctagaacttcttccgctggcccttgcctaaatccgctatatatttgacacggatttgccgtaatgctggaactatggcgaatgcatctatcgtcattaatgcataaataaatataccaattagtagtgattgaattccttctatggttatacatgagaaaccagtacgaatataacctacatgtccaatcgaactatgagctagaggttttttgactttcgtttgagc

SEQ ID NO: 745 - DNA, 1501 bp, Oryza sativa
cataaatcccttgcgtagttgtgttggattaacgccaaggttggacagaagataaacaaggtggtagctattcaaacaaagtggtagctaaccttcaggattcaggaataaggatacactatattctagtaatattcaaaacttccagctcctaagtttcctaagcagcacgatcacatttttttggtagaaataccctatattaggctattactattagctttcaatataagctaggatcaacacttattatttaaaagaacaccatgatcactaaagcatagcattaattaagtcttcatcatacctctaaaccttcaattagtatgatattctaaggattgaaatgcccaaaaaggaaataaaaaaaaaggaagataaaacctacgtttctccagctttacagaacagtaagtttccccaaatctcgcttctatctttacgatgctcttggcttctactactaccaaacaaacaaaccaaaacaagatgtaggaaagccataatcacgctagatgtcacaactactcgagaattgaaagcagtcaagctgaattaggagtcatgatttcagttaccctttgctcactaaaaacaaaaaaaacaaaaaaaaagttaccctttgctcagttgctcccggaagaaggcgtcagtttccgcgatacttctggaacacgccgctgcagttggagtccttagccaccgcgctttccgccgcctactcagggcagaggcgaaggccgctgatagcaacggaactgcgctttccccggtctccgcgggcgaaagaggcggggcgccgcacggcccctccgccggtggaccaggcgaggcgccgcagctggcggggggacgacgcggtggcgcggccgctgggcgccgccgctacgaccggaggaggaaggagggtaggagactcacgtgtgtggcggcggctccagcccagtgacctctagatgaagcttttgggtctgatttagttgatgatgggcttttttgggccatggagtttctcgacgtcagccttgtagaagttgataaatgggctaaagcccatatagatttggtggttgggctgcaatcacggttcgcgcgactcgagctctcgaatggccttcgtcttcgtcttctccggttctctttcccttccccatcctcctccccattgcgctgggtaggattccaatgtgggggactagggtttagggtttggagtcaatcccagaccgcgcccatgacgtcctcgtctcgagtaagttgcgttctgtattatcttcctctctctctctctctctctctctccgcgcgtgcgattttttttgggggtgtggttttggcgatgatatgcgcgtgcgattttttctccccgggtgggtttggggatgggaggcgtgattagaatcagcgaatcgcttcagtgcattgcgctgtattctgatcagtgtttttccataggagatttaagattttgttgttgagctgatgtgtgaaaactggtgta

SEQ ID NO: 746 - DNA, 1501 bp, Oryza sativa
cgtttccggcgctccgccggcggctggtgcttctccgagaacggcgtcgtcctcgacgacggcacccacgtcgacgccgacctcgtcttcctcgccaccggcttcgagggcaaggacaagctccgctccgtcctccccgagcccttccgcggcctcgtcgtcaacaaatcctccatgatgcccctctaccggtacccacatgttaaccaaccaattacaccgcagacgcacacgcacaattagctaatggatgagtgttttttttttgtgtgtgtagggggacgatacatccgctgataccgaacatggcgttcgtggggtacgtggagagcgtgtcgaacctgcacacgtcggagctgaggtgcaggtggctggcggggctgctgggggggaggttcgcgctgccggcggtggaggagatggtgaggcacgtcgacggcgagacggaggcgatgcggcggacgacgcggttctaccgccgccactgcatctccacctacagcatccacgacagcgacgccatgtgcgccgacctcggctcccgcgtccaccgcaagtccaacttcctcgccgagctcttcgccccctacaacaaccaggactacaaggaagagtagccaatcctggccgtccatccttcccgtacaccgaatcaagataccgttaattcagtcgtataaaatgatataataagattcgttatttgtttataaaagtaattaagttaattgattattaagggctgattaattaattgttagttaataataatggaggactagcttaggtcgtgttcatgtgtcatgtgaactggggaattgatttggtgaggactcgaactacgatctggtctcggccgcgaccgggagaggaatcaaatcatatccaagaacgggaccatgtaagttaggtccgtatgtacgatctgtacgatcgatgtgtgcatgatcaaaggtggtttttccaaacctcttaatttgtaatcattcttttttgtctgatgatgaaattcaataaaattcatttattgtctgaaatcgtatccgcctgtttcgatcgcttctgtacgtgtgaatttcatggatcagccatatactgttctgttttatatttcttacattggttaaattcaaggataaatttattagtttgttcaatatttatgaatgatctgggagtatgattggtttttaatcaaatgcaaatggcaaccaacagccaagaaaacaattcatggcattttgaacttttccacgggtcaagtcaatagcttctaagatgcatatatgatacctaaaatacaaaccaaccaagtcaaaatggtcaaacagtcgatactatgtatacaaactactagagtagcacttaactaagagttgaccacaataatgctagcttcaattagtcggtacttggtagttatatgtttttttttccttctgtaaatattttatagttctctccctttcgggttgttgcaccatagtcagatgttaaggaa

SEQ ID NO: 747 - DNA, 1501 bp, Oryza sativa
tgcttctcaatcagcgttgtaagtagccatgctctgcggctgcaacctgtcaggtcgtcatcggctgcaagatgggtttttcctttaccaaagtgagaaaaacgccatggttatcctatccatccactttgcaggaagcgataacggtgaacgctacaatgtttatccactggaatccgctggccgctgggccggtccggcaggcaaaagcccaagcgcgaaaccgcaaggtgcaagcccgcgacacgcgcgcgacaagggccgcaaccgcgatgagacgttggtttggaacaagttcactttaggtccctcttcttaaagtcgtcgagttcgaatttcatcgttgaaccacaatatcagatatgaagaattcctcaaccaataaaaccagtataccaaaaatctcaagatagtatgctccccgggtttggttaatgtggtaaataggacccacatgagccctacaaagcgggttggcttggttgaggaggcggcgacaagggctgaagtggagggcagtggtggtggaggcaaggtggtggaagggggcgattgttgtggcttgggcatcacgccgatggcatgagctagcagcattgcccccttcccctctgtgatgtgggcgggcatgctcagcgagtggcgggcagggggagatgggtggcaagctgtgggcaccggggagacgtgaggtgcagacgcaagcatgggagctcgttcagctgcctgcccttacaatctgctgcacccaccgcctctcttcaagtcggtgaccgtctttctccttgccgcgcgccttcccgtcaactgtcgctcctaccccctccccctggttggtcgccgccttactccacgacgccacaaccaccctaccaatccacgaccaacactcccttcctcctctagctgctccttccttgccgtagcatgtcgctccccacttccccagtcaccaccctcgttgtcgccttctttctccctgccctcttcaggtatggcaaggacgtccacaccctcgttgagtactccatcgatgactacctctaccccaacattgatttctataccttcctcaccaagcaaggcacatttgcattccttccttctaaatcaacatctttgcattttctttagattgatttgctcacaaattgaatcgagcagctttgatgcgcggttgttcatggggacgatgcgggggaagcgaatgatgttcgtgggggaactcgcggcgtcaatggtgggtggatccggagagacacaggggaaaagaagggtagtgattttttttatgacatgtgtgtcccatactaaatcagtcgggttgaccgaagtcagctcgtcacgttagctaaaacatgagagtataatgtcttggaatctttggtgcaccgatttttataagtcaaaggactcttcatatctgatattatggtttagggatgaaattcgaactctgttaaaataagagatctgaagtgaacttatcccagttggtttt

SEQ ID NO: 748 - DNA, 1501 bp, Oryza sativa
taaagctttgaaaatggagccaatggtgcactacttccatcacactagggtttcatgtggccataggatgtgttggtaaattttgaaagtttgattgtcattgaatgtgacaacaaggaataaatatatttcacatctaaaaataataataggcacttgagttatagaatagaatcagttgttaaccatcacatacttacagcaccagatcacgctacctataacgtggtttttgatgcatatggcttgctaaagcatgtccaacaatttgaggattatttttttttattattaggcacatgcacatgcatgtcattgatttttcctgtgctatctgcataagacatggtggatgaagaaaagaagagagagaatgtatagacatgataataattttgattcagctggcatctttgagttaaagtaggtagatttaggaagggtaaattctatttttgccctgaactttgttcgaactaaaaagtctatcatttacttttaactacaaaactagttattttttcaatctcaattttcaaaacaagacaaaaataacaccataaaccatatttcaaggtggctttgataagaaatattggtgtgtgtacatgtgttttttttttttgcaaacatgaaattcaaataggtaaattttatggttgtcgacctaattgatatctacacgggtaaaatatgtataataagaatataaactaagaaatccaccttcatttcatccaaagccacaaaaaatgatataaggtgttacaaacggttccattgtttagggtaaaaattaaacctcgaggagttcaggaacaaaaaatggactttacccatttagcaaaaatctgatatacaagatatttatatagtcagacagtcagcctccgtttatcctttatccttgtaatctaagacgactatttagacgatatgcaataacaagaaagcattcccttgagagattaaaatccatttcccggtcgatcgaagtgcttgcactatgggatatataataattcagtaggttttggaacggggcgctgtcaaatgtgattctcaatttgccaatttgcttaagttgtttggtgaaatttccgaacaatggaaacaagaacaattaaggattactgatgggactgctcatttataccatatttttctccttaattgcatgaatcgtacatgattgtaatacacgaccctatccatgactccatgtgcctgtggttgccttgctggaatcaggtagctaaaaacttggtgaaggaggcaaaaaaaaaaagaaactctacagtgaaagtcaaagcctcgtccaattgcatccagcttcgagcaggcacttggacaaaacttataaatagctctgccaagcatgacagagcatattcatcgagagatcgaattcggttctcgtctcgatcatcagtttggcctgtcgatctctgtccatctctgacgacgccgacggccatgcagcagctgctcgcgatgaagc

SEQ ID NO: 749 - DNA, 1501 bp, Oryza sativa; identical to SEQ ID NO: 743

SEQ ID NO: 750 - DNA, 1501 bp, Oryza sativa
gttgatttggtggtgacaagttcaagtccatgcctgatgctgtgagttcctcacttcctgtgcccatgttccaaaccgttacatatgcatttctcacttgatgtcctattgtttgaaacttgctgccttttagaacctccttagttgtctcaatgcttttacttttattactgccatgttaatgatcttgtggctgagtccttctgttttcatggagtgcattgcattaaaaaagatcccgtagatttttcttcatttgttaattatattgccaaaacgtgccttgcacgcgcacgataacatagtcagcttagtagaaagactgcatttttttcaatatttgcaatctggtttattttgagacatggtttgggcttgattattatctcattcttttgctgtactgaaattggttttggatttaattgtggactatgtctgtgtcactacaacatcaggtattggttataattcagctagaggaaagtagagtactttgaagtgtttgaatggttttcacatgtatactctgctagctaccctttagtaagtatattcatgtaaaggggagtaatagatcattgcactaatgttcaaactctattgagattgtcccaggtgtcactttgttcactgaaaaaaaaagagaacatttataggttttttttgctgcttgggagaggatgctgccgaattgaattaagacagccttcagaatctggtatatctaatggtctgtaaaattttacacaagcaacaggagggaccatcaaggtgagtgattatcttatccattcactggcagcgtacattgtcttatatgatgagaatagagttgaaatgtatttgagttcttatttcagtgcttcgtggtcgtcatttgctatgtaaacaattactaaactaataaaacacttaaatgttgcctgtcaattagatttttttaatatgtattaagattagtacgcagcccacacttttgctttctgtggtaggccaagtccatatccttattaggattaggaggaaaactgatgctccatgtgcccaaaatgtgtgtgaactgtacaagttagataataatagatggttggttagctagatccaaaacttgagctttactatggcttggtgccctgttatacaagacgtatatggataatgttttcagtattctgctttgtttgctatcagtatttttagtgcagaaatgcctcaagccactgtataatttgtatatatagtgcaacttggcagttaacaatttcctctttcatgtgattaattttcctgttacaaatttgcttccatatattcgtatccagaatttacttagcctaaagatatcagaaggagaacatatttatggagtgccgatataaatcggtaacccaacattcatgagcaagtaattatcgtgttataaattttatgccacattccagagttttataaccttaaattttatcttattacacacaccggaatcagttttatgagt

SEQ ID NO: 751 - DNA, 1501 bp, Oryza sativa
aacccaacattcatgagcaagtaattatcgtgttataaattttatgccacattccagagttttataaccttaaattttatcttattacacacaccggaatcagttttatgagtcacaattcatgccaattgattaggtagattttaagaattaaggatttaaaaaataatgctttaagatgatagaaagagaacatatgctaggtaacccagcattgatataaactgacaacatgctgctgctgagaatatgtgtaacaatgccaaaatctcacatcatattatgtgtaacagggaatgtttcacatgtgatggattttgtatagaaaaaggagattcattgtttgctgaaggtgtattgaaagttgcttgccgataaataaagaccccatggatagatgcaatgatgcattaagctcttgaaggaggattaacggaaaactatgtcgagtttttagtagccttgtttgggctaacgacactcggtttattgttctagatctctgacctaagaatcctgttttagttttttttagatctcttgctttgggtgttgtttgctctaggtgttctgttgtccgcagtttcaggtgctttgtagtgtagtttagtttgggggtgttctcaaggtgttgtacagtgaattggtttcggtgcttgccctttgttgcgttggtgttgtttatgttctctatatcgatgaaagatgttaaagcttttgcctttgtttcgaaaaagattgaaaccacatacaaataaatggttgtgtgaaatgtaacattcatggatgcaaaatttaccactaagttatcaaatccagaatcatggcatgtactaaaatgattaatattatttataaaatcataaaaatgcttcacctgtaagatggcatgttaaaattaacaattgtagataatacagagtatgttttgtacaatttatattggtatatacgtgcattacatgtgcaagattactagtacatttaatatatttatttaatgtatttgtattagcttgcaatagcctcaggcctcagcccttagtaaccgactcgaacccaaaccgactatcgttccttccggctgacttaacaggaaaaggtgcaagagaacttctattggccgttcgacacgcgaaaaccaacccaatggtggcggccaaggtgtcgacccctgccggcggcgcggtgcgcgacgggctccggcggctcacgcagctctcgctcgtctccaaggtctgctcggagctggaggcgcacctcggcgtcggcgaccgcgtcctcgcggagttcatcgtcgacctgggccgcgcatccccttccgtcgcagacttcgacgccaagctcaaggcccacggcgctgacctgccggactacctcgcgcgcaccctccacaccgtcatccacgccatccctacccacgccgacgacgcccccgcccccgccccccaaaaccctgcctcccgtggcaccggtgcaagggtttgcgggaaggacaagg

SEQ ID NO: 752 - DNA, 1501 bp, Oryza sativa
ataggccaaacagagaacatccgatcagttacttcatgttgttggatatttttgagctgcgggtctgcagcgcgcgtatacaacagggtgaatgccagatcagtttgccttggtgctgttcttgatccactccaggtacttggtgttaccaccagttatgggaagagcgataacttcaggaacactgcatgaacaagttaccagtaaatctgacaggaacatttttctcccgggccggccgaaagaataggccaaccaaattacattaagatttcagggagaaaagttacaagtaaactatagtaaacagacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttgtttcagtccaaagtaaggtaagcaaagctttaaaagggtttgttcccacatatgatggattttcttgatctaattcgtttacactgccacctctactaaaccttttcagtgtttccattaaattttttgaaggtaataaagatgttttctatggaatacagagggccaataacactgacatatgatctgggttcataggcatatagtgtcagagaaacggaagtgatgagcaaagtgacaaaccaggcactatattgacacaagcagctagtttctcactgatgatgctctgtgacagcttcttccctgcagtagatgtgaaacatgatgcttttaaagactgcttaaacaaaaggcagaaatagatgctaaaattaattaacaaaaaaataaacgctaaacaacaatattgaaaggagaaacatgatgctcacaagacaaatagtgcaagatcaatctcaactctaactgctttatcttggaggaaatgaaatatattgcctagcaagttccacaaatgaaatgcgcacacaatataacaagaacaaaaacacagtaaagtactacctgcttccctgtttggaacagtcacatacacaacaatggatggcacggtggtggaagcggactccatccgagcagagctgagacctcttaccctgagaaattttgcattcagatatcactacaagaagatagaattcaa

SEQ ID NO: 753 - DNA, 1501 bp, Oryza sativa
aacctaaagaaatttaactggtatatataaaagccaaacgacttataatatgaaacgggggagtagaaatttaactggaatgatcttttttttttcaagtcaatagatcacacttttagaacaccatgttggtcaccattcacggctgcaggcagggcatgcattgcatggaccagcaaaataatatcttcccacttgggttgaatcagtgcagtgtacgcatatgcatgcatgagtctacaaatatcttgccacttggacagaagattagttcgtgtaggccacgcatctatccatccgtagttaattatcatgtttgagctggcctcttgagtgtgccgatatagatctctggtctatgtgaatctaatgagaggttgagaaagagagtaggtttgaaggaagggagctctgctcctatgattatccattcaagtgcttggtgtgaaagaggtgctcttctatgagctgatcacttcactgtaactcaattggggaataagatggcattgtattaaaaaataaatcaagacatatttctttgcctcaacggcgaagccgggatttagacatgagaagggactactccatccgtctcaaaaaaaaaacctagaactggataatatacattataatacaacgaatctggacacattatagtactatattggttttttatggaacggaggagacctaatacaccattatttaggttaattaattaattagttagataactatgtcaaaaaaatttgttggaggggacagaccactccgcaattgtttgcctgttagtatattactagaagaggtaaaaaaaagtcatcatactatttgttatgaaggtttaatgtcaccattgtaatttttattttaaattctagctcgtccagaattgcattataaaaaaccaccagtttatctttgtatcaaataaaacaaaatgtcatatgcgctcgagaggagaaagggtgatactgtgagaggaatatgtagtgcaggtgcatttggtgtgtgttgggctgatgagttggccgagtgggggcatcatattttgtttagtggaagctcatctttgaagagtggatctgagctaattatgaggaataaatatataggtgacctaattaaaggcactaacataaaatcagagagtattttatacgctatcaagtttatgacattgaattcgtctctctctccctttatacaataacttaccagattaggcatacaatatgtatgagcggcacttacttgacaacagtcatatattatcgagcaaaacttcgaagttgtgggcataaaaagaacataggcgaaatcagaacatattacacaatcagagcaaacttgacactacataattaatctatatcttttatatagttacagccactaagcatcaaatgatcaacatgcaagtacaataatatagtacatattataacttaaaatacaactatactacatcatttacaaattactaaaatttaaactc

SEQ ID NO: 754 - DNA, 1501 bp, Oryza sativa
tgttgcttcatacgttgtagtaaaatgtttcattgtgtgacttgattctgtttcaccattttcagcactgaaacattttcaattcgatggtgttttattcttattctcgatgtactcggatttgtttcatattttaatatattcgaaatcattgtttcatacgttgtaaaaaaaatgtttcatggtgtaatttgattgtgtttcagcattttaaaagatcgaaacattttcaatctacttggtgaaacatttttttcctcattagtgaaacaacacccgatttttgacaaacaaatcggatgcccgatttgtaggcgcttcacgaaaaattgatcctcgaggctaacaaaattgacaatgcccaactgaaactgctggatgggcccgaccatgatcgagccatttgccacgaaaagaggtagcaaaagcgcgggaaaaccggttttccccgataaaccgcataaaccacctaccctacgcgccccaagagccccaagaggtactcggcctaagactaccctagaatttgacccagagacccagagaagagcaggtattcagttttcttggcctatcaaaaaagcttggcccaacaggcaacaaaaaaaaaaaaaaccctagctggctattctcccagtcccacgccgcaccgcccacacggcgcactcccgcacgcaccgagccaccgacggtccgacgccgcacgccggaggacaccccgcgcggctgccccccggcctgggcctgcccgccttggcgccgccttcccgcggccccgcctcgcgcggcctcccgtggtctcgcccgacgccgccccgccgcgtccggcactccggcctcccgccctctgcgccggccccagcggccctccccctccggactccggactccggtgagcgctagtgaactacctctctggctctccctcagtccggccgtccctctcccccttctatagagttctactagaccagtacttagtaataaatcaatttcttcaataatatctgtgattagccaattaaggagatattgatttgtataaattaccacaaaattgtgtgcaacaatgaacctcatatgacatttttgcatggtatgatggttggagattgaggcatggagaagtcaagcattgcgttacttattcaaaagcatgaagcaaaaaggagttgcatcttgtgatgtaccaatcccacccgtggatttatctaagaccttttgaacaatttacattgtcatttaggtaagattcaatcttatttgttattttctacttgtattgaaccatttacagttatataccgtatcgtttactatttgttattttctacttatttgttattttctacttgtattgaaccatttacagttatataccggcaggctgtgcacgagtgcgtccttcccctttctcgtcctccatcctcgcggcggcggcggcggcggaagcgaaccccgatggcactgagaggcggccacgcggcggcggctgctgggg

SEQ ID NO: 755 - DNA, 1501 bp, Oryza sativa
aggttattgtcacgaatactagtagaagcactagcactgaagaaagagaaaaaaaactgtaccgatcgaatcattaaaatcacgcataattaaatcgttggatgagaaaaattgattaatcaaatcgcaattaggctcgacatagctgcttcaggggggattgatgcaccaacctcaacaaacggatcagatatataaatcaatatatggatcgcctgtatgtggttgtggctgccttgaactggcacgaacctaatttaattagtatgcagattacacatatctgggttaattcactgtgcttgtttaattaatggcagtgtctacttatgtttcaagcttactgcagaaattataaaagagaggagtatccaccagaaggtaggaaaggtggtatgtcgtgcttgaagctactatatatgaattttgattagggcacagccagagctaattaacttgatcaactaagcaaccggagctaattaactgcagtagcaacagatcaacaaaagcaaccagagccaattaactgcagtagcaacagaccaactagattcactatatactgaactgtttttgaacagctgtaataagactgatctagtactatattatgtacctacagtgctttttctttgtttatatatacccctccgtccaaaaaaacgtgtttaggtttgtagcttggaattcgtttttttaacggagtagcacacatggattgactgtaggaatgagatcctctgctgacactgacatgctggcccaaagagagtagggcccacatgtcagtagcagtgactgcagagaagtagagaacatgtgtgttctagatcagtatgtgcagaggcagcagagtgatagacaaccagagctagtactaatactaacaataaagttaaaatatgtgctctagctaggcctaattttttctagagaagggtattttttacccatcctctatatttaaccggatatatacggccattgaaataggaaacttagccccgcaaacaatccaatctaaaattcgctccataggagatttgaactcagaaccttggggtactactcaagtcactataaccactaggctacataccctttcatagctaggcttaattaccacataaacaaagttgattgctggctcctgtcaactaacagtgcaatatgctagcaggaacctagctggtacggagtaataatgttttcactcttgttattctgcatagcgattcgtgcctttttgaccatgggaattaaggttcgatctgcttttatttagaccaggtatcaacgtccgcacgttcaaggatcatcggttagaaatttctaaaattttggctttaccaaatgctcctcttgtatataaaaaagagccccacaatccatgtgagtttcaaaaaaatgtttgtatagagcgagataatttgtttaagccaattttttaattcatgatatgctcttgtattccgaggtcgtgagccatgatcctagg

SEQ ID NO: 756 - DNA, 1501 bp, Oryza sativa
aactgagaaactgcatgctctcgtgtgcagatgcacgcacagtttctgtctctgctatggcaaacgcgaacatttgataaacattacttatacagtgattatactgttcatcagataattacttcgtagcagcacatcttttcattacttcatgactgttacacttattcccccaggaaagaatttttcatgcatctgaaattttcatgaatcagggatatgttggtttccatctcttaaaatatatgttaggaggcgtattcatagagtgagtgtagtgttacgtgtgcacgtatacatctcccgtgtaatcggaaaaggaaaatactcctatgatttcccttcagaaatatgagtttttttgagggtgatggactgattggctgatggtggtatataccacgtagaacgtagagagcagcaggcgccaaaaggcatctcccccaccacatcttccacaatcctcacccccgcctcccctttgtccctttcccaccgccccaaaaacccaccccctccctgactcctccccccgcagcttccgccgtccgcctccgctcccacgtcgccgcccgctcgtcgtcgccgccggtgagtctcctccactccgtgctcgccccctccgtacccagcagcaggatcggatcggtcgcgcgggcggcgggggtacgtatctgtattccgtagaattgggggaattcattccgggttgcggggttgctaaggtgttggattgactgcggtgacgggagggcggtagtttcctggtaaataggtagtaggagagatgctgagatgactgctggctttgagcatgcggcatatgatgatttagtgcttagtttgggggcttatctttagatactagcgggcgcatggttgtgagttcagtttgcgctaaccaccacttttgcatgaggaggcaaacgaggtcctctccagctgccctgccctagtgtgatatcatttgagcctttcatgctttttgtgccatgcttgatctgttccaatccatttacttcactaaccaaattatgcgggtcatatgcagttttcctttcatgtttctctccaactataaaagtttgattggccgcagccacatagagaaactcggaagattagggagtaaaccaatattaccactgtccacatagctttaacaactaacagctggtcctgctctttttttccttttggcatcagtttgttattgtcatgctatgtttccatttgacgactggactagaatagaatctgtttctttggctcgttttttttttttcatcaaatagtgatgacaaacttgataaatttacatactgatacagtgatacttggctgactttcataacaaacggttttgtgtattgtgtgtttaatggttcctcttgtttttgcagacgctcttgcgtgcttatttgtcaaatcagatctgaatataattttaggagttgcttcagcatggatactggctgcctgtcatctatgaacataactg

SEQ ID NO: 757 - DNA, 1501 bp, Oryza sativa
atccgcagccgcccacggagctcgtcgaacatcgccggcgccctcccggcgttcacgatcctctccgccgccgccgccaccgccttgttcgccgccacgcctcccagctgcaaaacacaggtgtagccaattcctcgtaagcaatctctcgaacacatggtgggtcggaaatcgaagcttagctttttgacggacgtcggtcgcacgcacgaatggtggactcaccttaccttccgagagagctgggcggtggtcgtcgtcgccggggtgcaggcgtcgcggaaggcggtgcagcggacgagggaggaggcggcgccgcggtcgaggaggtaggagtacttggggtggaggaggagcgccatgtacgcgaggaagaagaaggcgaggaacgccgcgttcagcttcacgatggccgccgccctcagccccgccaccggcgacaacgacgacgacgacgacggcttgacggcctccccggcgccgcccgtcacccccatgccaatggcacaccgcgccgggctagcttgtcctcgtgtcgtgcttcggcggcgaggttggcgcgcgtcgcgagctgaggtgcgcgctgttttgcctaagccggggcggcgttgcatggcgcggggttatatagatcgacgcgcgcggcatggcgcggcgaggcgcgcgcgaaggacgcggtgtgcgctgtgcgtgcgtgcgtgcgtgtgcgcaacagtgtcagtacgtgagaggcaagattgggggcaagtggttgggtacggtgagaaaggatgggggtgcaacgaactgagatgccacgtggcgagagttccattcaatccatgccttctcgaatctcgaggacacttgccacttcagtccccctccctgatgatgatcaagctctacaaattgcgtgtactagtgccaatcatgacgtgcgcgttgtgtgcaggagtaattaggatctgtttagctgatcgagctgaaatgcaactaaacagtttcttcatcgtctgaaataggagcgaaattgggtgtagcattttcattaaatgaactagataggtggtgctgagttttgttttatttttttcccttcagaaccatagatttatatttttctccagctatattaacatataaaactcgcactgactttcgtttaaaaaaaatactccacagctccactctatatataacacctaaaactaaatttagaagttggaatttacaaaatagatccttaacaacaatatttgagttaattttgcatcgcggtgatcccatcccctctatctcgatctctacctaggatcatggctcacgacctcggaatacaagagcatatcatgaattaaaaaattggcttaaacaaattatctcgctctatacaaacatttttttgaaactcacatggattgtggggctcttttttatatacaagaggagcatttggtaaagccaaaattttagaaatttctaaccgatgatccttgaacgtgcggacgttgatacctgg

SEQ ID NO: 758 - DNA, 1501 bp, Oryza sativa
caggaccagctgttagttgttaaagctatgtggacagtggtaatattggtttactccctaatcttccgagtttctctatgtggctgcggccaatcaaacttttatagttggagagaaacatgaaaggaaaactgcatatgacccgcataatttggttagtgaagtaaatggattggaacagatcaagcatggcacaaaaagcatgaaaggctcaaatgatatcacactagggcagggcagctggagaggacctcgtttgcctcctcatgcaaaagtggtggttagcgcaaactgaactcacaaccatgcgcccgctagtatctaaagataagcccccaaactaagcactaaatcatcatatgccgcatgctcaaagccagcagtcatctcagcatctctcctactacctatttaccaggaaactaccgccctcccgtcaccgcagtcaatccaacaccttagcaaccccgcaacccggaatgaattcccccaattctacggaatacagatacgtacccccgccgcccgcgcgaccgatccgatcctgctgctgggtacggagggggcgagcacggagtggaggagactcaccggcggcgacgacgagcgggcggcgacgtgggagcggaggcggacggcggaagctgcggggggaggagtcagggagggggtgggtttttggggcggtgggaaagggacaaaggggaggcgggggtgaggattgtggaagatgtggtgggggagatgccttttggcgcctgctgctctctacgttctacgtggtatataccaccatcagccaatcagtccatcaccctcaaaaaaactcatatttctgaagggaaatcataggagtattttccttttccgattacacgggagatgtatacgtgcacacgtaacactacactcactctatgaatacgcctcctaacatatattttaagagatggaaaccaacatatccctgattcatgaaaatttcagatgcatgaaaaattctttcctgggggaataagtgtaacagtcatgaagtaatgaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaag

SEQ ID NO: 759 - DNA, 1501 bp, Oryza sativa
tcgcgagcccaaactttttttccacccctacttgtcacggagccgacggtgcagtgatcgcctgatcaggggggaggggatcgcgtacgtacgtttccctgccctgacaggcatgagatcgtcacacgccgcggatacactgcgccgtgaaaataaagataaaggtttcctacccgcaaaagaaagataaattttggctagaaaaagattaatggtacatgcactttcaggttttactgaccatttacaagatattgtcgtacagtgttcaatggaatcaattgtgtgacaataagatcttccttggtatgacctgagacagtaagaattgtgtacgcatgttagaggtacttatcagatgtatatgtctatgaaaaggaatgagaactctatatcggagcacatatcataaaccttgattcaaaataatgaattgaccatgagaattgcctgacaaaatcaacctaaactatccatgcattgggggtcagatcgacaattggttaataaatgtgttaaggatggtaaaagaagcaaattttgtttatgtactctatatatactagactaaattaaaccagtggataagggggcagtccaatgctgcactgggtttcaaggtagagaattttacgtatacactgtattagtataatatctatagtcggtataagtgatcaatgggtttagattaaattgttatcacatcttttaatcttgtgacaaaattctaaattgtccttattataccgacaatatatattaacaatatactatgtattaagtaaaagttctctcgaggtattgcttaccggcaaccgcacctcaatttacttcatattcaggggacatgagaaatcaagaattaagaaaccattgagacggtgtttgatatgaagataaaaattaagtgttttatgtaaaacgaggtgataataacgtgtgattaatcgagttttaattattataaatttgaaattggattaatctgatattttagaacaacttttatataaaaagttttcacacgaaacatgccgtttagtagtttgaaaaacgtgccacttttatccaaaaaattatccactttttttatggaatctaacggggcctgtgtagctttggtgagaatttgatgggtttatcaagtttctgcttctaatccctttactatatattatgactacatattcttgaaaattatgagagaatctaaacagtttaagggaggtagatattatgaaataagttacggttattagaaactctcaggcaaagcttaagatggtacgatctccgctactgaaatatctctcctcagtgctgtagcatctactcccttcgtcttatattatattaagtttattttttctcctctcatttatcatagtataaattaatttttaagtaattattgtatcaaaattgtgaaagtagagaataattgattatgcggcttaattagctagagtaagttaaactcaacaacgaaacatgatca

SEQ ID NO: 760 - DNA, 1501 bp, Oryza sativa
caaatggtaattacgtttgatttttaaaatccaatgaaaataaaagaagaggcagtggatggaccgtagagtagtatagtggcagcatttgatgagacttctgaaaattataaaaacaaaacccaaacgagacaataaactctaaaaactataagtctaatttttagaggtttttagtgagaacaaatagacgtagtggtgatcgagaaagcaaataaatgaggggtgacaaagaatttaggatttgcaactgatataactttttaaaaaataaaactagaaacacagggatgataaggtttggtttttcaaagtcttaagacaacgagatatctatttaacaaaattttaagtaaaactatattaaaaattagataattttatatcggtgctagccgcgcaattgcgcgggtatctatctattatgttattaaaacagctttgaaaggagacaccacgttcgctgtgggggttagaaattcccacattaatcggagaaaaagaaaaggagagtccaagtagaaatacaattttaaaatagctgaaattcggaattaaaaataagcaatattgaaagaaatttccatataagaactcaatacgagattaatcaaatccgaaataaaaatagaataaaatccgaaattattaaaggaaaggagagtgtaagtaggaatacaatttaaaattagctgaaattcgaaattaaaaataagcaacattgaaagaataatccatataagaacccaatatgagattaattaaaatttagagtaaaaaataaaataatatctaaaattagaaaaattaaagagagttcaagtagaaatacaatttttaaaacaactgaaattgaaaataaaaaataaaaacattaagataacacaatacggtactaactaattttttttaaaaaaaattctgaaattagaaaaagaaaaataagatttcaattaggaatacaatttataaataactaaaatttgtgataaaaataaagactattgaaagaaaataccatctaaaacagagtagagtgttggcggttgatacgacatataaaaaatgttaataaaacaccaaatagaatcctaatgacgattaaaaggagggatgtcaggcaggccgtgaagcaaacgagtaagacggttatcgggacttctagaaagtaaaaaaaataaaccacattgataatcatatttgatttttaaaatctcaatgacaataaaaagagaagcagcggacggggtgtataagagtatagttgcagagccgccgacggttgacgagacttctagaaaataaaaaataaattccaacgataattatgttcgatttttagaatcacaatgacaataatgagtagggggcggatgggctgtagaggggcatagtggcatcgtttgatggaatttctaaaaattataaaaaatgaaactacaagtccaatttaaaaagtaaaaaaaaccaatgataatcatgttcgattttgaaatctcaa

SEQ ID NO: 761 - DNA, 1501 bp, Oryza sativa
tattaaaagaagagtatatataagaatccagtacgagattaattaaaattcagaataaaaataaaataaaatccggaattagagaaataaaaaagatagtttgagtaggataaaacaactataaaattgaaaataaaagaacattaagaaataattcatataagacataatacgatattaaccaaaattctaaatcaaaattaaaataaattccaaaaatagaaaaagaaaaaataatagttcacctaggaataaaatttataaataacttaaattcgtcataaaaaaataaaaactattgaaataagataccatctagaacatgtgacgagattaactaaaatttgaaataacaaaaaaataaatactgaaaatagaaaaataattataagagtttaagtaggaatataatttgtaaataaaatatcggactgaaaaatatggacttctaaaaaacttcatctagaacacaaatgataacaaacaacaataaagagggggagaagcaacaagtttataaagaagtagaatggtggcgattgataggacatctaaaaactattaacaaaacctcaaatagaatcccaatgatgattaaaaggagggacgatggatgggccgttaagcagcctggtcatggcggttggcgggacttatagaaagtaaaatatgaacccaaataataattatgttcgatttttaaaatcccaatgacaataaagagaagaggcagtggataggccgaagagaagtatggtgacagggtttgatatgacttctaaaaattataaaactatgacaaatgacaacaaatataggagaagcaacatgcatgtaaaggattagagtggtggcggttgatggaatatctaaaaactataaacaaaaccccaaatagaatcccaatgatgattaaaaggagggacgatggatgggtcattaagtagcatggttacaacggttgacgggacttctaaaaagtaaaaaaataaaccccaatgataatcatgttcgaattttaaaatctcaaagacaataaagagggggcagcgggcgagcagtacatgtgtacagtggtaaaggtgctgacagcttggtggaacttctagaaagtaaaaaaagaacccaaatggtaattacgtttgatttttaaaatccaatgaaaataaaagaagaggcagtggatggaccgtagagtagtatagtggcagcatttgatgagacttctgaaaattataaaaacaaaacccaaacgagacaataaactctaaaaactataagtctaatttttagaggtttttagtgagaacaaatagacgtagtggtgatcgagaaagcaaataaatgaggggtgacaaagaatttaggatttgcaactgatataactttttaaaaaataaaactagaaacacagggatgataaggtttggtttttcaaagtcttaagacaacgagatatctatttaacaaaattttaagtaaaactatattaaaaattaga

SEQ ID NO: 762 - DNA, 1406 bp, Oryza sativa
cgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttact

SEQ ID NO: 763 - DNA, 1501 bp, Oryza sativa
taccaaatacaacgggtctctcaattatcaaaaaccggtgcaatataggtcccatggcagtacagcgaggcgattttgtcccgcatcgcaatttgacccaagtcatcagcgttgagtcaacatgggtcctacatgtcagaacatcttcacctatctctgccttcaccaatatctctcttctttccatgtggggtggtgaggaggacggcggccgtcgaccaaagcagcccatgagcacatcattttaagggagagctattgggcaggagattccaggccctaggatccggtccaactagttaactactcttttttttctcacttacatgtgggctcataatttttttattttttagtttgctgactaggatgccacatcagtgaaaccagagaaccatactgttatgggaactaaattgtacggttttgtatagtataagggtgaagatttctagtattgaggattaaggatgtcatacaaactggacgtaaaattgagggatgtctggtgaacttattccttcaagagaggaatcccggcccaactagcgaaaagagctcacctaacaagttctccggcccaagaaggtccatccctctctctcgtcatcccctctgttacgaccgctcattctctcgtctctcagactctcacctcccctccggcctccgctcccttccgcaccgcaaatgctcgcgaccggtgacagcgtccggcgtcgccgggcgcgggcgcgcgggtacccgcggccgcgcggtggtcgcgtacgccggcgccgccgcaggtggaatccccgcctcctctccttccccgtgcccggaagcttccttcacctgtctcccatatgcggcgtcaccccacctgatggcggcgccgatgtgactggtaactaatcaattactggcagagacgatcaacgagcgtatagggcccgtaagtttgtctctttcatcgatttgctctcctacggcgttatttgattggattgtattggatttaacctggatggcgattggggatgttcacatcatagcacgttttgattcttgcggttaaaacgctagaaacaaaaaatgctcaattattgggtatagtattatagttgaccatggaatgatgtgacatactgacatggcatctatctgcatatcaatccatatttgttgtaggagattatatttaaattaactttaaagagaaatcttgtaggaaatgtattctctatttagaaaacaagtttatcttgcgcctcatttactaaacagatatggaccctcgagtcaaatctcaatgcaggaaaatcaggatcattcctcgatgagaagttgttaatttctcagccgagaagttctctttaaagaaatacttgttagtttatccacagtgctcccttgtaagcgagttaaatgtattttggacggccatgagagtgatgtgataagaaagttactgaggaaagtgcgatgcgtgaagtactgtagaaaaacagcacattagcat

SEQ ID NO: 764 - DNA, 1501 bp, Oryza sativa
aatacgaacctaagtataggaaatatgacttatccgtaacactgacaataatgaataggcttgaaccatggtattttcttttcaatatatcaaagttactgctccttccacttcatcttgtaagacactttgactctctttttttttaatcaaactttttaaagtttaatcaaatttatagaaaaattagcaacatgtaaaatatcaaattagttttattaaatataacattgaatagattttgatactatgtttgtttttgttaaaagtgttactctattttctctataaattcgatttaacttgaaaacgtttgactaagaagtctcataagatgaagagagtactatattagctacagagtatttaatagcctcttcaagctgcgtgtgataatctgacacgagtgataaaagctaaggctacgtatggctaatgggattaggaggatgggaaatggatatcatttcccttttccagatttatgctgtttggatacattggaaatgggatgcacaatcctgctggattgaggggtggatagagtgctaggcgaaattaccatattgccccttgccattttgacccctttctatctgtctatgttctgccacttattgcaaggaggggtattttggtcattagtctagaaacttccttttccatccatctaaccaaacataggatacaatttctcttcatataatctaccacctcattccaacaagatatcatttctatttcccattagacataacccattagccaaacgcagcctaaaggaattccaaagctaaacgaagagagatgttatggattattatagcccatgggccaagctgggttatttgtccgaacaagatattagcccattagcctagctaaggccttgtttggatcctccgggctattaaataaccctctggaatcttgctatttaggattattaaacgtagattaccgacaaaaccgattccataacccctaggctattttgcgagacgaatctaatgatgtatattaatccatgattaacagttgattactgtagcaaatcatggattaatatacctcgttagattcgtctcgcaaaatagcttagggattatggaatgggttttgtcagtaatttacgtttaatactcttaaataacgagattccggagggctattcctccggatccaaacagggcctaggatctaataattgctactctatcgactcatatcgagatgtccaccccgtcgtctgctgattggctgatctccacgtcagcagaaagcgtgcacaggtggcgagatagacgaagcgagctatccaaagtatccaaccagacgatcgcaagagataggcccatccttgcagcgtccccgtttcccgccactatttaaaccccactcgagctcactactttcctcaccacagcagctcacgagctcaaaagacacacattccaaaagcatctgtggccatctcctcctagtcctaggctcgcgtcaa

SEQ ID NO: 765 - DNA, 1501 bp, Oryza sativa
tgaacaatgaaatttttgagaaattttgagggattgattttcaatgggaaacaaaatcttatatggtggtatttggaacaatggaaggctctcaaattctttaggattgcctaaagtcatagaacttctagaggattttcaacacgaggtttaatctcctgggaaaatttcatgtctgcctcatttccatgtttttcgtgcttcattcaaatagtcattactatagttttttttcttgatttttttcatccatagaatttgatatatcagtgcactctaattctgttattttcttatccttgtgttttgaaaattttgcgttccaaaaagcctgaacttgagtatttcttatttctgcagaaattagattatcttcagtaaattgatcttctgttgaacatcccatttggcctgacttcttttttcccccggatctaaataggagtcatcatcagttgattcagctgtaataagtagtagaacagtgaatccctcccggcaggtaggccatgatcagttccgatccgtccaatgaacaagtgcagttcctggagagtttcagattgttaggtgatcatacaggtgcttctggaaagcatcactcgaaatcattgttttatccggtcgcagagatcagatcattgcataaatgaagaactgattggaggtgtacggtgtgatcgacgactctcagctgccgacggcgactcacttggttctactcgcgtagtcgcgtgttcaacacagcacggcacatagactggtgctcgtcggcggcggtggtttttgttagtataacaggaagttggctagtacgactgctcacttgtgacgatggagatattagcgtacaaaatcaaagctttcttatacttgattgatgatgattggttgggggcaacttatcatcaacattaaagcaatgctctagctaatcttgactgaggtaagcttagctagctaactcaaccaagcatgtttcaaaattgttgtgtccctatttgctcgcatttccaaaaggagtcaaaaggacgatcgatgtgatcacatttgatgccaccttttgcagatgcgcgggcaagtactaatttctgagtttctccgttgaaaacttcctcctcttcgatttagcgcctgccaatttattggacagttgcactacgagcaagtttaatattataggcaactatgaactccaaatcatctatagccaatataacagttaattcatacaatagttgcttactatactattaatatctagttccacttgtcatacacacattatgtcttggaattcgtactgcaactggctataaatctatagcccgctgctcttctctcttttcttttatctctttaaaatatatttatagttggcttatagactactattgtacctgctctactgtaaaatatccattggacaatattgtgattcagaccagcaattattttttaagtatttataaaacctgttaaaatgactagtcaataatct

SEQ ID NO: 766 - DNA, 1501 bp, Oryza sativa
acgagaaggctcattagcatataattaattaaatattaattattataaaaattaaaatagatttatttaaatatttttaaataacttttatatagaattttttttaaaagtaccattttactgtttggaaaacatactaatagaaaacgagaaagttgtagtttgggcctaagcattcgtttgtttgcataggaattgaactttcaagaggcacggaaactggagcaagcaattaacacataattaattaattattaattattataaacttgaaaattaggttcatttgaatttttaaaggagcttttacataatatttttttaaaaaaacatggtttaacagtttggaaacgtgctaatgaaaaacacgtaggaagtaggagtttagatctgagcctaattacgtttatagttcgtttcacgtacggctaatcatccaaagtaacccataaaagggatgtaggcttatggacgcgtggtaggaaggaattaaattaatcgatcatcgggaagatgacgatgacttaattatatcgacatgtaaaagcttttacgcgttaggcgaaagaaaatgacgacggtggcgacgtggggacgtacgggcccgggccggcccggcaggggcgcgcgcggctgcgagtagttcggtggttctctcgatcgatccatatacaatgcacgtaagatgaacggtggcatgtgacacaattccgtgcggttgtacaagtttccgcgccgcttcgatcaggatcaaatgcatatcgtttttatcatgcatgcttgctgcttactcccaccttttcaaaatatttgacaccgttaactttttagtatgtgtttgatcattcgtcttatttaaaaattttaagtaattatttattcttttcatatcatttgattcattgttaaatatacttttatgtgcacatatagttttacatatttcacaaatttttttaataagacgaacggtcaaacatgtatttaaaaagtcaacggtgttaaacattttgaaacggagggagtatttagttagacagagcccaggaggccagaaatacggaagaccaaatcattctgtcgctagcgagatagagttgaactctccgatcgagctctgaagataaatccgccccgtttctttccatttcttcttcttcttttctccctttgcatgcatgcatggttgcatgtagtgagctagatgcagatgtggatatgcccggccggttgcaattatccgtcgagggttaattaattgtccatgtatatataggtgccgttgtatatgtagtgtattcgaagataagctatgggaatgatttttgtcacatgcatcaaatttatacgcatagacttctcaccaaaaaaagaaaaagtacttccaaaatataccgtctatctatctactctctcgttccctaaatgtttgacgccgttgatttttttaaacatgtttgaccatttatcttattaaaaaaacttttgtgaaataagtaaa

SEQ ID NO: 767 - DNA, 1501 bp, Oryza sativa
gatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggaggtaggctcccttatgatctaacgtcctaagtaacgacgtatctgattggtgtaagctaataaccaaagccttatcatgaaaccgtcacgcttgtttttttcttttttctttttcttcttgtttcctggcatttgatgctgttacgtgttcctcttgccagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatg

SEQ ID NO: 768 - DNA, 1501 bp, Oryza sativa
atgtttagttttttttttcttttgacatagaagtactaatgcctacgaattgtgctcctcgccttcttcttgggctcaacttggcctctaccggtctctgaaaaacgcgagcccttttttggcgaaatgtcctgcaccatccgctggaaataaaaaagagagagaagagatccaattcctcgatcggtcaccatggaatgctgtagtactagcgatctgtactatatagcgtagctgcataggcgatcggttgactgtctctgtgccaaccatgtcgccgtccctcccccacaccgaattccgtcgtctcggacctctgctttttagcggttcgagctgatatgatatttttttttgtccgagcgactagcgagaatctgagacggttggtaattggttggtcccgaaactatgccctccctagaagaacacctttcggtcggtcccatttcgcggcaaaaagaaaacagaaacggagcagcacgcgatcagcggcaaacagtagtattctgattcgctgagcgttcggaatatatgggctcgcgcggtcgcgcctcgcggaatgatgagcagattgaattgctgaaggaaacatactaggcctgtttagattgtagccaaaataaatcttatcaaattttgttaatgtcaaagttttggtaaaatagcgatattgctaaaaatttttagcaggatttcttatgtattgacctaaatttgacgacaaactaaacgtagatatttttttttggtaacttaaacaatagtattgttgaaaatggcatcaaagtgaacgggtctaatgtagtctgtatagcattagcactagttgctgagcacttttttttttttgccagttgattgatgtttcatatttgttgatgcgtcgatggctcgatgcatcatgggcctcatggcgtcgtggtcatggctgcacatcttcgacatacatccaccatggcacctcgagtattcgttatttacgtatatgttttccaagctattaaacaatatatttttcttaaaaaattactatgaaaaaataattttgaaaaatcatattaatatgtttttaaatttaaagtaattaatatataattaatcataagctaatgacttatgttaatttatgtatttcttaatcttttcttttccttttctgttaaacactcacctttgcaaaaggtgtgaagcagcagcaaagggaagaggcattcccggcctatgttgacggctttccctgcaacaagccaacaacattcgcactccaatttacagccaagtgaccattattatttcacttggagtggtagaccggtagtgacagcgagatgcgcgatcatttggggatcacaggacgcgtaatcgctgcacatccatcggaacacgaagcctaaacgtcatagggacatctacaatccaagccacactagtagtgtcctcgttgactgaagccactacatatgactacactcacctttcaataaagaatactctcagt

SEQ ID NO: 769 - DNA, 1501 bp, Oryza sativa; identical to SEQ ID NO: 759

SEQ ID NO: 770 - DNA, 1501 bp, Oryza sativa
tgcgtggttgttggatccgctggtcctgcgtggtcgcgtgtggtgtgtgttgtcctctcgctggttttgacgaccttttcttcctcgatgccgctgtaggtggccggcggtgagcaggaggaatcatctctagtgttcttgtctctgaggaattttgattctctctgtgaagggatttggtgtgttcctgctgctactggtgctccagatgcttcccaccaacaggaacaggccccagcagaggactgccagatcttggtatttcatgagccagcgggtcgacgagctcggccggctccagtggcagcggcggcggcgtcgggacatggagcaagacggcagcggcgacgacgctgctcgggcagccgccagccaccgcattagcaggagggggctacgtccgtgtccccctgctgtcgcgccgccctcccgcgcatcgatggaaggtgaggccgcgtcggctgctgctcctctgctcccacgacgaagacccgccgtcgcgtggctcgccgccgtcctcggcccccccttcgcgccaccagttggctccgcccccgcgcgccgcagtcctcagctcgtcgtcgtcggttggtaatggaggtgaggggagagaggagggagagagggggattagggaaagagagagaagagaaagggtgagaaaatgacaggtgggcctcactgactggactgccacgcgtatgccacgtagaccaaaaccaccgcggattgggttgagggggtaattcgtccggtttgcatagttgggggtgaataatgtccagttttgttgttcatggggtaattcgttcgaccgcgatagtttaggggcgtaatccgtactttttcctaaacttttctatgcagctaccttcttggcctgttttgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctattttttttttgcgttgagtataagtagttctcttagctctttattctttttgtaaggtttacattcagttgaatgagaaaaacccagaaaaaattgccccatacattcttgcaagaattctttctctgaaacttttcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggagagctcggggagtgctttctcctacccacaactcacggcaacgaactacaccagctggtgcattcggg

SEQ ID NO: 771 - DNA, 1501 bp, Oryza sativa
cagtattggaatcagtagtcgctaggaatcaggatacggggtgattagaggaatcataaacaggattatgtaccaaaacggaagaaacaaataaaatagatcaggactcaaggagcgacggatgaagaggcatgagtacagaaaactctttaattattataataggtaaagactgtagtattaattattgtggtgacaggatggttagatatgtttcatgtgaaattgttggggcaagaaacacctcttgcaaggacattaatttgggcaataacattaacttaaactttgggagtacctatttttttatagaactagtatgcaataaatagtggaactatcaaacagaggtgcactggtagtggttactgcagctggggttggagcttagattcaagttgaaatgaggaacaattatgactataaatagcgcagacactacatacaatttctgtttgtaaggatggttttttttttcccttttcaatatgtaaaccaagtttggaattacaattttatggtataataggcggctagcgtataaagattttcagatttttttttacaactatttcatctatatattgaactatcttattgatgatatttgagatttaataacaaatcgtgggatgccaaagggataaaataaccggttccgcatggacaagaatatccgccggccgcggatgcgccccttgccatggcgcctgaagccctgaacactcggaggctcggagcaagatgattgataattaatcctattcggcagccatcgccatgtgccaacgtacgtgtgcagtagccaagccaaggcaccggccaagaagatctgaagaacacgagagccaaattagttacctgtcggcgtcggcggtgcagttgggcgtccggacggagcagtccggcccggagaagcagcggttgcactcgcacccgggccgcccatcctcgccggtgacgccatccaggaacacgttgccgtggccggagcagtcggcggcggccacggcctcggcctccctggccgcctgcagcgcccagctcagcccgtcgccgagccgctccggcgttgccgtcggcgaggacctgaggaggtggtgcgcgaagaagacggcgttgagcagcaacgacgagcagaggagtgcgtggaacgcgagccctgcagatcccaggctctgtgacctatgccgtcccgtctccattgctttcctgtctcggggtgtctccaatgacctcaccgtcggccactgggccactgcactgtgagcctgtgagcctaccggtttattaatcggtttctagcacagcgcgtgtggccccagctttggttcgattataaaatctgtgcttataaaatattttgtccaaatcggagttgtgatcgcgtgcaggtaattctttcatacaaagtacaatattttcgatttgaacagtccccgtcaattatatgtttttctgagaagtttgagatgcgttttttgacaaatcaacaatgatt

SEQ ID NO: 772 - DNA, 1501 bp, Oryza sativa
atagatcaatcagcaagtagcggatcattccagtgttgattttccaaaatgcctgatcgttccggcatagtggcaatcgaggccagctacaacaagcttgtcagttgtcaccgtcctaattcacgatttcacatggagccggtcagccggatgcaacgggagctctgctgtgcttctcggcgtagacaaaatcggtgatcctctccaggagcacgtcgaagtcgtcctgtgtcttgaggaggttcacccgcgtgtaccgcgagatgatccccgccgccagcagcagcgatctcgcggcagtcgacgtcttcctcccactcgcatttcacccacgcgtaggctgctcatcaggagagaccaaacacaccagacacaacttcagccccgtctccgtccaacaccgtcgccacctcgcatcaccaccacccagccagtcgcctgaacacgccccgcccccgcagcattcatcagcccactcagatcttctcatttaaactctttctccgctgcagtccacgaacttgtaagagtgtgcagccgggcagcattcatcagcccactcagatcttctcatttaaactctatctccgctgcagtccacgaacttgtaagagtgtgcagcccggccacgtatcgtaggtcacctaggtcacattaggccaacttcaccacaggcccaaccgaaaccacaactatatatcctgagtctacacaacccaaaatactagtctgatgaaagagaactgccaccaccttttaagttgtcctcccccaccatcaattattgatgtgggactaaacccaagcaacaatcttccccgtcacatcaacccatgtgaccccgaagacttttacctggcctcccccaccatttgacctttggaaattgtttcggattttaaacctaagttctggtaccacttattagataatcagtccgaaattaccatcagaaaccaaacacggaagaaactccataggagatctaaacatgatgacaacaccgaggcacgatatttgttaacgaggttcagccgaagcctacatccccggggcacagtttatggggtgctactcctcaattcagtatattacagcataccagagttacaactaccctgggccggacgccgctggcagacgctacctctcgctatgctaagtcgtcatatccggttacaacaagtttgtccttctaattaaaaggatactagcatagagtctgactcttactctactccaataactagtacaactacaagtcctaaattgtaaccgactttgtacgcatattcgacacaaactctaatagagtgtggagagtaactccgtcgccactgccatccacaagccgacgcaacctagccgccgctcgcaagccagcgagatgcctgtcaccgccaccgtcgccgttcaccactgtgctcccagcttcggcggcaaacctcagcccatctgcctgggagccgaggaaaaagccccatcaccaccgtccttccac

SEQ ID NO: 773 - DNA, 1501 bp, Oryza sativa
ttagatctcctatggagtttcttccgtgtttggtttctgatggtaatttcggactgattatctaataagtggtaccagaacttaggtttaaaatccgaaacaatttccaaaggtcaaatggtgggggaggccaggtaaaagtcttcggggtcacatgggttgatgtgacggggaagattgttgcttgggtttagtcccacatcaataattgatggtgggggaggacaacttaaaaggtggtggcagttctctttcatcagactagtattttgggttgtgtagactcaggatatatagttgtggtttcggttgggcctgtggtgaagttggcctaatgtgacctaggtgacctacgatacgtggccgggctgcacactcttacaagttcgtggactgcagcggagatagagtttaaatgagaagatctgagtgggctgatgaatgctgcccggctgcacactcttacaagttcgtggactgcagcggagaaagagtttaaatgagaagatctgagtgggctgatgaatgctgcgggggcggggcgtgttcaggcgactggctgggtggtggtgatgcgaggtggcgacggtgttggacggagacggggctgaagttgtgtctggtgtgtttggtctctcctgatgagcagcctacgcgtgggtgaaatgcgagtgggaggaagacgtcgactgccgcgagatcgctgctgctggcggcggggatcatctcgcggtacacgcgggtgaacctcctcaagacacaggacgacttcgacgtgctcctggagaggatcaccgattttgtctacgccgagaagcacagcagagctcccgttgcatccggctgaccggctccatgtgaaatcgtgaattaggacggtgacaactgacaagcttgttgtagctggcctcgattgccactatgccggaacgatcaggcattttggaaaatcaacactggaatgatccgctacttgctgattgatctatgtcgacgtttcgacgaacagatggtgtgcattgagcaatacatacacaagctattctgcaattggacggacattttggatttcagtgacgaaaaattgagtatgcaaataaatgaagatcgtagtaggcatttttgtaatcaaggacgagcatatgacatggtaagcaaaagtaaatgtgagaagagatagcacttggcattcgaaatggcggacaaaagcaacaggtgagcagggatatcacttggcaaatataatggctaaaaaaactgaaagaatgcgcatccagggaatcgaaccttggtcagtaccgtgggagggtactatgataccactacaccagatgcgcatgttgcttaagcatccaaaggaagttttactcattataacaactaacgtctttaatactgcaaaagaaagggagcaaatctgcaaatggttgtgctatagattcagaattggcagctacttccatgaacaataaaattgtatcctgccacggtattgtgctaa

SEQ ID NO: 774 - DNA, 1501 bp, Oryza sativa
tcttcgacctgttgtgctctgggccagacaacacgccttcttttacatcatttgtgtaaagtaacaatatgctaccaaccacaagttctgcgtgatcagtattaatatttgagagtgccccatataacagcataactgtagactagctgaagtcacacgtaaaacactagagaaaaatgaagagatgcaggaatgcccaaacaaatttgtgtgaacatggcagttgtttttcctgtgtaagaaagaaaaaaaaaagaagaagaggagaaacttttataacgaaacaaaaactagtgcaatggttatgctggcccagatgaggagtgcacccaaaaggtgagataaagcgaagtaggaagggagatctgcaggcggcagccaggcaagcaacatcaattgccctagctaatccggctgatcgctgtcaagctactggtgaaacagcctccaaaccaagctgctttgcgtggaaaacacgtgcatgcggatttgcttggaaatctctccgcgcatacgctgtgcccatgccatggcagccaccggcccaccgccgtgcatacgcaccgtccatttttttcactcggccatacgctccaagttggaacctgaagaagtgtgaaactcccaccggatgaaatgacgatgcaacaaccgttaagactctagcgacaaatccgtagtattcggataggtaccgaggtagtgtggtacacgaagaatgtaactttgacacgcgcggtggtcggcaaactgcacaaacatgggtgtgtttagttccatgttaaaattgaaagtttgactaaaattaaaagttaaaaaaaaagttgaaagtttgactaaaattgaaagttttgatatgataaaaaagttataagcttaaagaaaaagttgagaactaaaccaagcccatgtcaagatttcagtcacatcgaactaattaaccctggtccgcgatacaggtcacgtacaacggcgacgagacgagcgaagaaagatagctacaggttttttcgcgtcgaaagaagcttcgttcgctgcgaggaagaagagcaagtggtagcggcagcggtagctgtagtacaggagtagggaatccccgtgaccgtgataggaggataaaccgggtctccgtccagttcaagtatagcaatggacgtacggtgcgcagcggggcacagcaccagcacaggtcggcacgaggagaacgcggagcttggtttggtcaccgcgatagctgttcttccagtcaccgagagccagccgggacgacggtggcccaagccggggtggtcaaggcacgggcgggcgccgcgggcgattggtcgcgcgcgtacgtgcaacttggggagagaccacgacacagccaacccacgcgccgcgtggcgccacatcgtgagcctgcacgtcgcggccgtgatccatccaccattccaccgccaccagcggcgctggtacaagtaggggggggtgctttgcttgctgcgggctgcggctctactct

SEQ ID NO: 775 - DNA, 1501 bp, Oryza sativa
gaaataaaaataaaataaaatccaaaattattaaaggaaaggagagtgtaagtaggaatacaattttaaaatagttgaaattcgaaattaaaaataagcaatattaaaagaagtttccatataagaacccaatacgagattaattaaaaataaaaataaaaataaaataaaatccaaaataagaaaaggaaaggagagtccaagtaggaatacaatttaaaaatagctaaaattcggaactaaaaataaggaatattaaaagatagtccatagaagaaccgaatacgagattaattaaaattcagaataaaaataaaaataaaaccaaaattagcaaaagaaaataaaaggagagtccaagtaggaatacaatttaaaattaactgaaattcggaattaaaaataagcaatattgaaagaagtttccatataagaacacaatacgagattaatcaaaattcgaaataaaaataaaataaaatccaaaattagaaaaggaaaggagattccaagtaggaatacaatttaaaaatagctgaaattcaaaattaaaaataaggaatattaaaagaagagtccatataagaactcaatacgagattaattaaattcagaataaaaatagaaataaatccgaaattagtaaaagaaaataaaagaagagctcaagtagtaatacaatttaaaattagctgaaattcggaattaaaaataagcaacattgaaagaataatccatataagaacccaatatgagattaattaaaatttagagtaaaaaataaaataatatctaaaattagaaaaattaaagagagttcaagtagaaatacaatttttaaaacaactgaaattgaaaataaaaaataaaaacattaagataacacaatacggtactaactaattttttttaaaaaaaattctgaaattagaaaaagaaaaataagatttcaattaggaatacaatttataaataactaaaatttgtgataaaaataaagactattgaaagaaaataccatctaaaacagagtagagtgttggcggttgatacgacatataaaaaatgttaataaaacaccaaatagaatcctaatgacgattaaaaggagggatgtcaggcaggccgtgaagcaaacgagtaagacggttatcgggacttctagaaagtaaaaaaaataaaccacattgataatcatatttgatttttaaaatctcaatgacaataaaaagagaagcagcggacggggtgtataagagtatagttgcagagccgccgacggttgacgagacttctagaaaataaaaaataaattccaacgataattatgttcgatttttagaatcacaatgacaataatgagtagggggcggatgggctgtagaggggcatagtggcatcgtttgatggaatttctaaaaattataaaaaatgaaactacaagtccaatttaaaaagtaaaaaaaaccaatgataatcatgttcgattttgaaatctcaa

SEQ ID NO: 776 - DNA, 1501 bp, Oryza sativa
atccagtacgagattaattaaaattcagaataaaaataaaataaaatccggaattagagaaataaaaaagatagtttgagtaggataaaacaactataaaattgaaaataaaaaaacattaaaaaataattcatataagacataatacgatattaaccaaaattctaaatcaaaattaaaataaattccaaaaatagaaaaagaaaaaataatagttcacctaggaataaaatttataaataacttaaattcgtcataaaaaaataaaaactattgaaataagataccatctagaacatgtgacgagattaactaaaatttgaaataacaaaaaaataaatactgaaaatagaaaaataattataagagtttaagtaggaatataatttgtaaataaaatatcggactgaaaaatatggacttctaaaaaacttcatctagaacacaaatgataacaaacaacaataaagagggggagaagcaacaagtttataaagaagtagaatggtggcgattgataggacatctaaaaactattaacaaaacctcaaatagaatcccaatgatgattaaaaggagggacgatggatgggccgttaagcagcctggtcatggcggttggcgggacttatagaaagtaaaatatgaacccaaataataattatgttcgatttttaaaatcccaatgacaataaagagaagaggcagtggataggccgaagagaagtatggtgacagggtttgatatgacttctaaaaattataaaactatgacaaatgacaacaaatataggagaagcaacatgcatgtaaaggattagagtggtggcggttgatggaatatctaaaaactataaacaaaaccccaaatagaatcccaatgatgattaaaaggagggacgatggatgggtcattaagtagcatggttacaacggttgacgggacttctaaaaagtaaaaaaataaaccccaatgataatcatgttcgaattttaaaatctcaaagacaataaagagggggcagcgggcgagcagtacatgtgtacagtggtaaaggtgctgacagcttggtggaacttctagaaagtaaaaaaagaacccaaatggtaattacgtttgatttttaaaatcccaatgaaaataaagagaagaggcagtggatggaccgtagagtagtatagtggcagcatttgatgagacttctgaaaattataaaaacaaaacccaaacgagacaataaactctaaaaactataagtctaatttttagaggtttttagtgagaacaaatagacgtagtggtgatcgagaaagcaaataaatgaggggtgacaaagaatttaggatttgcaactgatataactttttaaaaaataaaactagaaacacagggatgataaggtttggtttttcaaagtcttaagacaacgagatatctatttaacaaaattttaagtaaaactatattaaaaattagataattttatatcggtgctagccg

SEQ ID NO: 777 - DNA, 1501 bp, Oryza sativa
gaccagatatttatagtatagtatgtaactattgtatgaatgagctattagattggctatagatgaattggaggctagtagttgactatactattaaacttgctctaagaaaaagtatcatatacggcgaaaacgagactccagtagcagccacaaaaggagctatctccattctgtatcacttgactttcgaatgttgaagaagatgtgttacatttacagagagattgcacgcaagcatggccttgaacccatcttcgtgcactcgtgtgctgtgtattccacggtgctcctgcgtgtgactcaagcactgggatcattttgtatgtgcgttcgccgatcgatgtgttcttcgatcgaaccataccgatcacggggaaaaggagtaatcgaggcgcaccgggggcaccgagcccgtaatctttcaatcctgctttttgtgaaagtagcacgtacggatcgagcggctccgacgttgcctcggctgccaggaacggaacgtgattcctcgagtatagatactctttttttttaagtagctatacaactgttgacagtttttgggatgaaaaacttttaaatataactactatgtaattacattgtaactactatgtaactactatataactaatatataactcgagtgtaactaaaaaaacccgatgggagaattggttaggtgaacaatccctactgcacgcgtctgaattttttaaaccgttttccctcactagcacaaatctcaaagcatattagacggcttaaaatttaaaagtttttaccccctattaactgtcgccagttgtatagcaaatccatttttttttaaacctccaaggtagatactcgacggacgtcataagatttgctttcgtttgtttactcactgtttacatggtgcagcatcgtgcttgtcgatactagtagatatttgggcgtacaacacgacaaagaaggttccgaggcttgggaggctggcccccggcgtccgaggccttgagggtagtagggtggctccggcggtctgcttcgctgttccatggttctgaattaaacgggcctctgatgggcgatgtcgcatattttttgggccagaatcctaaggcctactgttgaagtggacgtgcgggtttgtttaggtgggctcgttatccacatacatgggttggaccgtccaagtaaatcgattcttttaggaaaaagtacaccggaggtccctcaacttgtcatcgagttacaaaatcgtgctccaaccacaaaagcagatatagcacatcaatcattttacaaaaatcaatcattttacaaaaaaacattcactttaggtcattcggtggttttgaccacagttttattctacgtggcagttgagtcagcgtggaacccacgtgggctccacatgtcagcatggccacgtcgggctcattctctgttttcctcctcccctctctctctctcacattcttctctcttctctgggcaagccgaccgacgactg

SEQ ID NO: 778 - DNA, 1501 bp, Oryza sativa
atcgcgtatttgcatgtgctttgccgttacaacattctatctatagaagttcttcagttatcagcatattccgaatcggcttattgcaatactgtcgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttact

SEQ ID NO: 779 - DNA, 1501 bp, Oryza sativa
ggacggtccagcccaccgccgacgcgtacagcaacctgacaaacgcgtcgttattcccctcttcaaccttcctcgattgtatacatggcagcagcgcagcacgtcgtcgtccggccatggacgtcacgggagctggtcaggccatggaggagcagtgagcggaggggtcgatggcggcgttgggacggggcgatgcgctcggagccgagggcgccgtggggagcaacgcggcggagggggcccggcgacgctggccgtggacctcggcgcagagggcggccgtggacctcgacgcaaagggcgccagggcggaggagatccagcggagaccgaataagggaaggagatcaaatcagagcaaagggggagagagaagggagagaaagggagaagatgacacgtgggaccaacatgccagtggggcccacaatttttttattttgtgtgtgaatgacatatgggtcccacgcatattttttatttctaatgccacgtcaacgccatgtggaaagaagactgagtcaatactatcacgtagacgccacgtcagcgaaaccgccctccgaaactaactagggagtcaaattacactggttttaagagtttggtggtcgaaatattcgattttgtggtttagggtaatggattagatttcaatcgcttttgatttgagggtcatgaagtgaacttattccttgtagttgcgcaagataaaagcccaatgggttaaaccaagcccagtgtcacccacggctcaccagtattgtggcccactggtttgtggtcttcggattagcacaaaagtgggcccagtttagtctagaacttttcttttttcttttttttttcttttgcgaaagtttggtactacaatctttgagttctggacacgtataggtaataattaactgtaagtaaagttttgtactgtaacttaatactagtaattcgtggggaatctgtattactgtagacaaaagggggagaggggatgtgataatgacacggattaactcagtataatgccattttaccaagccaccaactcactccccaagaaagcacaaagccacatcaacctcaccttcttgcccccgaagaaaaagaaggccacggaagccacgggagagtgatctgggccgtccatctcacaacaagccacggcggggagagatctgtgccgtccatctcacaaccagctcctcccccacggccccacccccgccgctataaatagacgcttcctcttcctccccccctcttccccaccactccaaagttccaaaccccacaccaccaccgcgcgcccgcatttctccccgctcctcgcgccgccgccgccgccgcgtagtcatcgagtcgagcagaagcgttcctcctgccatggaggcggagacggagtgcaaggtccccggcgtctactccgagaccggcattcccgtggaggatccggctcccggcctcaactccgacgtcagcaagaaggacgcccctcctgccg

SEQ ID NO: 780 - DNA, 1501 bp, Oryza sativa
gataacctatacaacttggttttcagagaaggtaagtttcctcatgtcccttaaatcaggttgtttcatgcagctaaatgattctacaaaatagaatcttgcaactggaacctggctttgcatccctcgaagtttactctgtaactgatatgttttctttaactgacaacaaatgatactgatagctacccaacattccaagattttcaacttcatgctttttaatggattttccatggtgtgaattgaccttttgtaggatcattctttatacaatgaatttgtgtggatggagaaattttggagatctagagaatgatggctttcaggcttgccaacgaagagatcctgcccttcaattgtttatcatacacagttgaacttgaggtatcgctacaatgccaccatatttccagtagtgtctgttgattgcaaagcctatgggtagagagaaaccttgttcatttccttcttttgactgaactcacaaggttcctctctgtccatattatgattgtgtttatcacaggcatatacaaaggtagcagatattagaatgaagttaatggaacagccatcagatgctctccacggcacaatgcaatcacagctctgaatatagcagcaatgaaagtaaatggagagaaagggtaattgtatactagatgatctcattagggaggcttgtttcattttgacttgaaagatgatactgttggatgtaattttgatgaagaaaatggtttatctattttaccttggttcaaatgaataatataatagaagaacgtcactcacaatcacattgtatgatgtacttactgattattatgtttatatagaaaaaaaatatataaataacacgcttcttccaaacatagcacacccgtagcgatagcacgggtattttactagtaaggaaaaatgaatgacaattcaagccacaagaaagtgaaaagaaataataggcaactttcaaatagataaccgaataacctatgctatatatgtagttgcgttgcacaagcaaagtagttttgagtgacaatcacttgatttgctcaccaactgctagtattttagaaagaattgagcacatctttcaatcttccatcagacacgtctataagtataagcttaattaagtgctactccctctgtctcattttaagtgcagctataagttttcgtgcctttcttcctatcttaattacattgaatgacctccttcagttattccggcataagtttccgtgcctaactttaatcgtccgtcttatttaaaatattttttaaaaaaattaaaaacataagtcatgcataaagtaatattcatgttttatcatttcttaacaacaaaaatactaattataaaaaaatttaaataagacagatgattaaaattgggcacggaaactagttgcacttaaaataggacggagagagtacaaaattgtgcacttctgcaaaaccaaacacaaacagaattaccagtgggcaa

SEQ ID NO: 781 - DNA, 1501 bp, Oryza sativa
ttgatcggctccatctccgcttcgacggcgaggaaggcgaagcgcgtcgagttgatggagtagtccccgatcgatcaccgggcggtcaccggaggcggaggcggagggaggggctgcgaagccgggagaggagccgtggcttccggccggcggaggggatccgggcgaggcgacggccggccggagaaggagccgtggcttccccgatccgccgctgcggcggggggattcgagcggaaaggggatttcgttcgtggcttctgggctctggctttggtagccgttgcggatggagggaaagggagggagagagaggtcggggggggtgaagtcgtaaatttataagcgggcttttcgcgtcaccgacaggtgggacccacgcagtcaccgacaggtggggcccatgccacggctgcttcttgtggcgcactccacgtcatcgacggcctcggatatccaatccccaaagcctccactaaagtagtactagtattctagaagcttcggatggagcgccgccaccgtcctcgcgccgccgccgccgccgccgcttctgcctccgtctccgccgccgcccaccacccggggggagtgcgtgtacatccctaccatacgtcggcaggggtggtgaaggggaagctccacacccgcaaggccgcgacgacgtagtactaccacgtcagttcgaacaactccatccaggaggtcagtacttggttcgagcgagctgcgcgatgcagttcttggaattttccgcgattttcccccgtctttgtttgttttttggggagaagtttcgaagggtttggggaagctagcttacgcacgattgatggtttctccccgtcaaattttacctgaactttggaaacgaatcatctggttctcctcatagtttcggttgattgttttgattcttgtttctgggtgtttttggttcagggggcttgcttgcagaatgtgcaggcccgtgctgcgcggtccttggatttctttccccatttttgggtggagaagtttttgacgggtttagcgaagctagtttagttctgttgggcatgatttcttctcgtaaaatttgcaccggctgtttgtaattggaatttgggtgtagaaagcgcagtactactattttcctgatgtttctacagccatttcctggctaccagttctaagatttgaagttactgaaactaaatcccaaaatggttagtgctgcagtgtggggggcatttttttggttgggtaggaagcaatgtgcatctacttgtagacataatgagttttcttgaccaatggtttcattggttctaggcaatttcagaaatggtggagatagcccatgattaaggatacggtggaggggctcatcagcactggatggctggaactaatgtgtggcctttcatgccccattggttactctatatgttagcattgccactcatgtctgtattctatagcgaacacagtgcttcttgtgaagttgaagaatggggct

SEQ ID NO: 782 - DNA, 1501 bp, Oryza sativa
gatagattatttctgtaaatattaaaaaaaaaatctaaaaacgaaaaaaattcctagtagaagaggccacgcgtgtactagtgggcccagactccatggcccacctgcagtgaccgtggtcaatcctgggactgggtggggatgggatccggaatggattcatcagatcagagccttccttctcgtcatcttctctcgcaaagattcatccggaggaggagatactcctcgcctggggagtggggatgatagacctatccacgccacagcggcggcggtggcggccgcgggtaggtatgcctctgcctctctctctgtgtggtttctgatcccttcgacctacacttccagttatttgatttagcggacaattagggcaaagtgctacaacattcaagatcacaaacttagattaattgtttattggccgaaatcccaactatttttgtgacctcttaggttttcgttctttatatcttcacaaaagtgatattcagaaatttggccaaaattttcgggatggcacctttcttttctttttttttaacaaaatagtatcaccagcttatgttgaatagactgatgagggacatgaggcataatatacggaatatgatgcatgagactataacaatatgatggtatatagtttagattttaaaatttatattcaaattggctggtttgttccggtaccagtcaccgagttcagattggttacctgttggtcaccaccagtatttggatcgctgattatgacataactgaattgcaggcgggtcgagcacttcacaagctgaaagaaaggttgcaaccaagagaaaggagtttcctctccaacgagatgattcttccccatgtgacaaaacaacgaaactagatattccttcccttccagaggtacaaagtattaacaacagaagtgtccaacagggaaattaattaaatacctatatgatagtttcatgtttgcctgcacatttcgaattttagacagattagacactttctttgtacaataaaatatttgatgatgccactggtaatctgacaaaagtaatatgcaaatagtcttgttaagtcttgtgttgcataagatttgtggtttttactagttatgtttttgtgctctgtttatatgccatctttgactccacacctttatgattggcgtaatgtttatttgtttcaatggaagccatcaatgatataacaaaatgtggaatcactttagctgtaatgaataagccactaattcgacaaaatacaatatgccaatagtcctgctgagtcttggatttgcagtttcaagctacatctgctctatttatattccatgtttgactccacacttgtatgcactgtttgtttgttccaaaaaaagtgaccattactggtaacattgttttacaacaagagctactatcattctaatatcaaagatatatatttcccatgcctgcacaggatctcctgctgatgatactttcccatgtgccaa

SEQ ID NO: 783 - DNA, 1501 bp, Oryza sativa
atatcccgtaatctagacaccacgcctaaactaccagatactactctaatatcattgtcatgacatagagtaattgcataagcaaacattatacccgcaccaaagtatttcctagataagctagccatatattaagtataacatgaacataatgtaaagtagacattcatatactcggaaagtatttcaataccataaatgtatttagaagagtattctaataaaaatacaaagcttacaaaagagaagagaaaagctactagagccatacccgaactctcccgaaggctttcggactcctgatttctactctattcctattccaccagatagatactactaaactaagcttgaaagaaatgagagagctattgcttgaggtgtgtgagtgaagtgagaatgagaaactccttttatagcctcccaatgacggttgtgacggttggaatggtcggaaattccctccaaccgccattgggggctaatccacaccgttcaggcgaagccctggatcggatggcgctgaggagggttcggccgaaccccctggttcagccgaacctggggccggcccaatccagcccaatttcggctggtgacctactctgttgttcttctctgcagacttgtgaattctgacccagtttgtcacgtcaattctgagttcttggcccattcatacttaagtctggttctcgacatcgtccgattaatttatcgtttgagctgatgtcgattctcctccactttattgtcattctctgcaaaaggttagtatacctaatactagtggaatattattattctaacaaacatatgcattgcaagtatcactagttctcctctattttggtaatattgacgatcgaaacttatggataacgaccgtcaacaagtcacgccggagcaagttccgcacgtcgacgacggcttggatttggtggacgctggcggacgacatgcgcggcacagatctgtgacgggtacagtcccgaggccgaacgcggaaggggtgacgggcagaacgacgacgaccggagacgctactattgctgcttgatgactacgcaaatgcctgagagatcgatctctcaggatgacgactcgacgagagaagaaaaaaaaaacggtggccacccccgggagaccagaaccgggggcgatggcagcagaagcgtgagcggcagctataggttgcccgctctgatatcatgttggatagtatagaaggagaggtatactgcgtaacgtggtacgattgtattgaggttcaagggccggtatatataggagtacatgagaaggagaaaaggaaggattacaaatatagaaggaggccacccaaatcaatcctatcctaatatgactctaactatcatatactctaacatctcaaattgggtgatatatattgtgatgtcttcacgcatgagttggttttgctgcttggaatatattgtactcctgttttttttaaacagtaaattgatgatctgggttg

SEQ ID NO: 784 - DNA, 1501 bp, Oryza sativa
acaataggataagttcgtgagagtgagaccatggcaacgacattgaaagctgaagaagaaatgttggttctttttatcgtgatataattcaaaaactcaagtcacaaacgtgcaaaaaaaacataaggtgagatataccatgcttgttttcctccaaaattccagcccatttcataatatttttaacggtattttttttagaaaatgggataaacccagtctcaacatccaatcagatgtacacagccaaatttttaacggcattgatagggattaaccctttttgtttcaaaatgctgcatataattacttctcacaagataggaatcctttaaaacttatagtatatgccttttcttttgttccaaattgggcttttagcagtaattccacacatactctatctggctgtctcgcagcagcagtggcacaagtcacaagtggaaatatgggcgcgagcagtcgagcagcgcggcgcagccaccgcaggggttgatgtggtgacggcgtcgtcggcgcaggatgcagggagccaccgcgcgcgaccagcacacctcctggccgtggccgctgccggaggcatgacatggggttccgcgcgccgggctggctgatgaagactggtactacaatgcggcgggggtcggcgccgtcgccggctcgcacgggggtcgatggctggcgctggttccatctattcatgggggctccgcctccgcgtccgggatcattcaacacggcgagcggccggaacagccggatcattcgacgtctccgggtggcgtttcttggcgctggggaacgcggcggtgttcgtcggcttcgattggcaccgcgtcggcatccggctaaaatgccggagttcggtggcctcaccggcttcaacttgttcgacgcagtgggcgtgcccggagcgccgccgcttcttctgtgcccgtgaccactacacgttctctgcaaatgtggacgcggcaaggccgtgatgctgggcctctgacgatcgtctcccccaatgagcgcgagctctcgtttcccccaatgagcgcgagctccatccgtcgcaacgccagcggaggggatcccggccaagaacatggcggagcgcccgtcgccggaagaagctcaacgaccggctcaagttcttgattgtgattaggttggttaggattacgcaattttgtttcatccgttagttagtctgtcatggtgtctcaaaaggctttagttatggcgaatttggtgtgtatttgtttgccatggagactggagagtgaaagtaagaagatagaaaaaaaatctatgtatatcattgctcccattgttcatgtatgtcacatgcatgcttgaagcaaaataggtttggaactgtttttcgtagtgagcaacgggcattccagttggaattgatgtcaaatatgttcaatacacatagcctctgtaaataccaaaaaaaagaaatatcatctgattgcttgctttaagctgggctataaatagtcca

SEQ ID NO: 785 - DNA, 793 bp, Oryza sativa
taaatatgtcttttttccctgagaattaacggtcaacacacagtcaactgacgggagtggcatgagagggtgtgcaaatttggatcaaaggcatataagggaagagccaattttcaatggcatataagggatcaaaccaattttcagtggcatataagggattctctcttttaattaaccaacaccggaacggtggcaataaccaacatcattagtagaatctgatacctatgcattaatgtagtccaccattgtgtgctagttgaactaagcaaggctaggaacttcctaatccaacagcgaatcattttacaaccccaagctaacaaaggagcgaggtacaaaaatagcatggctgtaacagtaggtaaatatcccatagtaacaatttaaaacaatgcagtatttaagggaaaacggtagagcatttgcaacataggttcaatatgttcaagtgataagcatgacttgccttgctctgctgctggaggagcctcggcgactatttcaaaatacaccggagcgttgggagagccggaatctaagcgacatacaaagcaaacaatacaaacaggccataatactactgaaacagagaacaaaaccatttttaatggattctatgcatttttcttaatttactgagacttgaatgggcttaaacggagctcggatgaattttctatgaattttagaagattcactgtgttttactataaagagaaaaaccttaattatttattgcgcaatatatcccagggctgacgtcatcaaggagggggcggcgccgaca

SEQ ID NO: 786 - DNA, 1501 bp, Oryza sativa
cagtgttgcagctatactagaggcaatgggccagcaaggaggacgcaaggtaggcaggacattgaatgaagagttgaagacatataactgagagtgcgggtggagggccagtgagccttgtaatatgtgagaggtgctcaggccaagtctagctaactactagctggaatagactataaggacagcatgctgtatcacgtacgctgttaagcaatgaatgagggaattagctgttcttctctgcctcttccttcttcttcctcctgctaatccatggggatgtacagagcaggcactgaaaaacagatatgataatgaggtaaatcatcatttctaattagaaaacagatgttaagaaagcgatccacatccattacaggggaagggaactggctccaatcagtgctagagtggggacacatacacacacaaaaaatatgtaaaccaacctgaccaatttttgttgtttgggatggacacgctattttgagcctgactcattgaagagatcaaatcccaaaagaagacatcaaatatgaataagaatattcttgagagctcacttgtgtatagccaattgataatctcatcgcatagtcatttgtgatatgttgcttctctgttcctgtaacagcatcatggtgctgagcaagagctagagcatcagctaaagtatctgttgtgagatttaatttgctttccccttaaaagaattccagaagccaagatgcctgaaaagtgaaaagaaataagatattaagcatatggcaccacaaagtaccaagggaacaagaaaatatatcacatttaaattggacatgtgaaagccagaataatgaaaagggtggtaaaaccaccaatcatagcacggactgttgttttaaggaaggtcttcttgtgaaggaaccagtccaggcattcgggttgtccgcataccaggtgtaagaaatacagtcaaatgcatgtgaaagaaacaaagtgaaattacccataccaattatgaatatgaaaatagaacatacaggtagaaatcatttgtcttgagaggccatggctcatttaagcatattttgcatcagtataaatggaagacatggaatagagagcattggcatggccaattaagggaatggaataaacacgttgaaatcatcatatcacaagttcaagatatctgcattatgtaatgccatgactgcaacttcatggtgaaaccaaaacaaagaaactaaacaatagtcagtattagtaatattaatgatcatctttaaccttattgacataatgaattagtttgtccatcattctgaaccaactttatccataatgataaatcataattgaattttgaagtctgtatccattgtaatcatggcatggtttgtcgtcataatatttgcctagagaaaagaaggaaaaaacatgaattaggatgaatcattcattcctaagcagatcgatagcttcaagttaaaatgttgatattcagaaataacttttg

SEQ ID NO: 787 - DNA, 1501 bp, Oryza sativa
tatctagtttcgttgttttgtcacatggggaagaatcatctcgttggagaggaaactcctttctcttggttgcaacctttctttcagcttgtgaagtgctcgacccgcctgcaattcagttatgtcataatcagcgatccaaatactggtggtgaccaacaggtaaccaatctgaactcggtgactggtaccggaacaaaccagccaatttgaatataaattttaaaatctaaactatataccatcatattgttatagtctcatgcatcatattccgtatattatgcctcatgtccctcatcagtctattcaacataagctggtgatactattttgttaaaaaaaaagaaaagaaaggtgccatcccgaaaattttggccaaatttctgaatatcacttttgtgaagatataaagaacgaaaacctaagaggtcacaaaaatagttgggatttcggccaataaacaattaatctaagtttgtgatcttgaatgttgtagcactttgccctaattgtccgctaaatcaaataactggaagtgtaggtcgaagggatcagaaaccacacagagagagaggcagaggcatacctacccgcggccgccaccgccgccgctgtggcgtggataggtctatcatccccactccccaggcgaggagtatctcctcctccggatgaatctttgcgagagaagatgacgagaaggaaggctctgatctgatgaatccattccggatcccatccccacccagtcccaggattgaccacggtcactgcaggtgggccatggagtctgggcccactagtacacgcgtggcctcttctactaggaatttttttcgtttttagattttttttttaatatttacagaaataatctatcggcgagaaaatttgcaaaaatagaccctgccgctccaatggtgggcggcaagctgacgtggcaaacgggggaggaacgggcggtgacggagggtgggtattttgcatgaaaacccttgccgccctctggtggggcggcaaggggtccgaatgcaaaaagagccgcagggggccggccattttgcaggcggccccttgccgcccactagccgggcggcaggcctcgctgcctataaaaggcctgccgcccagcccccagccctcatttctcacctctcaactccagtgaaaaaaaagaagagaggggaggagaagagaagaaggggcgaagccctgccggattcagacgccgatttcaggtaatattcgtatatcctatatgtgactattgagttaaatagtgtgtatttttaaaaaatttgtttgaataaatgcattatatttttatggttttagttgtactaatttagaagtgtgtattgtagatatcggaacaacgtagatctgctagtttggaatcaatactttaccgttgcattggcttacacaagaagatattacgttgtagatgtttattgcatgaaagagtaatatgatctagttaattcgttgacagata

SEQ ID NO: 788 - DNA, 1501 bp, Oryza sativa
acggcacaaaaggctatcatcgtgttgggtacttttgccggttttttctccagtccaagtgtccgcactgctcacgcttggactgcgggggatgttaaagtatatggtagttagagtcatattagaatatgattgatttgggtggactcattccatatatgtaatcctttcttatcctccccatgtacacctatatataccgccccctgagactcaatacaatagttttatgttacgcagtatacctctcctcctataatatccaacatgacaatccaaagcaaattaatattaggagacttgcaatacctttcgacgtgatcactgcaaaatcagtgtgttctaaagatcaaaattcatacagcaggtgatgatcgagcatattgacaaatgacgaatacaagaacgagagtgtatccacgcaaaaaccacgagccgcttctccgtcgatcgagatagtacgctatgtcaccacgagccgcttctccgtcgatcgagatagcacgctatgtctccagggacgctgcctccgtgtcgagctcagccgcgcgcctctccagcgcagaggcccagtcacgcgagcggatcgtgtcaagcaactcgctggcctggagaatcggctcggagaagcgcttgatcgagaggtaatcgaggcaggccgaatcgagagcgcggaaatcatcgtggtcgatgtggctgaggtgaagccataccttctccatctccttgccatgacggatcctggcacgagctacctcctgtgcggaggctatctcgtcgtcgtccagcgacaccaagtcccacaactcggaggggatccgcttgccatcgaccatgacctcgtcctgcttcccctcaacctcctccccctccccctgctcctgggccatcgcggcgtcctcgacgatctccccctcctccaggtccatcccggcgtcctcgacgatcctatccgtcgcatcggaggaggccccctcgccgccgcccacgaactcctcctcctcctgctccatcgcggcgtcgtcgactatccagtcggtggagtccgaggcgcccttgccgccgcccacgaacccctcctgctcctcctcctcctcctccccggcaacatccctggcgcggcgacggaaaaaactcgtacatggcgttctgctccactaagatgcgcagcagattgcgggccacgtcgcgcgtgatgccttcctccggctcatcatccacgacgagcagctcgcgaagcttctccgcgcggttgcggaactccgcggcgcgcgcacgaagggcggaggctgtcgtggtcgcatccgccgccatggcgtatgcgtgggcgtgcgcgtggcgtgagagagagaggagaggggtcacaggtgggaccgtgggaggagagagaggaagagaggaggaggctgagctggaggaggggaatacgatttttactttatggtttggactatttatagcccagcttaaagcaagcaatcagatgatatttctttttttt

SEQ ID NO: 789 - DNA, 1501 bp, Oryza sativa
aaaatgtactccctcgtaaaataaattaacctataataggatttgactcatgttcctgtctagatttagtattaggctatgtctcgtactaagattaatttattttgtaatagatgaagtattattttgtgacggagggagtactgtttagagcatgtacaatagcacactataagccaagctataaacatgtatcaagaagataaaaaaataagagagaagatcaatgggaccatagactataagatacaatgtgtatgataggtgagatcagatattaatattatagtatacgtggttgagaggtaactattatatttattaaaaattattatatatattagctattaaattgactagattatttagagggtgagtctaattgtctaactcgcgcacctgcatgagggtgtgtttagtacacgctaaaattggaagtttggttgaacttggaacgatgtgatggaaaagttgaaagtttatgtttgtagaaaagttttgatgtgatagaaaagttggaagttcatgtttataggaaagttttgatgtgatggaaaagttgaaagtttgaaaaaaaaatttgcaactaaacacggtgtcagtgttattttgtctgagtgttattaatgatcctcaagtcccgtgcctgcctcgctcacccgcagctggcgtggcccgccggcaaaacccccctcgccatcggcggccggcgagagagcgacccttctctacggctcccggctccactcacgatcccccgcccatgacacacccacacccaccattgcacatgtggacgtcgtgtgctcgtgcaaacacacgtggtcgccagctagcgtcacagccaggtggggcccccccaaaatcccctccttcttccccggccgcgcatcctcccttctcctctcctctgcaaatctctgccgccccggtttcccatctccgcccgcagtaaacccctcctcattcccaccaccacctctcctcggaggaatctttgctgctttcctttatataaacccctctccagtctatacttccactccacactcccctccacccccccccccacacccgcagcagcagggagaaggtatgctccatccaagatcggatctcatcatcctactgcgtttcttgatttcctttttcttttcttttttttgttctctatcatatgtcccgggcgcggcacatggccaaaaaccagagaatttccggcgctgttctctccgatctagagattttcttttcttttttttctttcaaaaagtgacttttgtttgtcatgtggaaagatgagtgtggaagaacaattgtatttttttccactgtttttgatgctgcatttgtgttctttttctttcctagagtgtcttcgatgcgaacgaggctttggaatcttgtttttttttctttttcgtatgtgtcatcttgattaatctgtattatccctgatctaatcgatggcaattggtcgagcagacgacgacgaagatga

SEQ ID NO: 790 - DNA, 1501 bp, Oryza sativa
aaatgtatttttgatgtttttaataattaatactcaattgattatatactaaaagtttatatgttgttgcgtgcggctaatcatccgtttcaaaatgaactttagaataggtcctttaagtcgcccccaactttgggggctatttttaatacaaagatgaagtacactactaaaaagggttttttttcatgtggctaaatcatattttcataggcggagcccccaagtgtttgtgaaaaaaggaatttttgcaggcaggtagcacaacaacttgcaaaaagtattttcgcgggcgggtgttatgtcgtccgcgagcaaaaacaaaaatcgcaaaaaaaaaagctttttgaaaccctagttcaaatccaccctagtcgttgtcagatccgcgagggaggtggtaaccactgttggatccatgaggcagagggttgttgccatcgttgtcgatgcaatctgccgccgttgtcgtcgtcattgagacctcatctcacccgaggttgacggtggcggatccgtgagggagagggccactgtcgtcatcgtcgatgcagtccaccgtcgcatcgtcgagaccctgctgcacctaaggccagtggcgcagatccgctactcccgaggtaactgccatcagatccacgagggagaggtccgctaccaccagacctgtgaggggagccggtctctcccgatgcggcggagacgccctatggaggctaaaaaaatcatgagatacacttgctcaaaaaaatttacatatatatgatacttgaccaaaattattaagcatgtgacatgtcatcatttatatgcaatctgtacacaatagttgagcattgttttatctccaataatggatcaaataaatttatacgaatcttttttatccaggtaacacatactctttatatatttcttgctaacaaacaaacactaggatacaaattggtattaccatgaactattgtcctgtgattggtgcaaatcagtaagcaactactactaagcactgagatgcaagaatgtacctttcttgcaggctggcactctgaggagaacaaatcaaggatgctccgctgcttgacggagattagccccagccacattgctggcaacgccggacggcctgctcactaagccgttccgctgccgcgcgctgctccgctcgaggctggccgcgggcatcaccgtcggccactggccgcgcctctctgcccgtccagcgcgccgctggctgcgcctcttcgcctgccccgcgcgccgctccccacgcttctccagcgcgccgctagatccgccgctgccagcgcccgccaaaccgctgccccacgctccggtgaggaccccggcagacccctcaaaactgcgctcaacgagtaggagcaccacggcgctccagtgatgctcgcgacgatgacggaggagccgcacagcggcggcggaggttgagattggagtcgccaggagaggactgcggtatgggctcaagtgggaaggttga

SEQ ID NO: 791 - DNA, 1330 bp, Oryza sativa
ctttccctacacgtagtaagtctgttctgtttttgtacttcctccatcctataatgtaacaatctagtatgggataagaccttatcctaatacaatgtatctagacatgtcctaggttgggtctcagattactaaattttatgacagagatagtaactatttaaactcatgtttctcaattactctatctaattatatagacttgctcgttaaaacctgggtacgtggtaccgaggttgagctaccgtttatactactacgatggtgcatcccgaatagcaagagtacacgtgacagtccatccgggcggtgctgaggcggagcccgggcgcccacagacccaaagctaggacggacgaacggtaaagcgaagaagcaaagcaaaggccccgtccctccctggctgcagtgtagtgtagtgcagtgcagaccaagataagggcaagggcggcccctccccccctcgtgccgccaccaaaaggagaagacgcgagaagacaagcaatcgaatcgaatccaagcgcgaaaacccacggccgcccccctcccccgatcagggtcccccgttcggtcggctaaggtttgctactaaaaacatgtgtaattttttgcccctctgcttacggagaaacacgcgatgacgccgcgcttttataaccgcgcgtccaccacgattccccctttactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgcagtgccaagagtccaagacccaacaagggggaggacggaggaggcgaggcagaggcatctcaccgaagggggaagggcgacgccatgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaaga

SEQ ID NO: 792 - DNA, 1501 bp, Oryza sativa
gtggaggccggtttgattccttctgcttcgcacggtctgaacagagagctcgggccgacaacggtttgatactgggcctaactatgaatcaagttcaaagttcaatactggccaagatttgacctagtttaaagtgcgaggtgatagctaagttcccttcaaaaaatggcactgcgatgcaaaattgttactagtatttaggcctgttcattggttgaagttgggaaattctcccatatacaaggaaaacggaacaatgaattgacacgtaattaattaagcattagttaaataaactttaaaaatcaattgatatgatattttcaaacaactttttataaaataaaatttttaaaaacataatgtttagcagttcgggaaatgtgcgtgcaaaaactgaggagaaacggtcgtaacatggacaatagaaaatatttcatccgtttcaggttataagacgttttaactttggtcaaagtcaaactacttcaatttcgactaagtttatggactaatatagtaatatttataataccaaattagtttcattaactcagtaattgaatatattttcataataaatttgtcttgggttgaaaatgttgttattttttctataaacttagttaaacttgaagctaactttaacaaagtcaaaacgttttataacctgaaacggatgtagtattatggtagcgtagctgcattcttggcacatatttttaaatgccaattttatgattcttggttaaaattttaaatgcaatatagaagttttgagaaagtttcgtataatttaagttgaaagtttcttatgtgttgtagcagggggctaaacatcgcatctcctattggaccgaaatacggtttctaacacccacatgttatgttttaatccaaggcaaatacttctcgagccttcatgataggtgaataggaggcgttcatgtcatcagatgcaaaggttggccagccaggagaatagtgttcgagcacattgcaagagaaacatgctattcgataagggggaaaggaaacttgatgattacaccagcgaacgagaaatattccttaagaagatgtcacgggggttgcttcaaccacttctacaaactatgccaatagtcttagggaccactcaagcacatatctatgttcttaactattttagggcacattatagtaacttctcgtgtgtcattgggtatgtttttagcttcatatgtagagctggaggctatataagctggtcctatcctgtagcaagacacggagcatattcatatcaatataccacatcgtataacaatgattacattttgagttcgtgaattcgtcttgtctttagaataagtgggaaaaggagtattatttttttcctacccctgattcaagaggaaagaagtatccgttggcaacatagctgtgctaattagcaatcgtcgatgcgtttgagatactcgtgaacggtgaaccgtgatatgcctctgcattactcaga

SEQ ID NO: 793 - DNA, 1501 bp, Oryza sativa
gttcgtcgtcgcgcgctggtgcgtgtggtgtggtgtagtagtctcccccacaccgccaagtcgccaacgccggtgaccagcttggcgctttcactgatctctcggcacgcagtctggccatccatggccgcctttttctcttttccgggctttttgcctttcacccagtgtgcctttaccgggattgccaaaatcttttcagtaatcccatcgtgcatatccatacgtacacgcctggctactacaacgtacggcgactatgtatatatatatgcattgcaacaatttgcaattgcgattgcatgcgtgtcagagatcgccggaggccgtacgtacatggatatgtctggttcaacacattctctcttctcgctggccactgtaattccaccgaaaagtagctcatgcattccctgttctgatcgatgggcctctaacgcgtcgcagccttgttgtatcattgctgctgagtagcaaaagaccgaccgatttgacggtccccgacattgcatggtgtgtcacttgcattgcaccatgcatggtgtgtagagacgacagacactcccctgcaggcaatggacatggcatgggaggctctagctgaatgacactacaaattaaagctatctaagcctgagtacgtgatgaccagtgtgaccaaggacacaggaccagtgtagtccatgccacaagctaagcttatcgatcgatctatggatcctgatgatttgctgtaactaaacagtaaaatatgttattttgcaaggaagcatgcacctcgttttcctgactgtacccagcaacttttgcacgagaatgatgtgtgtcactctctgtatcattagctaagctctgggatgatgggctttacttacctgcaggtagtactgctgcttttgctgatatattgccgggggttatcagggtttcaggaaagccatgttgtgtactcctacatgtaatgtgttcatagagattacagggtactgctgctacatatgcagtgtggaggaatattttttcagtgcgtactggaggtctggagccatggctctgttgatgtgcagtatcctgttgcgagttcaacgatagatggaggcgctaactccaaggtcaacctcagcatcaatcattctgggtctcgctttcgtttgcatgctttgccaatcatatatactagcatgttgccgcttcatcgatggcagatatggaggtttttgatggtctcctcatcgatagccccctctctgcctgcggctaacctagctaaatatatagagcaaatatatatggcaaatcgatcttagagattgcggacaggaatatacttttctgtgttttgctttgctttgcttctagctaggtctatatgatcatgcgcaatcatatatgcaggtatatatagatggagttgtgactagctagctagttatagagagaatagcacacaatatgcaatgcattcagactagcagacagcaaagtaagcagggtaattact

SEQ ID NO: 794 - DNA, 1501 bp, Oryza sativa
gtaggaggtggccgggtcgagcggcgccgtgttgtcgtcgccgccggtggggttggggcaactcggcttcagcgaggtggcgagggtggcgtcgaggttggtctcgttgtagaggcggccgcgaaagttggtgcacctggcttgcccgatggtgtgcgcgcccgacagcgcgatcatgtcgctcgccgtcaggcccttgtcggagaaggacttgatcaggtcggcgaggtcggacgtcggcggcgggaggtcgttgttcgccgcgtccaggctcgccgtcgtcccgtctcgccggcccagctcgacgtcccacgtcggcccgcccagctgcacacagttcgttcgttcccgatcaattcatcaaaaatacagggatcggagtggtgatcggccggtctggtgcttacggcgacgacggagtcgcgggcggcgacggcgaggatgtcggcgcaggagacgacctgctcgcaggcgtcctcgagctgcgacttgatgtcgtcgacgacctcgaagccgcggagggagttcttgttcggcttcgcgttcttctcgccggtgatggccgccgtgtcgtcgagcagcactgacccgtcacacccctgcacgcgcgcgccgtttttgaggtcaatggttagtccttcgaatttgaaaaggttaacttttaagtagacttttcgcgcgctttctgcatgcacaccacttgcttaactgacccgtcagcatccactctgaacttctgaattatatctattatgatttatgaacacgggaaaaatcatctgaatataaaatgtttggcgactagtaactaagtaagtaaactgtagcgactagcgaatttcgaaattgaaacatctacttcaaaggtcggactagaaaacgagaaggaaaactgaacttaaaagggtgagttgtgtgagacttgcattgacaaagcagtcgtggaaatggaggcgcagcagcgaagctcccatgcgagactccttggaaacggcgtctctgacggcagattcgatgatgtcgagcgcgtcggggcatgtctcgtcgtagaaatcagtggagagctgcgccgaaacaacagcagagaagagcaacgcagccatggcagagcagacgaagatttgcctggaataagccattgcttaaccgcaagctaagcacacaattaagtatccagatactctctctctgtaggctgtagcttcagtgtctttgttacactgaactctgcaatgcaaggagagctacatgagcggcgggatttataggctagtgctgatgaggttactggatgcttctccaatctgtcagtttctgtcaagctaccgattggatattgtcgagtgcgtcggctttccttgtcttccattgtttttaactcagtggactacaaccagaaagcacggaatgagaagtgtgatgaaaacttagtttacatgcagaatgctgctacgatctgcaacatacttgcactttttacctggcgtgactatcatacaca

SEQ ID NO: 795 - DNA, 1501 bp, Oryza sativa
catgtgccattacagactgaagcgccgtgatcagtgccagaatagttttccatcaagactttgcaaccgccaaatccaatatttaactgaatttcagtttaaccatatttgattccatggacgatagtgctcctctgcctagtacttaaatgtggattaaaaaaggatacagtgacgcagaaatggtttcaatttcagatgaaagtgtctggtttagtggttatctgcatctccttcatgggttctcctctagttaggctgctactactatcacctatcagtaccattgtatcagagttcagtaaacatttaagtgaaacaggtttcagtttccaaaagaatgttcaaaaaaaatttcagatggaataagtgaaggcaaaaaaatggcattggaattacagacagacacaaagtttgggagatccgaagccatgcatagagtattgtgaaacaactatgagctttgctttgcttatagctcatgtttaattggagtatttactccacactccaagcaaacatgcagcatgcctaatttgttgacatcggtcagactcgctacgacgaacggcactgctgttcacacctgagttaaggactagcagatggagatttaggtctcataattttgtaaattatcgccttattggtttctgaagtcgcaaagtcgcacgttaaaccccattttgcaaacctggacccgcatatgtgggttgcaccttttgaaaccacgaccaaagttggactagagaaatgcaactatgcaagtggctggatcttgcttgattctgatctactagataccaggcaacaagggagtagcagcagcatgattgtctcaattatcaccatgaataatcatgtacgtacgtatgaccaatacagccttttcaaacctgttgttccgcatagtaggtcagtagtacaattgtgaacttctcaaattcaaggcatatcttcgtctgctctgccatggctataaaacttatttagttatgtttagttgttttttcttgttatacagaattatacaaagtgaatttggcatgtactgaacttccttagtgctagtctgctagacatgtggaactaagctacataacagtgtaaagttttatatttttgtgtatgatagtcacgccaggtaaaaagtgcaagtatgttgcagatcgtagcagcattctgcatgtaaactaagttttcatcacacttctcattccgtgctttctggttgtagtccactgagttaaaaacaatggaagacaaggaaagccgacgcactcgacaatatccaatcggtagcttgacagaaactgacagattggagaagcatccagtaacctcatcagcactagcctataaatcccgccgctcatgtagctctccttgcattgcagagttcagtgtaacaaagacactgaagctacagcctacagagagagagtatctggatacttaattgtgtgcttagcttgcggttaagcaatggcttattccaggc

SEQ ID NO: 796 - DNA, 1501 bp, Oryza sativa
tcggcgtgggcgcggtgtccctcgccgtcttcgccgacttcgcggtagcacttgacgtcgtagctcatacgcatatacgctgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcacatgtatatatgccattacgtgcagcggaggagtgcggatgcggggggtgcagcggaaggcgagcgcggcggaagagcggcggcgggcgagcgcggcggtgggcaaagcagcggaaggcgagctaggcgaagcggaagacagtggatgggacgaggagctcccccgtgctcggccgccaccaccgctgtgcccccgcgggtggccgacgatgctaggagaggcatcaccggcgggagaaggggaagaggcagaggaagagattgtttattggtcgccggccgcctccccctccctcccaaactcgctggccgccgctccgccaccgcgctcgcgctccgctacactgtccgcggcctgctcgcgctccactgctcggcccgccgccgcgctcgcaccttccgttgcttcgttgccacgctcgccctccgctacgccgcgtagcctcgcccacggcgacgacgatgacggccacggcgcgtggctgctccgcccacagcctgaaggagaagaggagagagaaaagaaaagagaagaggagagaaggagaagaaaagaggaaaaaaaagatgtgcaactgacatgtgggctctacggtgtttttttaaaaaatttttgctgactaggatgccacatcagcaaaaccggacgaaaatactgccgagggacctccggtgaacggtttgagtgagtttaggggtacacatttctgattttgtggttaagggacctcaaaaaatctcgctgttaagttgagggatctccggtgaacttattccccaatttgtacagttttttttctccctaattatttgggcctgaagctgtgggcctttccgatcgagctgtaggcccggaaccttggcgagtggtgatgtgataacgtgtggtgggcacagtagccccccgaagaaacacagcgaagctcccatcaaccgacaaaagaacactgtaacttttactccaccgtgggagggggaggaggagcaggacaggcacgtgggtcccacgggctgattgaatttcgtggccccaggtatcaactgcgatcgggccctcacacccatgcagcagcagcaggaggcagcagcagcacagtcaaattaacaatggaccgctacgtcgacttcggtatagtactggatggctgctcgctatcaacggctctttttcaaacattctcccgagtatttttattttccggcgaatcctacattcctaccattagcacattagaatgtttttcaggtgaggaggtaggt

SEQ ID NO: 797 - DNA, 1501 bp, Oryza sativa
ctactcgtcaatttaacacttcgttccttccttgccgttggaaactaatttttctcgcacgcaaaacggagcaactcattaacataactaagtattagttttttttaaaaaaaatagattaatatgattttttaaaagcaacttttgtttttttaaaaaataaacaaaccatttaacagtttaagaacgtgcgtgtggaaaatgagaagaataagttataaacttaaaaaaataatgcagttcttggattctaggcatctatcataggacgataaaaaattcaagagtaaagtgtacgggcagtctttaaacttgtaggggtatgtcttctagatccctaaactctcaaaatgcatatccaagtcccataacttgtcatagtgtgccatctaggtcccaaatcactaaaacctcttcaggttcttacgtgacgttgatgtgtatgcctcacggacatgatatagaattattttgactgacaaatgggacccatttaattttttttcctttttccttttcttttatctttttcccctttcttctcctttctctgtgacccgtgcagaaaaaaggaaaaaaataagaatgagaagaaaacgaaaaagaaaaggaaaaagaagaaaaaaaaggaaaaggacacgtcacgtccatgtggcattgccatatcagcgccacataggatcttagaggggatgtgctaatttgggacctagatgatgcactttgacaagttatgcgatccggatatacattttgagagtttatagacctatatgacacaaccctacaagtttaagtactgctaatgcactttactcaaaattcaatatcatgctgttcacggttaagagagaaacaaaacgagcatcgtagtacgtaaacttgtttgaaaaaaagttttgtaactgcgaacagaattacagaagactacagtaatcagtcagatggaaaaggtatacctgaggttcctctcatcatgtcacgagatacaaaatcgtgcttttcaaccgtaaaactggataaaacgtatcccccaacttacaaaactagtacagagtatgatctttgaggttttgctatttcacttgcgatagaattttgagttcttatactctgacttttcacccgtacgatcttgtatcaagatttgtgttcctatgaattcaacttgcaaagttgcaattacatttagttacaaagtacttatatttggttatagagtatttacacttaattacagagcaactacactcttacattaaaaaaacatattttacaacagcttctttctcaagatttatgattttctatatgtttgtcccttttcttttatttcattcaaaaatggctatatgtattggttggaagttctgtaaaatttgaagcttcaaatctattgaaatatcaatgggtagtctcgtatttttattggcatatatagagataaaaagtatataaagtttagtttagtgtaaaactcctgacaattagattttcttat

SEQ ID NO: 798 - DNA, 1501 bp, Oryza sativa
atgtttattggcaggctttattttgttactcagtatgtaactcagcttttatcatttttttgattcgtttgcagctcttaagtttgactactctcgggttattgatacagcatacatctttaagtatgcaaatttgcctactactgcatcagcctctttaaacagcctgtgcaaggtacagttaaagggatactgcatagcatcttatttactcgtagccttgtttccttatgaatgatgttctgcttaagaaaaacaatgcatacaaggcctgaagaaccccatgctctgaatctatgcatgctgaaatttttttgttgatttttgtgcttctagtctgttttgggctatgctgttcgagaagaaggggagccacataactgcttgaaggatgcagaagctgcgatgaatctagttctcgccaagcttaagcatggatttaatgatcccattgaaattgcaagagatagtgtaagagtaaacaattatcttaaacctcagcattgttagggagttgccaactgacttgtttatttccatttcttaggtacctgaatctgatatgatgaagttgcttgctcacaaaattccagtctacctgccttgtcaggagctgctcaaattattttctggaaatcccagtattgatgagaaggtttttgcatactaattatgatttgctcaatacacatgtacttttatagtctaatggttttatttccttctcaatagattgattcaagggttcggggtgattattattctacatgtatttcatttggagacagagatgaggtagagaaggcatttgatgaactggatggccaagaggccaaggtacgttataccatttgattttccactaattgggttttgcccttgtgcttatcatttgattggttgaattgcatcaatgtgctgttaaatttctcagttctatactatgctgaaacacacaggactctagcgggcgacttcaaaaaaatgtgctgctgaaacgcgacaatggggatgtggcaagcttctatgtacgaaagatggcgtatggcgctcaactaaacaagtcagaactttcaaacaagagaccgccacctaccgagcatgtagaaccaacaaaagaagataatgatggggataagcaaaaaaagcgaaaaactggtaaaaagcatgagaagaagaaagcaaagatatcagtggctgaatgaagatctttggagggatgattttgagatgcagagagattggatgaatgaagctggagaaggatgttgagaccattcggctaggagcagttttgatctcaccatgagtcatgagaggaacaattttgatctctagacgctcttcttgttcagcggtttgtgcgctttagattgctaggcattaactgtagaaagttgttagggctcattttattcctccattttatcgactgttgatcacgagtattagagagggtccaggaggatattcttaacgtaaattcactgcaaactctttg

SEQ ID NO: 799 - DNA, 1501 bp, Oryza sativa
tgaaactatattttgcttccgaggagattaaaacgaatctgggaagaacatgttcttgtttatgcctcgttccaccggatcagctactattgttcgtccaaaaagaatgcaagtagcagattaattacactccacgcccttaagaattcgatcaaaatcacgcacgtaattactctgcagtttccacggaatccttgtttacactttcctcattgtgacagatacgaatcagggtgctaaaattaaacccgagattacagcggagtatattccgaagaacaggaatcttctgagtttactccagatataagcatttattccttgcctttaaaggcctgatatctcacagaatccattagtttcattttgagagtggaacggctgccatttgtaaacaaccttccacaatatttcgctgtgtactagtactatactactatacacagaaatctaatatgcgtcacaaacaggaaagaactggcagaaaaatatacgcctcccactttccttgcaaaactgtaggatatccaaatgcatcgcgaatcgcagcaaaccgagaaatcccacgggaaactattttaatccctcgagagaatatcccctcgttctttgtatgtcactcaaatggtcatgaaaaaaattgaaaaaaaatgagaatgtgtattaacatgtgatataatactctacaaacatgtaagttcaaattcaactcctatatatcgtaacgaaagaaacaaattaaactgtagctagttaacatatatttagagtcaaatttgtttttttcattgtgagatgtagaagttaatttttttacttgcctgtttgtacagtgatatatcacatgttaatatattttcttaaatttttaaaatttttttcataaccatttaagtgacaggcaagcaacgagaggatatccgtccgagggatcaaaatcctcttccgaaatcccacccaaatttcattcctgctgaaggaactagaagctttataaccgcgataaaaaatacaagcgacagcgatttaggcagtagaatcccccgcgacccgaggagattagtctaattaacaagtgcagattccctagcatctcgtgctgtgtttaactgcgtgagtgcgcatccgcccctgattcccaacttgcgcctgcttgtctggattccacagaatcacgcctcggatcttctgcgccaacgccgccccccttcccaaaagaaagaaaaacaaacaaacaacggcgttggctacagttgggtgtcgcccagcctggctcgaaaacacacacgcgacgcggtcgcggtcacgcacaaaatacacgacccatgcggtgccccctcccggactcgagttctccataacccaacccagcggcggaaacccctcacgtccgacccctataaatacccaccatctgccgcgccatcccatcgcaacgcacgcacaattcacagcaacacaagcagaagcacagtagaacgcctaggaaatactacgtcga

SEQ ID NO: 800 - DNA, 1501 bp, Oryza sativa
gatttcgaggatcaagctccagatctcgagcaaggcaagccacctttgaacatcttgagcctatatttgaaatttaattatgttgcttgcaaaatattatgcattgataggatcgcacttaatctgtttgtcccgtctacaaggcagattggcggacctacctaatttgtcgcatttgatccttcctttgttaattgctataccatgtccccttgtaaccacccagttgcgcctcgatactcgtgcactctgtgcaagtatcgacggtcgccttcaaccttaaaatctgagtaacaacttgggtaaaactggagttttacaaaagacttggaaaacccgacacctgggtcggtgcctccgaaccaaatgaatttccaaaaccgcggaccggggatcctaccgggtgtacggtttcccgctcttgcacttaaggaccgtttccttggaatttcatccgaacataagacaagtacgaccacatgggtggaatgggacgcccctggctgagtaaattgctaatcgggggagctttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggacatgggcggatctgaggtgattcctagcgtagttttgtttgtctactgcttgtgaaattgctgttgtgaaaaggggttcgatgtttgaaaaatctgcagctgatgggatcagctaggcccgagtggccgtttgaaaagttgttggcccgggtggccgtttgaaaagttgttggcccgggtggccgtttaaaaagctgttggccgggtgccaactttgttgcaatcctaaagattgacacattgcacatactccgaccggacgagacgcactgtctcatccgtgtcgtttgagaagcactcacttagttgttttcagaaaagagttcaaataaaatcaattgcaaaaacaacagccttcccttgaagcctgcattaaacacttatttcccctggcttgctgagtacccccgtactcactcttgctctatataaatatccccccccagttgctgaagaagatgaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgctgtgatattctgtctc

SEQ ID NO: 801 - DNA, 1501 bp, Oryza sativa
caggctttctggaaccactagccctcctcaaggttgaacaccgaaattactacgaaatacagaaatccgcactaccaatcgcagaactctctttccgattcccctttcacccggtgaaatttcacgaaatgcaaagggggactcagaagagggtttcagaattcagacaactcaccagtacttgacagccttgcactgcttgcacctgaacgtcgtcggccggaagcacaccgcgcagacccccttggcacccaccggcggctgcggctgcggctgggcccgggcctccatctccgcctctgcctccgcctgagccggaaccacggccggcggcgccccccacgccgcctcatccaccatctccgtcgcgtgcacgacgctcgggaacagctccgagtagtaggcgcgcgcgcactccacctccgccatctccgactcctcctgcgccagccgcgtgagccgcagcacctcctccctccgcgccgcggcgcgcctcaccttccgccgcaccacaacccacaccaccaccaccaccgcaatcaccacagccaccaccaccgccgacgccgacgacgacgacgacgaacccgccgcctccgccatccaccacctcctcctcccctctcaccccgctcccctcctcctcctcctcccctcccctccccaccgcatagatctcgccgcccaacctcctccacccaccggatccgcccgccgatcccgaccccgacccctcccccgcacctcgccgtagccaacccgccaaaatctagggcttccaattttttcccctccccttctctctctatctctctcctctactcgagttttgtttggtctttggaagtgacggagaggcaggcgacggagagagagaagccggcggactcgagaggagggaaaggaataataaaagaataataatccggcttgtggaggggggaaactgcaaaaagtggttccgcgagacggagagggaagacggagcacgtaacggtaacggccaccgcgacgacaagaaaggaatgggttcccacacgcgggaggggggtgtgggcccgagtgtgtctgggccgtcggatcgattccccccgggtggatttcgtacctaacttttggaatcgcgggaaaatgttattagcaagtttgttcttcttcccttttcttttttgttatgtgttcccgccaattaggtgtggggtcccataaagtgactggtgggtcccacgcggttgacgttgagggatttttcacatgaaagggattttttaatatatatatatatatatatatatatatatatatatatatatatatctgcggttggtaattggaattggaaactattctaaggtaattggtgatttttattcgttttagaaattagaagaagttcggatttgtcacagttgcctaaacttcatgaagcttttatttaggcaaatatatttccatcaatatcacttgttctcaatattgcctacccgaaatattcgatgcc

SEQ ID NO: 802 - DNA, 1501 bp, Oryza sativa
cgccaccctttcctcccggctcccgcgaccaccacgggggcggggcccgcgtgcggcggacggcgacggcgacgacgggggcggggccgcgtgcggcggacggcgacggcgacgtcgggggcagggcctcgtgcggcggacggcaggggctcggcggcgcgaggcgacgacgtgcagcgaacggcgacaagcggaaccagccgcgccggcctcggggcggccgggtcgtggcgacggcgggaactcgacagcacgaggcgacggcgtgtggcggacggcgacgccggactcggggcggccggatccggggtcgacagcccagcagttgcgggattcgacgtcgtgaggcgacggcgacggatggggctcggcggcgcgaggggacgacgtgcggcgaacggtgacgagcggatccggcgtgcgacgtgcgacggtgtgcggcggacggcgacgagcgtttttcgatgtttgttaatttggattttgttgtttattttgattcggatatctggcaaaaaaaggtcggatagtttccgaccgaatccaatttccgacggataccatcgctactgtattcgaatttgtatccgagaaaaactatccgaattcgtatccgaatccgagaatatccgaaaaaaattcgaccgcaacaatccgcatccgaaaaaccgggatcggaactcagaaattatccgtaccactttcatcctactcaccaccagcaagcaaggcatcctgttcccagctatacttgcctactattcccttccttcttttgcccgcctcgaccccaatacgccgcaaaaaaaactttccgagcagacacacaaggaaacccgaaacccaccccccccccccccccaagcgagtcatctgccgtccatcctcaccaacggacggcccacgacgcgtccaaaccacggaataattagggcaaacccaacaagagccctgtccgcccacgcgccgtcatactcgcccccccttccccttttctcatcctcctctccgcgtcaagtccaagcgaccaccagagatctctctcgcggggcggccaggtcctccccatcccgcggccaccacccacctccgaatctgccttccccagaaccaccgcgacccctctttctttccttcttcctcctcctcctcgtgccgtctccaagctccctccagcttgcgaggcgaactataaatagcggcttgggagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctcctcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaa

SEQ ID NO: 803 - DNA, 1501 bp, Oryza sativa
tatttctttctaagtttgggccgaaaagagacttgcgtctcgattcgactttaagagatgtttttcaacagctcatttggcaatgtaccgacctcccgggtcagatcattacttctcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggttacctcatgccacatagaaggatcaaatcctcacgtaagtataggccattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcctacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagaacacgaataccgaggtaccacaagggtggagcgacaaggaaacagggtagtacgacctacggaaattagtgcgactactgggtaggtccgtcggtttggcacgcaaaccgaggccaagcaagttaagtgtgattctaataatgcaagttgcaaataaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagacctattagtagtgccattaaataggtctcaattttacggaattactggaagtggaacggaggcgatcggagctacggatcgagggatatgaattttggaggtctaaatggattttctggacaaggaaaaggaattattaattcccttggaaaagaaaaggaaggaggga

SEQ ID NO: 804 - DNA, 516 bp, Oryza sativa
atactatacgtatgtaatactattgtttactgctaatgagtcaagttggagatagcttggtctcggaatatggtttctttgtttgttccatgtgtaggtgactcgatgtctcgagagagtatttgcggtaatggactgggagtcggcttggggataaaacgacgtccgtggtggtcagagatcatgcgggatacttaggctagagttgatgcacgtggttgatggagattctatatggcataccatggaggaattgtgtgctatgggatgcggagtcgaatttggaaggagtccaaatttggtactattggttatgtaaagttttttcttgtaataatgggtttcctaaggtgtttaggactcctagtatgagtttggttcgtggctttaggctgcctacctcatatataaatagagggggagcgtgaggcttcccggtatcgctttagagagcaatagagttgagttttgagttagggttttgagtttagtcgaaatttttgtgaggagtgctgt

SEQ ID NO: 805 - DNA, 1501 bp, Oryza sativa
agatcaatacggacagtgaaactcgcaattcatgcatcaccaatcaagcgtgtggaaggcaaaggattcacgtacccttgccgcggtggcgggaggagcgcttcctcgggaggaagccgagggatccatgcctcgggtgctcgaacttcctgtgcgacatcttcctcctccttacctgcaaacgaaacccacacaagccatgagatccgcaaccaagaaaatgcccgtaaaatcaccaatcgcaagccacagcgatcaaactacagcaccagcgacgagaattcgatctcccagctagctcactaacaactaatggcggattgcggacacggagcggaggcaaaatctgaatcgaagcggggattggaggatgaggaggggaggagcttacctgaggagagtgacggcgacggcggcggcggcgcgagctgagtgcagaggcgagggaggtaaaccctaggggtggtatttataggcggctaccgaatggagggtttcgctgggtcgggcggaaatgtaggaatgggcttgaatgctagggctttgtgtggaggtcgcagactgggcctcacactaggtaaagcgaatgggcttttggactggatcgcttggacacgaccacaccaacttgcttacggcccaaatacgtctctttctgagtgttttgtattatgacagtggaatattgtgtactttatctgttcacaaatataaacattttatgttttttaaatttgttcacagatataaagatttttagaatagtaattgcttcatcaatcacctcacgttttaatttctttccatcttactctcagtaatccttctaatcccaaacatacttcattttatgatacatgtcaaagcctttttatcctcaagtctaatatctgctaaaaaaaactaaaattgtttatattctgttggaataaataggttaggccaaatttaatttaattaaaatcttaagatcccataagtattgttagagacaataatactaccttgaaaatttatgtggaataacctcaacttaaatagagtgatattggagaatccatgttgaccggttgaggtgatggttggactgccacacgcgcgcgcgccgagtcggcctcggccgtgggcgtggcgaggcgaggcggcctgccgagccaagcctcttgttgctcttccgttttgtaacagacgaaaataaagtcaccattaacaaatgaaattcattgtgtgttgtaacctacacaacaaatgagagattcattgtgttgtaacctccacaacaaatagagatttatttgttgtaacctctacaacaaatagattcattgtgtggtaaccttcacaacaaatgagatttatttgtgtggtaatggagatctctctatataaataacgcaaaggaaaaggctctcaaagattgagtcttcctcctgctgatgttccttggcgatattctccttttgttcctgcgttgtctctctgtttccccggttctgtccat

SEQ ID NO: 806 - DNA, 1292 bp, Oryza sativa
aatttcagtaaaagtaaggtgaaaaaaaagatggataaatttgatccgtgccatactgggacaacagcacactgcctcctgcatattcctggaaaaaggaatctgtgtgctccgctctcagctttgagcttttggcagctaccacctgcaaaacatatggcggcagctttgccatgtgaatcatattattgtttcattcggaagtgttttttctttccctttaggctgagtctgaatcagccttttgtgagttggccgctagtaggacttgttttccctaagatcctagggtgtgttcggacccaagggttcccagcacctctccatcgttttccgcgtgcacgctttttaaactgttaaacaatgtgttttttgcaaaaagtttctatacaaaaattgcttaaaaaatcatattgattcattttaaaaaaaaattagctaatttctaattaatcacgtgttaatggaccgctccgttttccgtgcgaagaagatttgttcccaacctcccccagcaaacacagccataaccatgttttctaagttgctcacagtatttttttctataaacttttttataaaaaaaatattttaaaaattttaaaaattattttttaaaaaatataatagttaatacttaattaattgtacgctaatagttttttctcgttaaacgtgccatggaaaagccagtctattaagctgctttgaactcactattagcttgcggcgttttgaccttcatttgggctaaagttgttatctcgttctctgtaagctcgttttcccgattaaatgatgtatttcgtccaaaaactttttatataaaaaattctttaaaaaatttaaataaatctattttattatatctcaggaatgaacggacagtatcttgccgggtatttgcttcttggcacttttccagaattgtgaaccagttggtagaataaccagtaggcttgtagaataataagccagctagaaacagttagaagttctaaaaaagctaggaacacagttaggtcctgtttgggaagcccaataaatccctgccaatatctcagtcccaagcccaaatcatttggcatgggtcttgaatatcctcaccattatttgattaatgattggtttttttacatatattatgattaatgattgcttaaccttcaaacagagaaagttcctgtttgctccaacaaaacacttcacacggttatcctgtcaagtagggctattaaactagctcatcatccagcatccaatcaaagatcttccctcttgtctccttcaga

SEQ ID NO: 807 - DNA, 1501 bp, Oryza sativa
ccgtttcacaatataagtcattctagcatttcccacatctatctatctattatattattaaaacagctttgaaaggaggcaccacgttcgctgtgggggctagaaattcccacattaatcgaagaaaaagtgaaaaaagaaaaaggagagtccaaatagaagtccaatttaaaaatagctgaaattcggaattaaaaataagcaatattgaaaaaagtttccatataagaacctaatacgagattaatcaaaattcaaaataaaaataaaataaaatccaaaattagaagaggaaaggagagtccaagtagaaatacaatttaaaaatagctgaaattcggaattaaaaataagcaatattgaaagaagtttccatataagaacccaatacgagattaatcaaaattctaaataaaaataaaataaaatccaaaattagaaaagtaaagaagagtccaagtaggaatacaattttaaaatagctgaaatttggaattaaaaataaggaatattaaaagaagagtccatataagaatccaatacaagattaattaaaattcggaataaaaacaaaaataaatctgaaattagcaaaagaaaataaaagaagagttcaagtaggaatacaatttaaaattagctagaattcagaattaaatttaagcaatattgaaagaagaatccatataagaatccaatacgagattaattaaaattttgaataaaaaataaaataatatccaaaattataaaaattaaaagagatttcaagtaggaataccattttgaaacaactgaaattgaaaataaaaaataaaaacattaaaagaacacaatacggtattaactaaaaattttttaaaaataaattctgaaattagaaaaggaaataagatttcaattagtaatacaatttataaataactaaaatttgtgataaaaataaagactattgaaaaaaagaccatctaaaacacatgacgagataaattaagtaacatgcctataaaggagtagagtggtggcggttgatacgacatataaaaattgttaataaaacacaaaaaagaatcctaatgacgattaaaaggagggacgtcaggcaagtcgtgaagcaaacaagtaaggcggttgccgggatttctagacagtaaaaaaataaaccccattaataatcatattcgatttttaaaatctcaatgacaataaaagggagaagcagcgggcggggtatataagagtatagttgcagagccgccgacggttgacgggacttctagaaaataaaaaatgaattccaacgatagttatgtttgatttttaaaatcatagtgtaataaagagtaggcggcggacgggctgtagaggggcattgtggcatcgttcgatgggacttctaaaaattataaaaaatgaaaatacaagtccaatttttaaaggttcggaacttccaaaaattaaaaaaacccaatgataatcatgttcgatttaaaaatctcaa

SEQ ID NO: 808 - DNA, 1501 bp, Oryza sativa
gccccatacccactccaccgcccccgccccccgccgccgcccccgccgcggagccgttgttcggcggctgcgcggtggtgggcgacctggggtgcggcttagccgccgacttcgacaccgccgtcgccatccccgtcggatccgcgccaacggcgagctcagatttgaattccgccgcctcgagctcgacgcatccagcggctgattcggggcgaacgaattcgagcgcgggattggctcctccctcggatcgatcggagggtttggggggtgggggttttggggcggattggggaatggcggcggcggcgagatctcgcctcgggagcggaggaggtggaggtgggggagaaaggcgaggagggcggaggcgagagagagagagagggcgaaagggctcaagattcgttggagtcgagacgatgaggaggagggtagaggagtgagggcccactgaggtggtagagagtggggccaccttgtcagggattagtagctgggttacctgggtttataggagtgtactatagcgagctggaaaaataaatggccgttcaaatgatttggtgctgtttaattagagtgtcctcctgggcacacctgtcagtgagacagtgtagtgtacttgttgatttttttttcaagacatcaagaatttggaactgaaggaagtactcactgacaagtggagaagtacggagcaaaacaccatgctgtttactcccagaaacaccatgtttgcggttttttatcgtctaaaatttttgaataatttccaaattcgtgacttatctgccaataagctggttgctctaggagcgaagcaaaataaaaaataatttataacaaagcttagtgttttaaaagttatagtgctgaaaaataaattacgatgaaacctcaaaataacctctaaatttattttttttggttgatactgataaattaataatcagacgatgagaagctaagtatccacgaactttagaataattatgttgggcccatgaatttgttcatttctctgggtgtcggtcgaggtttcttctgtcctttgtaagttgccggtggaatttaattgtacaaatgcaagtccaaactccaagcaaacagccagtaccagtacaatcatactaatattgaaaagaaaaaaaggtggaaaacatcaacttttttaggtaaaatgcacttctatgattctatccgtttgacgatatctgatctctctgggctgatttgaaagttgtcaattttatgttgaggagttcattccattttcatctgcttggagtaagactctgcatctgtcatatgacaagttgtcaaaggaccatgcatgcatgtagcagcaacaatccaaccaaggacagatttttttttctatttttacgaagaaatcagggatggataatgtaatagacttgttgttttgtgagtaattaacccactaagatacgagtaaaagggccactcgcaattatgtgtgcatcttccatacatt

SEQ ID NO: 809 - DNA, 1501 bp, Oryza sativa
cactgcatcagccatgctatctctgacaggttttacctgaaaaggattgacaagaacaacttaatgcaacataatgcatgtaacaatgacttgtcatcatctgaaaaggatccatggaagagcaacagatccttcagtttgggttgagtgagttaaagttttagttaccttatcgaagcgacaagcttcaagagcagctattgttggagctgttccatcacctatcaatcggcctgaatatgtggccaggacacacaatgtatcagctgcagcttttctagtagcccaatcactgttctcgagacagtcacgaatgctttgcaatgtttgaggcatattctgaggactgattgctccaacctgacaagaaatatatcaacaattattcaaacaaggagagctagtgaatctgatgttatgtcattgcagagatttataagatatgtatcgcacagtaatgcttggcacagtattcccaatagtaccattcaaagcatgtgttaggagacacattcgcttagagcatcaatgtatgtttcagttcaatgtttcaactgaagtactaaaaagaataaaaggctaccagaggcaaagcaaaaggttaattattcgcttatctaaacattaaatcacaatgctgtggtactatccattgttcatggggccaaacaccacacaaaagtaacaacagtcttatgtacccaatggtaggatatcaaatactaaactcctaagtcctaaccatccataaattcagaggtgcaaaacaaaatggcacattgtaataatgattgaaaatatcaaacccttgtctcaatgataactcaccattcttcacaacacgaacaatttccaaccatatagttgtcagcaagacatataggcaacatccaaaactgattacatgatgaactacattcgaccgcagcggcagcaccaaacatcacttatcacaaaaacaattcctaccccttggccacaatttatgataacatttcccatattcagacagaaaactaaatgtccatgaaaaataatcaatttagtaatgtctaccacaaatttctaccacctggcatctgtcaagtcaattcatcgaacatattgcatgcataaagaaaaatatcgcgcaatcccaacctgagacaagctcccgatgatggtgagaagtgcccctttagcctgtactccctgtccaccaagcaatttgcaaaccctcggaccaatcttcccaaacatccctaccacgccaggtccaggccccgcgccctccaccgtctttgccaggcaggccgccgccccaccctgcactgccttgctctgctcccccatcgcctcaaacagtggcttcacgaacagtgtgacagtcgcattgcccgcttcagcggcagccgaggccgccaggggtcggaggtacacctccgagagctggccggcggcatcgcggcacgcgtcgcgcacggaggagtccgagttggtgtccttgagcctccgcgcgagg

SEQ ID NO: 810 - DNA, 1501 bp, Oryza sativa
gcccttttactcgtatcttagtgggttaattactcacaaaacaacaagtctattacattatccatccctgatttcttcgtaaaaatagaaaaaaaaatctgtccttggttggattgttgctgctacatgcatgcatggtcctttgacaacttgtcatatgacagatgcagagtcttactccaagcagatgaaaatggaatgaactcctcaacataaaattgacaactttcaaatcagcccagagagatcagatatcgtcaaacggatagaatcatagaagtgcattttacctaaaaaagttgatgttttccacctttttttcttttcaatattagtatgattgtactggtactggctgtttgcttggagtttggacttgcatttgtacaattaaattccaccggcaacttacaaaggacagaagaaacctcgaccgacacccagagaaatgaacaaattcatgggcccaacataattattctaaagttcgtggatacttagcttctcatcgtctgattattaatttatcagtatcaaccaaaaaaaataaatttagaggttattttgaggtttcatcgtaatttatttttcagcactataacttttaaaacactaagctttgttataaattattttttattttgcttcgctcctagagcaaccagcttattggcagataagtcacgaatttggaaattattcaaaaattttagacgataaaaaaccgcaaacatggtgtttctgggagtaaacagcatggtgttttgctccgtacttctccacttgtcagtgagtacttccttcagttccaaattcttgatgtcttgaaaaaaaaatcaacaagtacactacactgtctcactgacaggtgtgcccaggaggacactctaattaaacagcaccaaatcatttgaacggccatttatttttccagctcgctatagtacactcctataaacccaggtaacccagctactaatccctgacaaggtggccccactctctaccacctcagtgggccctcactcctctaccctcctcctcatcgtctcgactccaacgaatcttgagccctttcgccctctctctctctctcgcctccgccctcctcgcctttctcccccacctccacctcctccgctcccgaggcgagatctcgccgccgccgccattccccaatccgccccaaaacccccaccccccaaaccctccgatcgatccgagggaggagccaatcccgcgctcgaattcgttcgccccgaatcagccgctggatgcgtcgagctcgaggcggcggaattcaaatctgagctcgccgttggcgcggatccgacggggatggcgacggcggtgtcgaagtcggcggctaagccgcaccccaggtcgcccaccaccgcgcagccgccgaacaacggctccgcggcgggggcggcggcggggggcgggggcggtggagtgggtatggggcccgcgggggcgacgccgtcgaagaacgcggcga

SEQ ID NO: 811 - DNA, 1501 bp, Oryza sativa
tggagttgtcgatgatctcctcctcggtgagcagcggccggccgccgccgccgtcgccgtctcggaggctgacgaggtagctgatgaggtcgtccgatggagacgactcgccctgctccaggttggccttcttctccctcaccgtcgccgcgagcagccggcgagccctcgcgctcgccctgaggctccggcggaacgcggtgaacggcaggtcgagcggcaccgcccacaggccctccagcatgtcggcgaacgcggcggcgagccgctcccggacggcgccgcgcgcgagcccgaacagcagggtggcgatgacgtcgagcgtcagcagcttcatcagcggcagcaccgcgacggtgcggcgcccggcccaccgcccggcgaggtggcgcctgacctcgccgtcgatcctgcccacgtaccgccgcagcatctccggcctcaggaactgcgccagcgcgccgcgcacgcggcggtggtcgtcgccgacgagctccagcatgttcctcctcccgatgatcgccgcgaggctccgcggctgcttgggcgccagcgcctcgctgaggaacaccgccttgttcgccgccgggccggcgaggagcaccgtcggcgcgccgaacagcgacagcttcgacacgggcccgtacctgtcgatcctgccctgcagccaccgctcggcggtgttgcgacgcatggcacgcagcagggacaggctctggccgaccagcggcaggccgagggatcccggcggcaggttgcgccgcggcggcggcttcgtcctcgtcgatcttccggccaggtagacggccagcggcgtgaggaaggcgacgaggagcgcgacgacgacgacggcgagtgccattgcagcgatggctaactgggacgatgagtgtgaaagggtttatgtgttgagacttgagagagaccgacagaatggcatccgcatacttctttcgtaacggggtgacaggaatctgatttaagccgctttcatatgtaattaacaactatgtcaaagtagaattgtttgcagtttttttatttgacattcatattttagcagctggacccaagctaataggaaccgtgttacgacgtcccattggcatggtgggagatgctagccaaaaaaaaaaaagatgcgcctaagaaatgcttgcgtaccttgatcctactggttatttgggagatctggaatggagagaacttcaaacaaaagaagacttcggcccctggccctaggttgttcaacaaaataatggaagaaacatgaacttggaccctagctggtgttaaaaagctagtgagtttcatctctgtacaactttacttttttctaaccctaggggttgtatttttctcccattttatttaatgatagcacagtctcgtgctgattccaatcaaattttaccttaaaaaagacaaaatttgctacaggacataaaaaaaatgtgtaattagctaagggacaccacaagatcgtgaaacgactgagaaa

SEQ ID NO: 812 - DNA, 1501 bp, Oryza sativa
atgcgatctcaccggagacagggccttccagaaatcgaggtcggtggcgggcgcctcggcgatcctggtggcccaggaggcgagcatgatggcggagccggcggcgagggagagcgtggacgtgagccacgggtaagggaacgcgttgagcaccttcttgttgtagatgttgaagatcacgttcagcgcccaccacgtcgcgaagtagaccccgatcttggcccgcctcgccgcctcctccggcgccgcgcccgccggtgcagcctccaccggccgggcgccgtcggcggtggcggacggcggcggcggcgccggtgacgcgacgcgcgacgccaggaataacgggtcctgctgccggtacagggggcgcgccgagagggagaggggacgtggcccggcggcggcggcggcggcggcgaagaggggagggaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggttgcggccatagagaccgctcgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctagaagaacatcaaccgcgtcaacagggaaggctgcaagaatagtagccattcaagccaaagaaaaccgtaggcactaacataaaagacctgacctaatccatcaatcaaggagcatgctaaaaggagatctagagagagggagaggcactggcaaatcctaattgatggatcagagccaagcatgttatggcaaggagctcgttggctagctcaagggcgcctcaaagaggagggaggaggagggatggggatggaagaaggtgttgggcaaggtcaccagtcccgcggggagaggggggtccgaggccagagcctgccaccggtgccacggattcgaccagatccagccgctaggagcgcagatctgcacgccaccagtcgggggcgccgggcctagccttcatcgccggctgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgcatttttcatgttatgatacatggttcc

SEQ ID NO: 813 - DNA, 1501 bp, Oryza sativa
ggcatattttggctaggagatgaatttatgccatgtgagatataaaagaggtaaagtttggtacaacacaagtgtaacatgtaaccaaacaaccacatcgaaaagttaatcttggttaacttttaggtgcgctaaagtttgccattcagctgaacaccctttaactttttgaggtgattgtttagttacatgacacatttgtgttgtgccaaattttactacttttatacctcacatggcataaactcatcttctagccaaaatataccatacttttggctcaaaagtttaacaaagtgcagcaactatcaaaaaaggcccagtactccggtactccctagtccctactttggcctagatgagtaagcaacgtgctctgctaagaaataagtttgcactgtcacgttctaaatcttaccaaattattgcaagccaaaatccaaacatatttggtaaagctgctaacgtgctttcggctatccctaccaaaaacgaatgccaaaatctccccaacgaaccaaacgaaatatgtgattaccaaatgtaggtacttaaagaaaacgtggactcgaaataaaactaggatgcaatcatgagaaattctcctagcaattttgtgcagaaaccatttgaggacatgtgcccatttttaggatcccagatcgctgaacaagtggagaaaagttcgagagatcaacatttccagtttccacattcgtccttccgcttacgccgatcacaaaccataacggtttaccaagaacttaaaaacaattaaaaaaagcttttacatatacattattagcaatttaaaaacaaatattacaaaaataaactaaggtaaaaaaaaccttaaaaaaacttagaattaaatctaatgttaattttaaaatccttaatacaccttaaaatcaccttctttttcctctaaggcccctttcgacatagcaactggtgaagattgagtacaggaacgcaaaatgagaaaatcattagtgatgattaattaagttatactaattgtttcaaacttgaaaatagatttatatgatgttttaaatcaacttttacatactccctccgtcccaaaataagtgcagttttgcactattcatgttcaacgtttgaccgtccgtcttatttgaaaaatttttatgattagtatttttattgctattagatgataaaacatgaataatactttatgtgtgactaaatgtttttaattttttcataaatttttcaaataaaacggacggtcaaacgttgaacatgaatagtgcaaaactgcacttattttgggacggaggtagtagaaagtttccgcgcgatatacaaattagtagcgtaaaaagcgtgctaatagaaactaaagataaaatccgtattttaatccaccaatccgaaatgattagagacgccaaaaggcccactttactgtagtgacccacgagtgctccatttcctttccttcagtgtctcagtcagtggatcactgtgt

SEQ ID NO: 814 - DNA, 1501 bp, Oryza sativa
tgttgattttgtataaactaggtggttcatcatgggatcataactgcaaacgttcactagactctaaagtgacaaacaccttattcctttacctttttttcaccaggaaccacacattagatccacttatcgtttcacctcacgtcgcagactacaggcgagcgcgttctctagcatcgttgggtagcggaaagatcccctgcccctccagcaaaacgacgtgccgacgggcatctcttctgctctactccatgttcttcctctttggcaagaagatagtaaggctccgcgcacccccttcgttcgctccccattcttcatctccagcaataagacagtgatggcaccactctccttacttatctcttatctttacaagggcggtgacgaggtgccatcccaccttcctcagatctgacgcatagcaccctttcttcttcgcgcatgttgtatgaattgccaaagttcttaaattttttttatttcgaagatgacctttcgaaaatgagttgaatgtgtaaagtattaggtatgaaatatcgagttgaaacttctaaaatcgggtttctaagtttaagggtttgaataggaagctttcaagttttcacatgaatatttcaaaatctgaccagatgatttgtaatccgagttgaaagtttgaattatagagttggaagttctatatatccgagtttaaagctttaatcatccggttgagaattttagtgaaagttttaatcattgggtttgaaatgatatcaatctgaacaagctctaagaaaaagaatattgaccaatcagtagacgtatcttatttatgtctctatatatcatagctatcgtgaataagttttataggaacccaattattaaactttaatctcaaagtgttaagtacgatactaccactccaggaaaataagcccgagaaaactccaggaaaatagtacaacctcgtgcgctgacacagtgcaccccttctagaaaaccctcgccaaattttcgtgcagcagacgccgtagaccccacaccctcccggactgttggtagtggatctcggaaggcaaaaccccgaccaaaacacccaaaaaagaaaaaacaaaaaaaaaacacaaaatgaaattccaccgagaccagaccaaaccaaaccaaaccgaactccacaacacaacgcctctccccctccgccctcctcctccgcttccttcccttccttccttccttccttccgcctcgcgtctcctcgtcctcacctcacctcgcctcgtcttcctcctcgcatcgccctagccctaggccacctcgccatttgatgcgggggcgcccgccatggcgtcgtgggggctgggctggaagcggagctccgagatcttccacctcaccctcgactacggggacctcgcggatggacctcctcaccatcaccagcagcagccgccgccgccgcagcagccgggctcccctcccacgccatccagcgcgggctccacgccgacgtcgt

SEQ ID NO: 815 - DNA, 1501 bp, Oryza sativa
taaaaaaaaaaatcaaaatttcagtaacaaagtgaacaatccgaaactcacgacacctctctctctctctcccagctggttcgcgcggccaccaaacacatcgcctcgactccccccacccccacctccagcgatctccgccgccaccgtcctgcccggtaagctctaccgcccccttcttcttcctcctcgccgatcgttctatccgatcccttccccgccccccgaatcttcatcagcgcccccagatccgcacgcctccatgcgccaccccaagcccgcctcccgcccgcgccatcaccggtgctacggccacccccgcttccaccacggccggccagccggccggccggcagcgcccttatgtcccgccgccgtctcctcctcctcctcgtgctccaccctaatttgctactactactaggcgaccacctttcccaaaccctagcctcgccaactggctcgtcagaaaccaaaccctccctccaaccctacccccgaatccttactcggacgggtgggagcttcatggattagcagatgccctggaagaatgggaggttttaatgttgggtgtgccaattgcacatggttgcagtgagatcgatctggttatctgctcccacaatttaatttgttatactattttctttttttgtaacacaattcaaagccttctgttaagcaccgagttttactgtagtacaaatgttgcgaaaatgcatcatttgatctaggtatgaagttcagtaggttcaactgattggcaggtctccagcattaatgctcttcctcaaactcagttttgcaaaacagaaaggataaatagattccttttactaaaccgtgattttgtgttgattaagacgattcattactgcttgtttgttcaggaatggagaagtaccagagcaaggcccggtttgcacccctcagtgatgctccatttgctctccgcggtaaatgactcttgcatgaatatgtctatatgccttgccttctggtttgcctttgatatatcaatcaataatatgggcagccaccctattgttcataatgcggtagccaagtacattatgcaatgcagtaattgacttgtagctgacgtaggacacaaatttcttgcaaccacactagagtaagttattgtttttttttaagaaaatggaagtcgtcattggtttacacgagacatggttttcactgtttttaggttagtctctaattttttattgaactggacgctagtgtatattgtataatttgatgtacatgttttgcaactgcttcaaacaactaaataaatgccctcaccttttttcatcgttttcaggtgcccttggtagctcaaactcatccttcaacaacatagatcatctgagacaatcctcaagttctggacaagctaggagctacacatcttcacccctaggagctctgagaccaaagatgttcccatctggaaaccgactcctgcacacaagtcgtcccctgtcggctc

SEQ ID NO: 816 - DNA, 1501 bp, Oryza sativa
ttctatttttatagagagtttgaggagaaggggattgagaagattgggaagatacgcaaaacgaggtgagccattagcatataattaattgagtattacttattttaaatttaaaaaatggattaatatgattttttaaagcaacttttctatagaaaatttttgaaaaaaaacgcaccgtttagtagtttgggaaatgtgtgcgcggaaaacgaaataaactctctctttctccacccaacgaacgcagtagactttatatataactctcaacttatatttttgtagatataattgtattttatagctatatcaatcaatctataccattataatccaaacccaatatgatctgacgactaagatatttttcttttttttctccaactaatgtgagaattttctagtctctataacgaatggtgtgtcttctttcaaggctttttttaataatatataatagatagatgcttatacgggtggatagaggggtatatgtttatgtaaaaataaattatgctatgtcttggacaatgtgctggtccagctcagcctaacacaagcaggccccacgccccctctaattctctaaataaaaagtttggttccatcagatactagaggtaaggtcaacacggcagcttagccctgcacccccaactcttgcctcaaaagttcgacaaacacgtttccgcatcaatggatcttggatatgagcatcctgctgtgcttctctcggtggagatcagcgaagtggtccagaagctccgccgctctctgggcaaaagtagcgactccttcaagagaactacgaagaagctggatgtggtggaggataagcttcgcttcctccgtctggacagcctgcagcgggtcaagcctgcccctgcatggctgcaggacctgaacaaggctgcacaagatgcaaagggacttcttgacgacatggaatctgaggtgaaagctcctgactcttcaatctctgatgttatgaattggctctcctctgatgacagaaacatgattagaatggtatacgtcattagtaaacttgccagtgcatgttctcaaggcaaatctatagttgacacaccacccctgaatgagagtgccttaggagatgaaaaggaagataagatagcttcatcttctgttgccatgactcgccaagacaaatctttccttggtgatgactttcttattggtcgcgatgaggaaatagctatgataagagacatggtattggacaatgcccaatatgtaccaacagaaataacacttaagattagggaagaagctgagaagttacatgttcctcataagggttggattactgaaactcttcataaaattgatatgtctaaatggacacagcaagcaatagaagtatccccacaccccgaaaatgaaaagagcaacaaggtagaatatattcgtcatccacatgacagtgctgttacataccttcggaatccggcagttattcccattgttggaatca

SEQ ID NO: 817 - DNA, 1501 bp, Oryza sativa
gatttaaaaggatttaggcaagtttatggtggcaagcctagggcttatgcccaagctgccctaggcttgcctccttgcctccgccccttaaaagttgtacatgactgaggaaacatcaggctgagagatcacctaaatggcgttttgtaaattgtaatcgatgttagcatgcctttgattgtgatgatttctaaatcaacttggacaagcccggcgaagattttgacttgcacaaactttcgacgattcagatatgaatctggaatcagtaaaagtgagcgtgcacggtgatcctaaacttctataaatgcacacatgtatattttatctttataagtatctttaaaaaccgagctagatatcttaatatttatgaagtcaccagacattcgatctcaacgggcgtgttgtccagtacttataacatataaaattagctgtaaatacaagtcaagtttaggttggaatgagtacttgccatattaatcacctcaacttataatctgataaaaataacctagaaatgcttatattgttggacctaagaagtagccgaaatttctcagtatgtagttcaattactacaaattttatgtatataattgtcttttctttatagtcgaccatcagttcgtctagaactgattatccaaaagatttattagcgataaaatattatttataggaacaacttttataggtgtttttaacgacttaaaacatcaatgtgaaatttaactttaatttcaaattttaaattttggatacggctaaatgagctgaagcaatgcaactccgtcaagtaaagttaaaagaaagaaatcctaagggtgtgtttagtgctttgggtataaagtttttaagtatacggatacacatttgaagtattaaacgtagactaataataaaacaaattacagattccgcacgtaaactacaagacgaatttattaagcttaatcaatccatcattggcaaatatttactatagtaccatattatcaaatcatgacataattaggctcaaaagattcgtctcgcaaaagttccttaggttccttgtggtggaaccagcccatccaagttcaaatcctagatttgacacgggtgctcgcatttacggctaattattctttcagtggtaggcgacgaacccgtcgacagcgaggcgcctgtggtgacttcgtcaatttcaagacatgtcggctcagtctttcggaggtgctcataggggtagggtgtacgtgtgtgcgtttataggggtgagtgtgcgcacgttgtgagcgtctgcgtttgtattgtgtttctaaaaaaaagaagattcgtctcgcaatttacatgtaaactgtgaaattggtttttttttctatttaatatcacacatttgatgtgacattttttgccacaatttttttttatctgaacaaggcctaacccctgctgcgtgagacgtgtcaataaaggtcagaacagaaaaataaaataaaaattctgcatcttc

SEQ ID NO: 818 - DNA, 1501 bp, Oryza sativa
ctgatgtgccgaaggaaggcgcttttgaggtggtgccttgtgggcccataaactccggtgagcagaaatgtggcccctgtgagtatgaccgtcacttgcgccgaaatcaagaagcggccgactcggacctcttggacgtcaaagactgcgctattccataagaggaggatcccccctctcgtgcctcttgctggcttaaaggcaaatttgtcgagcttgtagcctcctaaaaagtgggcgagaccgtcatctatattctgtagctttgtctcttggaagcatgccaagctgcacttcgtgtctgccataagctcatggatcgtgttacagcgcgcagccgaattgagccccctcacgttccaggaaataatatctaggctttgcatcattttagtaaaattgttctccgtattcgtggcccacgcagggggtgggctgcttggtcttatatatatatatgtattgttggagcaaaagatagagcagtggtactagtacattagttgttagtagtacacatggattggttcaccgatcagggtcttcattctcccaaatcctcaagatttttcgaaattagttgagggaaaaaggaaaggagatcaaggggatttggtttccgtgatcaattttagaggataagcaatagagaggccgaatcgagtcggattgcctggagatggggtcgggtgctataaggactccatcccgagcttaaagacgacgcactgtgggtgtggggcccaaacgccagagagaggaggggctgagggaagccggctggacttttgggagggagaggaggcgactaggtcggttggaggagggacgaaaagcatacttttccagttctgacccgaaaggagagggagttttaattacttctctgattaaattaatcctcaaaatgatcttctaaagtttgaaaaatacttctagtgctcaaataatttcaagaaaatttctaaaaatacttggacacaaagtatttactttgataaaattttatttagctcaatttgatgattaatttttattttaaataatcattgaaatcgatagcatgttgtaatcgtatttattaacttattaaaggaatagaaaaaggagcctccacgttcgctctcatggcctacaaattctcatattaatcggagaaaaagaaaaaacagagtctatatagaaatacaatttagaactagttgaaattcggaattaaaaaataagaaatattggaagagtagactagaatctatatagaaatacaattaagaaataatagaaattcagcattaatatagagtccatataagaatttaaaactaactaaaatttagaataaacataataaaattaaaagtagagtttagaattcatataaaaatacaatttacaaataactaaattttaaaatttaaaattaaagaatattgaaagatgagtttagagtacacgtataaaatttagaataaacataataaaattaaaagtagagtttaga

SEQ ID NO: 819 - DNA, 1501 bp, Oryza sativa
tcagtttgggtaaccatttatttgtgatttctattgtctttttcactaaactatactaactaatattatcatttgggtttcccattttgataatcactttcatcgctataattttatttcttacattattatttgcgttgcttatatcaaattatcgatgttaaaaattaatagatgtacttattttattaccgttgagtactctaataccaaaatagtggtgcacatcctctaatttgctctagctcctttactgcgctcgcaacctctatcacatgaatatactaatatataagaaggcaacctacacggacagctcgtactagtatccatgggatcaatggcacgaggcatccacaatgtggtagaagaggaggcaatagggattaaagtattcctactactactaggtaagacacactatgcacagcggcaacgggaggagctgtcgtgggggcacgacgacgatgggatggcaacagcgacgaggggcgggggcgcgatgacgggacgacaatggcgacagggggcgtggcgagctcctccccctcccccccacggtctcgctagtggctgggctgctcggtcggcgacggcgccgacaacctccttcctcttttctattgatgctgtttttctttttattttcatgttcaaaatgcttgtatgctgtgctcacttccatgttaattgaatctaatgaactctggatgaggatttgaatcgatgctcgaaaatttggatgtggatttgaatccgtacatgctgcgaaaatctgatttattttctttttttttggcaaaaagagattttggggattagttttttttatggaaaataattttcactggcggcccacataatgaagccgccagcgaagactattttttgctggaggagcacataaggcagccgccatcgaaggctatttttgctggcggcccacataaggcagccgccagtgaagatgattttctctagcggctgtctttagctagctgccagcgaaaagttatctcctttagcggtttatcgccgtcagcgaagatgctacattttcactggcctttgctttgtggcagcgccaaatgccgcaagcgaaagcccaaaatagccgccacgaaaaatggtttttgtagtagtgtgggaaagcactagtagtgtggtggtagagtggtgggtgcatgactctacccaccagagttcaaatcctaatggccacaaatattaaaagcttggctcatgtttacgacattccacaaaatatttacaaattagttccagatattgaaccacgtgtcttaattagttctatacggtggcggaacttaacaaaagcaaacaggagtgaaaaatgagtacttcagtaaaaaaaaataaaaaaagagagacaaaagccattgcaatgaaggcaagtcacggtaatatgaaccttcaaatttatttttgcagcaaggtgttgaaaattctccccctttatatcaacatgttctctcatgac

SEQ ID NO: 820 - DNA, 1501 bp, Oryza sativa
ttatattgcagacgaaccgtaactggtcgggtctacaaaaatcgtcctcccatttttacgtgtggacccttaagagaaccgcacgtgaaattcgatttttgcaagcgggtctcttaagggtatgcacacaaaaattagcctatttttacaggcagatatcttaaagggctgcacacaaaattgaattttcgcatgcggacctcttgagagaaccgcacgcgaaaataccctccctcctctctagattttttcctcccatcacttcaaaattttcatccttatcctctccatctctctcacctactcatccttatccccactctcatttgtctcttactttctcctctttctctctctctctctccctctctcaaactctcctagccgggagagtggcggcggccggcggaagggcagtgcaggcgacgaggggtgacggcagaagaggctggcgcgcagcggccggcggaaggacggtgaaggtggcgtggggtgacggcggcagaggcacgcagtggccggcagaagtgatgaggacatcctccactattatccactggcaaagacgacaaagtcgggcggcgaccgtgtgagcctctgaactgaataatcccaccttacttagcttgggaggaggaagccaccttaaaagggagagccacccttcccctattgaactagtcttttagggagattgggcctttccccgagtgggtgtgccaaagaattgttggggtccgggcaaccttaatttgttgggcctcggccgaccccacctgggccagattgttatcaggaagggtggcgtggggtgacggctgtagaggctggcgcgcgcggcagccaacaggagagcgacgaaggcagcatggggcgcgcggtggtgggcaacgggctgccggctatcccccatgcagatccagtgggcggcggtgtcgggaggagcacggccgcggcggcgagaggagcctgtcggtggcagcgggaggacgacagcagctcaatttttgcgatttttattttttttcgtatttttgttttcgcgtgcgggcaacataagcatcaacacgcgaaaaactaattttcgcgtgcgggtgtgccacttgcacggaaaatttggattttcgcagaccttttcgggtagacggaccggaggtccgcacgcgaaaaccacttttggcctcttggaaaatcgttttttagcagtgactatttagaaatgatatgttttccggtagatacattttcttcttatttataggattctttttgtcaattatccattggctgtgtacctaggttatattccctccatcccaaaatatagcaaactagaatcggatagaacgtattctagtactacgaatatgcaagtactgggatacgtcttatctggttctaggttattatatgtagttgaatttaaagtagtttaactttgaccaaagttaaaacgacttataatctgaaacggaaggattacagttaactggacagcagt

SEQ ID NO: 821 - DNA, 1501 bp, Oryza sativa
attaaccgagccattattttttttctcgacgtgggccaagccttggttctctctcgtaggctatctaccaatcacagatgatcttttcatgtgggcccaccttaattatctctcacctaatttttttcaccaatcaatttagtcgaccccttctctatctccactccctctttcttctagcaatgcaaaataagttgatatcaacggctaatagtaggcatattttccctattacacttgccctaacagatcaggataattttctaacggagaaaatacgtcaaaaattttattttttgagcgaatagaaaaattaatacgtcaaatttgtgactgataccgacaagtgactactgatattttatgctaaggccagctatagcaggaaacagctagagagagaagaattctcgtcgcatacgacattggaaatgaaatggaataatggaagaagctccgcaggttcatgggattgatgactaccagagaggcacggaaacaccaccggttcttgctgttgaattccaagcacatgctttctagaattccagaaccccatgagagcccagttaagttgagttgatctcgacgacgacgacgacttctgttgatcgagataaaacggttgggagatattccgagattgagtagtattcaaagctattgatatgctgatttttcgtctttgaccaccttgggttacttggaaaagtattggggtttcatctactagctaggttgtttgttttagtaggagtagtactgtagtagctaacttggtggctacgcagggcatatatgcatgttgctagaagatgattagtgtgtacacacgttttaacgaaattaattgtgcaaattaacgaagatcatcacttcattagtactccagtagtttataatcaatagagtaactattggtttctaacgagacaaaatactcaatgttttaaagcaaagagagtactgtattatattttctctcgttgaaaaacagtcacaaagttgtttttgatgcgctcacgtgacacgtgtgcactttgcatcccgttcgttgtatccgaaaccctctgaacacgcatcatgtctggaacaatcattgactaatctttccgattaccttggggatcaccacccgcgtagccgcctagctctgaaccccagcagtagttgaatcgagtcattgctttatgatgcactgccgtcatctatgtatcttttagggtggtcaaagtaaacaagttctgtcgttgaataaatatatactgctgtccagttaactgtaatccttccgtttcagattataagtcgttttaactttggtcaaagttaaactactttaaattcaactacatataataacctagaaccagataagacgtatcccagtacttgcatattcgtagtactagaatacgttctatccgattctagtttgctatattttgggatggagggaatataacctaggtacacagccaatggataattgacaaaaaga

SEQ ID NO: 822 - DNA, 1501 bp, Oryza sativa
ttagcttatggaaaaaaaagatttgcaatctgaccgcgttgccgctgcctacctacacttcccagttccactgcttcgagcccagatcgtatatatgttgctgcaaccgggacgcgcaccagcacccgcacaccatatgacatggcacgatggacttctcgtaaccacgccagacaagatctcgtgactccaccctccctcccccgaggaatttgcatatatgccactgttaaaaactggcttcgctcgaatgccatccctaaaatgggattcgctctaatgccactgttaagatgtgggcgttcgctagaatgccatttttcccgtttgttgcaattgcaaaacatttttcatcaaaatatttttttcttgggcctttttcatcaaaatatttttttctcggaccgttttgcccctggaccaaatcaacatctctaccagtatcgttctctcgtctgttccaggcgtgaagacacagatcgaggagaggaagaacagatggcgacgacgccggcgcccggctggcgcgccgccgcatccactagctagcgcgccgccgtcttcccccacgtcggccgccgctcttcttccccacctcgccggcgcagcttctcccaccgcgccgcctctcctctccaccacccagtgaactccgccgccatggaaggctctctctctcatccttccaatcgatctcctcgacctgctatgctcatcccgtcgaaaagttcgattcttttgctccgatcgtttcgctgtagatttggttttgttttatttgtgttttgcttttcttttggtctctcttttttgttggatcgatcttgtctccgacgatgtaaatttatactttcgttcttctgaagttggcaatgtggaagaactatatggagacctgaactgggggttcccatcgatcaaatcttatcattttttttggtttttttagttgagatttggtcaggggcaaaacggtccgagaaaaagttatttttatggaaaatgtaagcgagcgaaaccagcttttaacagtggcacatatacaattctcccctccgcccgtgacggtttcggcgacaaaacgaaacccgcccccacccccacacccaaaatccgtgtgcgccgccccgcacgggcgcgccccccgtcctcgcccccgtcgccgcctatatcaccgacgaccctgctttgctttcctcctcctcctccttctcagcgcgagttagatctccacaggagagaatcccaatcgggcccctcctccgcccctctccctctcccccctcaccgtcggcctgccggcgacggtatatcgaatcgaggtcagtcttctcgtgctccagtcattggggtttcctctgcggagggatcctccttggggttgggtcgtcggatgtctcaccccagagggattggggcgggggatgtcgggttggatctttccttgttgctgtcgttagctcgttgcgtacggggaggtgggggaaaaagacggaagtag

SEQ ID NO: 823 - DNA, 1501 bp, Oryza sativa
atgcaacacggtcagcatcggcaagaatcatgaagcaaagcaatcgtctcggtccagcaaaacagaccagcagttcacgattcctgcatggagagctgctccagcactgcgacagaaaggagcacaaacacacacatttagcacgattctccgcaccaattaggaaggaatacaacagaacacgcaagctaacacaaaaagaacgcatagctacttccgtctttttcccccacctccccgtacgcaacgagctaacgacagcaacaaggaaagatccaacccgacatcccccgccccaatccctctggggtgagacatccgacgacccaaccccaaggaggatccctccgcagaggaaaccccaatgactggagcacgagaagactgacctcgattcgatataccgtcgccggcaggccgacggtgaggggggagagggagaggggcggaggaggggcccgattgggattctctcctgtggagatctaactcgcgctgagaaggaggaggaggaggaaagcaaagcagggtcgtcggtgatataggcggcgacgggggcgaggacggggggcgcgcccgtgcggggcggcgcacacggattttgggtgtgggggtgggggcgggtttcgttttgtcgccgaaaccgtcacgggcggaggggagaattgtatatgtgccactgttaaaagctggtttcgctcgcttacattttccataaaaataactttttctcggaccgttttgcccctgaccaaatctcaactaaaaaaaccaaaaaaaatgataagatttgatcgatgggaacccccagttcaggtctccatatagttcttccacattgccaacttcagaagaacgaaagtataaatttacatcgtcggagacaagatcgatccaacaaaaaagagagaccaaaagaaaagcaaaacacaaataaaacaaaaccaaatctacagcgaaacgatcggagcaaaagaatcgaacttttcgacgggatgagcatagcaggtcgaggagatcgattggaaggatgagagagagagccttccatggcggcggagttcactgggtggtggagaggagaggcggcgcggtgggagaagctgcgccggcgaggtggggaagaagagcggcggccgacgtgggggaagacggcggcgcgctagctagtggatgcggcggcgcgccagccgggcgccggcgtcgtcgccatctgttcttcctctcctcgatctgtgtcttcacgcctggaacagacgagagaacgatactggtagagatgttgatttggtccaggggcaaaacggtccgagaaaaaaatattttgatgaaaaaggcccaagaaaaaaatattttgatgaaaaatgttttgcaattgcaacaaacgggaaaaatggcattctagcgaacgcccacatcttaacagtggcattagagcgaatcccattttagggatggcattcgagcgaagccagtttttaacagtggcatatatgcaaat

SEQ ID NO: 824 - DNA, 992 bp, Oryza sativa
ggagcgaggcacaaaaatagcatggctgtaacagtaggtaaatatcccatagtaacaatttaaaacaatgcagtatttaagggaaaacggtagagcatttgcaatatatgttcaatatgttcaagtgacaagcatgacttgccttgctctgctgctggaggaacctcggcgactatttcaaaatacaccggagcgttgggagagcaggaatctaagcgacatacaaagcaaacaatacaaacaggccataagactactgaaacagagaacaaaaccatttttaatagattctatgcattttttcttgatttactaagacttgaatgggcttaaacggagctcggatgaattttctatgaattttagaagattcactgtgttttactataaagagaaaaaccttaattatttattgcgcaatatatcccagggctgacgtcatcaaggagggggcggcgccgacatgcgggacccccgggtcagtgactcgagagagagggagggggcgccggcacgtcggccccacttgcagaggcacaaggcgggagggacgcggctggtggctcggctcggcttcaaaaccggccggcccagcatggcgagtggcagcggcacgcgcggtcgccggcgacggcaaccggcggcgaccgacggcaagcggcggcacgcgacggcaccgcggctagcggcgccaccgtggcgacacggcaccgcgacgcgacggcggtgcacaagtggcgagcggcggagagaaaggagaggaaggggagggccttactgacgatgaacgagggcgactagtgatggagggaggtcggcgaacagcgggcagcgtcgggagagacatagggaacacgatgagagaggttagagggagagagggagtccacggcgcacagcatagccggccaaaggcgatggtaatggagatgctcatcgacgcttggggagaggcgggctccggcggcggactttgacggaggaggggtgga

SEQ ID NO: 825 - DNA, 1501 bp, Oryza sativa
tttgcaaaattataatggtatggttccaaattaccataaattttaataccgacatttacacatatgcagatgatcttttaataagactttagtaaggatggtaagccattggccttaattctcgtggtggtttgttaaggtgcacatttgctaacgtgtagtatgtgtgtagtgccatgtgtttctgtgcatattcatgaataaataatataaaatgttctgggaaactaaaaggctaaaactataattatcaaattaaggatatttgtcttttttttcataaacctcctacctatatttctcttcccgtccgagcatttggcacgtattagtgacactaactctaaactttaaactttaaagtgccactgccgactcgcctcatgtgctcttggcaatggctatcctctcctgtccaatagccaatagtctattgaggtcacggtatatttggaataagtttctttttaccctgtttatatatttttaaatattttttaaaatttcagatatttctcttccttcctgtccagcgtttatgagtgacgctttggaagcgcccgctgccgcctcggcagaggctcgtctcctcgcgcggccatggttatcccctccttccccctgcctcgcctccacctctccctccaactccacaaccccagcgccatcccgagtccccgccgccggccgcgccccgccccgacgagcgagacgctccgccgccgcctcctccgcaagggcgtctccccgacccccaaaatcctccacgcgctccgcaagaaggaggccctcaagtccctccgccgcgccaggaaggacaccgccgccgccgccgcggccgcggaggcggccagcaatgcgctgcccagggaggaggacggcgccgcggtggtgggcgaagacgacgaggcccgcttccgcgcggccgtcgccgagtaccgcgcgctcatgggccggccgtggcacggcggcgcctcggcacccccgcgtggggccctccgaggcgaaggcgagggcctcgacggcctccgcgagatgctcgcggcgaggagggccggcaagttcgagtggctactggaggatgatgacgtagaggagggtgaagaggaagcggcggtggggaggcgggggcgtgctggcgtcggctggaattcggattttcgggatgaggagaggaggattgagtcgctggtgaggaggtataagcgaagaatccctccctgttcgtgctcttgctgtttcaggcgttcttggcctttcactgctttcgagtagtggtggttgctttatgattttaataatcacatttacaagaatatgagatatggcagaatttagatagatagcggtttaggattcaccttatgtgcatttaacttcattgcactcttcattatcctaaatgccaatgccattattgagttaaatcgttcacaatgaattgaattgcgtgaaatgttgtctttgttccatattgcataagtaagttttttttgtcagg

SEQ ID NO: 826 - DNA, 1501 bp, Oryza sativa
atcccgccgcccccgtccgccccgcgtgcaatcaagaggggggaaatattccccgtgattccctccctctttccccccatttttccctccctctctccctcggattcgtttggaaacctctcccctaacttcgccggcgccatcaatggcgaccggatcttccgcgcccgtttccccctcgtccggcagctccctccccctcccaatcctatataaaccttccccgtgcctccctccaccgtttccgccactcgccgccctctctccccgtcggaatcgagctcgcgccgtcgctctctctctccgccgtcgctctctctctccgccgtcgtcgccccggaccacctcccgcctcggcgtcgccaccttcggcttcaccgcatccccggcgacctcgtccacccctccgctctggtcgccgtttctgtcgtcgccgtcgacccggggtgagccgtggaccgccgcttcttttcccccttcccttcccctctctcggccgccgctccgccggtgcctatggccgccgccggcgaccataggggcacgggcgcgccgcctcccgccgctgcgccggcgtggccgccttcgggcgcgccccgcggctgccgtgtggggcccggctgtcagccgcccgcgcccttaggtgcggctgacgcgtgggacccacggcgccggccggtgcgagcccgggtgcgcccggtccaccgtgggccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgtgtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaatccccaaaaatggttttaggctgggctcggggtgcatggttttgatagtagcac

SEQ ID NO: 827 - DNA, 1501 bp, Oryza sativa
ttttttctattttttactgtggcatgtcgattttttaaaatacataattttgaattaaaatactcatgttgttctgggttgtcctaatatttgactatcaatttcgataaattattatagttccatacaatgagattccaaactcttagagattcaccataacaaatattctctctgtttcaaaataagtttattttttacatatctcacacataccaataaagaactagaatacccctgctttataaaatctcaatgcaactatttcttactaacttcaatataatgattacttaaaaaagaacttattttggaatggagaaataagtttcgtaatataacccacgtgttattaagctatacagatttttttaaattaatggtacatgtttcataatttaaaataaaggtagtattttgttagcgtggtttactctaggcctcacgtgtatcgcgggtacgcggtttgtgattatatggtctgatgtacagtcacaatatagattctgtgaccaccacaacctgacaaaccatcaacctatgtgtgcacatagtatacaagtgtcagcaccaaagatgatctacgcaacaagcctatggcagctagctagcaaggttaaatttggagtgttgtttgatatgacgtagacatggttaatgaagctatgattgatcttaatatgtggttgatacagctacgagcctatgatgggagtttgaagcatgattggttgatatttgctttatttgatctcttattctttaatcaattacttactatagctaacagtcttattcaagctagctagaatcggtgcgtatgcaagcaaagttaatcattaattgcatttgtcttctgtacaccgtttctgtggctgtgtttacttgcatgtcttataagattgacagcaggtaggagtagcaaatatatggaacaactgaaagtcagcaccaaattaatgacgttttgtgttgcaaattaaatcccgttgggaggttttatgcataaatgtgtgtcctgcaggctactggtagagtgctagtcgatgccctcgttttccacatttgattttggcagaaatactatgatcaattgattagatagttactgcgaaattgaaactaagggtatgtttgccacggctccagctccaactttatctcttctagagttgaaactcagacaaacagtttcaacttcatctaaataagaatggatatagctgaagcgctttcacaaaataaattagagatgtggagctgggtttaagatgctccacaatttaactctaaacctaacttatgaagttaatttaggagttcgagctctaccaacgagccctaaaagaatggcatgatcggtagcccaacgtattgaccaaaccgtttagcatacaaaactcgtgaacattgtcactgtctttggtttatatataagttgcccaaatttgctacatttattatgtctaaactcgagttggttaggttatcataatcagca

SEQ ID NO: 828 - DNA, 1501 bp, Oryza sativa
tttaaattgtgtttgtgaaacttgggattgaaatggatgatttgtgttgagttgtgtgagtatgattatgattatatgacttgttgccaaggaagacaacaagggtatgtttatgatgatatgatgttatttatgatgaatttacaaatttgttttgttaattgaatcaactcctttgcaaaagtattgtgaaccaaaacttgctttatgctgaaatttaactacatgttgccatcctttgaatatgtcttacatgtagtatgataggattgatttttggcttgacagtacattatttttaataatgtaccgactcttattattctggaatccatttttgttggttgtacgtttagattaatttgagtgatgagggtttcgcgtgcttcttctaggacttgaacttaatgggttaacccccctagtcggagtgcttgtgtttgggtagtcaagcttccgctgttctctgataaatctatatttggccggtcggcccatgtaactataaggtagttgtaatttgagatcactttcgtcttaaatgtatttgctatgtatatctatgcttaagatgaaagtgtgaatctggtgcacatcctgggaactagattcacatgaatacaagttaagtatatttgagatgtcgtatatcttaaaccatttttgtcaagtctcctgaatgtgtaacacatcttatcaccaccttcgtggggtttaacgggtacatctcaggctgaagttgactggcaggctaaagggccagcaatgtctccaatatccttctctcgaggcatcggatatttcattatgtttgtttgatgacttgaattattcacttcatccctcaaatataatgagaggttcggactgcctccgtcaagctgtgtgcatgataaaataatgaaaatagttgtgtgtggtcctgtgtggacgaaatattctttttggttggttggttggttggttaaaactatagtgatgttggttggttggttaaaactaagtgatggcaaatgttgtttaaattcaatttatatcaatttattgtatttaaatctgcgaatgcatttatgcaaattaaccctaaccttcctttgaagccttatatcatatattgtatattcccgtacaattgtgagtactttatgtgctcactctcgttgtctcaccaaaatttcagagaatgcctgctgtttccagaagtttctgttgtggaggaagttgaatagtttgcgtgccctagtcaactgcccgtggtgtgttgttgatgctctgcgcttctttttcggttgtttatctctgtgcttcatactctcatcactagacgcgttcgggatctcatcaaatagttctgaagcgtagatcagcatgtttgagaaaaccttatccaaaatttaaaaacttttaagtcaatgtttgaaattacgtatgcggatgcgtgtgagacttgctactcgtttctctctcgcgcacgtgcatattaggaagccccatgagtata

SEQ ID NO: 829 - DNA, 1501 bp, Oryza sativa
tcgattgctgcctcattgatctttggatttttgacgtactactactcctacattaataatatagcccacttcttactattagcctatcctaaagttaacacatataataaattagctataagattagctataattttcttctcctatctctatctctcacttatacatttaatgtatttgtcttggagcttgtgttaagctagctcttacatgagagccaacatccttctcttctgtatacctctcttctccacataagcttatagtagatttataactcactattatactttctctaagtaaaaacgcggcgggtggtacattggtacgtactcggtcagttgcatatggtgaaggatttgactgaaggtatcctgtgtgttcatgtgcctagcctcgttataaatggaaagggaatggattacaaagacgacttttaggctcagttcgttgcttggtgttggtaaccaatgtctcgcccatgtaaaacggagtgacttattagtacatgattaattaattattaactatttttttaaaaaaaatagattaatacggagtataattttttaaggaacttttatatggatttcaaaaataaaagcaaagcgtgcatgccgaaaaaacatgcaagttgagttagtaacctcaacaaagaactcaacattaagggtgcattcaggaacttaattattctctccgcatggaaaacaagatagattaggtcattagtgtgggattaattaaatattagctaaaaactaaaaataaattaatatgatttttaatttttttaaaaaatatatcgtttagcagtttataaagctaaatagattaatatgataaaagaaggcatgaaagtaaataattaaacgagtcgacaacgatcactatacacatgtgagaagcgccacagacgcaaggtgtacagtgagggatgatggtcattatcgagtgacttaaaaagataatcctagctatatatatggagccacaaattaaacgagttaagtgagagtagcaaattagtttcaagatttcatagtctacctatcaaacataaccattatttgccataaataaataaagtttaaattatgtaataagcacacaaaagctagcgtccgatgtatgttgaacaaaaaattagggggacggtcagaagaatatcatattttgcctttccacacatatacagaccataggacaatgttagttcaagattatcgagatactacctctgtgttttttaatatggtgacactgttatgtttttttataacatttgatcatccatcttatttaaaggtttagtgtaaatataagttaaagtaagagtttgtttgatagtaaaaagtcataacaaaataagtgatatttatataaattttttgagtaacataaatagtcaaacatcacgttaaaaaaaaataacagcatcctatatttaaaaaaaaacgcagggaggatatactatcaatgtgaccgttaaaaaggagca

SEQ ID NO: 830 - DNA, 1501 bp, Oryza sativa
atttttgacaatcatggatacgggataccatcagctgagctgaatttagggtattaagcattgcaacttacaccagacaagacaaacatcctctcttgaggattctgccttgatctctcaaccaacgtggaccgctgtaacgtcgacaaagcctttttgtacctttgcaatggcaccaaatggcaaagctggtagaacattttccacacagttaatgacatgaacaataaaaacagctatagagatttgtaccaaaaaaatgtttcagagaaagtaagacatacctccaatgggatatatgttggccgctttggcttcccaacatttagacagggaaagtgagcagatcccttcaaatctattttccaattcttcctgtagtattcaaagactgtcacttcttccactgtatccgagccaccgttgccattttttctctttatttggaacctggatcaggaaagaaaaactagaataaggtcgaggcgcgtttgcagctcagaaatggaattcaggaatatggcctcacgtctgcgaatagcaagtgtcttcagacaaaccgatgatcctaaattcagagccggtgtgagtcgtttttatcctcaggttcttcagtgcacacttggccttaaaaagaaaaaaaaaacaagcaaagaacatggaaactatgtgatctaatgaacgttcactggttatccctctttcaggactagtacattttgttagaatttcaatggttactctcattgagaagaggatggcactcgagatggggcgattttctggttttcttcattcactaaacacaaaagccatacctgtccaagggaggttggatacatatatatatagccatagctggctgctagcctattgctgcaccctcctagtctaaaattcaaaatttgaatgggatgctgtcctagagggcatccaaactgaataaagcataaaggaggcataaaggagatgctaactgctgctgtcctactaaccgcaactgtcctagcaactgaaaaatattctaaagggtagatgctgtcctgaaaaaggtgaaactacccaaaaagcaataagaagaatcacgaccaaggaccacaaagacttatccaacattctccccctaagtcttgtgcgtcgtcttgtgggaaagttgggccatcccgatcctggagcagagctcgaggaacttgatcctcccaagaggcttggtgagcaagtccgcaagctggtccttggtgttgatgtagctcgcattgatgctccattcctccaagtagcttcggatgaagtggtacctcacccggatgtgcttggtccgttcgtgaaaaacggggttctttgccagggctagagcggacttgctatccaccctgagctccacctttccagtgtctctgccgaggagatcactaagcagtcgagcaagccagagcgcctgggtcgaagcggcggaggccgccatgtactcggcctcgcagctggacagggccaccacctg

SEQ ID NO: 831 - DNA, 1501 bp, Oryza sativa
ttctaagctgaatgtgcatcaaatccctgtccaggaccagccagggtacacaaacgacagttgttgacatatagatccacgtcttacaaaaatagaaaagattacaaatgcagcggaaagataaaacgagctagacttggacgcttgacttctgcagcggggcgactccactccacaggcatcccttgacggcagcgatgagatcaacttcttcgatacagctccaactggaaagaacttcaactctggtgtgggggaaaagagagcaaggctgagtactacccactgtactcagcaagacttaccggaagaggaggtatgatgtaggatataaccaaaggaggctaggggttcatttgcacaaagctagcatttaaaagcagaagttgaaagcagtaaaacagttgtagtaattaatcaatattaaccaatcactgtccaacgctacaccacgttgcaacaggcccaaccaaccacctgaactacaccagttcattaagctaaactaggggtaagactaatcacggtgaatctgggtgatcgcccataaccgcgggcacggctattcgaatagttttactctggccagaggtgtacaactgtacccacaagatacgattccacacatgtcgacatgccccgaagtatcaccataatactgcaaagggggaaatcgtgacaagaccctccgcataaccctcccctaaccatccacaccatgctaaggtttcacccccacccctaaaaaggcagtgggcggtcccctcttgtgccgtggtgaatccggcaactggacaaccggacaccccggccgacccaactccatcatgcccaccctcgccaccggtgcctaggaaagggtcgagctatacttcagatcaagcagttacccactcccacttgtggtaagcacggtaagtctcccagggtttcccgtgaaccggtccttaattgccatgggtgcgaccagcaaaaccatgcacccatagcccaccattcagtgtattttaattaactaacaccattgcggtggcactagtccaaagctatgctaatagtcaaagtctatgtaataatgtgatccccatttgtgtactagttgaactaagcatggctaagcatttccaaaaccaacatctaatcattttgatacccaagttatcaatggcataaggcaaacaataaatggctgagtgataggacccatcccacatgacattgtaaaagaatgcaacatttaatagaaatgcgggatatttgtaaattgggtacaatatgatcaattgtaatgcataacttgccttgctctcgcactgatgagacctcagcaacgtcttcgagaaaccgcggatcgacgaaacggccgagatctatgtgacaaacaaagcacacaagcaaaacatgctataagactactgaaacaggaaacaaaaccatttttaatggattctagggatttttatgaatttactgagacttgaatggacttacacggagctcc

SEQ ID NO: 832 - DNA, 1501 bp, Oryza sativa
agtttatacttataaccttaagagcaggtacaatagatgactataaatcagctataaacatatgttgagaagataaaaaaagagaaaaaagagcagcttcagcatggacttcaagacacaatgtgttgacagatgggactagatattaatagtatactatatgtttataggtaactattgtatgaattagttattaaattgactataaatgatttgaagctaatagttatctatacattatattaaacttggtcttatatagtaaaaagacagtaatgatagctagccctggcatttgcaaagctcggagactgtgtgagtacgttatacgtactgtacatctcacgggatcatcggaacgtgcaaactaatcgaacgtgccacacacctaataagcacgcggccccagcaggtccatcctcccagcacgtgcgacctaccaatttcctcacggacctcaccgctccgtacgtttgtgtttgacgacgtctagggctgtaaaagaaaaaaaaagctgggcactcagtagccactcacaagctgctcaatcgccacgagaggtgcagtagtaagtggctaatccataaactcacttatatattaaaataaaacaagtttataaataagtttcactagttaatcaattacacctttaaccgactcatcgtaggcttaatagttctagcttggctcgagcttctgacaagtcaagtccgagcctataccaaaatctcgtgagctttgtcgagctgagctcaagctattatcgagcctgacaatatatgtattttattttttactttacaaattagtagatcaaagtatatattatattatttatatataagtattcaacacaacgaagtagtttgtatcggtgccacatatttatattgttttgttttctccttatttatgtatgtatatgattaaatagaaattagttgcttttatttattgagagattcgatccttaaaatatatgtatagtggtactccctccattccagaatataaagatttttagggttgaatgtgagtactaagaaaatatttagaattaaatggaagaaaatgatgattggtcgagaaatagagttaggcgagaaaattgaatggtgaagtgttgtgattttggctgagaaaagaatgttatgaagaaattatcatattttgaacaaaatacaacaacatcttactctctcagggatactttacaacagaggtgacttcttcatgagttatgagccagctcggctgaagcttatatcgagctcgaacctgcacaggtgagctccgctcgttgacagccctagcgacagtccccgtgggcgccatcgccaataaaacgcgcgcgcgccatatatagccaagctcctgtactccgtgtagctgctcctgtacagtacacctctttcctcctctctgctcgccggagacagactagctaagctagctagtaggagatcgaggagggattgaccgattgagctagtaataa

SEQ ID NO: 833 - DNA, 1501 bp, Oryza sativa
agctgaaactgtttggctgagttccagctccaggaggggtggagctggagctgtgctaaataggccctaaattttaattattacaaacttgaaaaatagattaatatgatgttttaaagcaactaccgcatagaaagttttcgtataaaatacattgtttagtagtttaaaaaacgtgatattgaaaacgagggaaaatcttatcttgatgaatgtaatgcgcccggtgatacatcgagaacctcatggctcatgccttcctaatcgtgctaactacgccattatattggattcggacgtacgtaatcgcagtgttttaatccaattgaccattagtggcgcgtgtcacgcactctcaacgatctcgtacaggggagagagagagagagagatccgcggacagaggcaaaatggtcaattgcaatataatagagggtttcaacaactgcaaaacagtctataaaggtgatgaatcatcgaggtgacaaagaaatagtcaaatagatggtaatcaattgcaatatagagggtttcagtgaatcaattggcaaatcgttgattttctcgcaaacatgagatatataaaatgtataataagctagcttgtgatatatagctctgagatcagtcaagacaacgcggcgccgtgccgccgtgcaacacaaaaagcccccttcaccggccggtgttgcatacctctcgtgctatgtgcatcgcgtccccaacaccacctacggaccgtggttagttttattttccctaattaaccaactgaatcaaccaaaaatccaaaactcaacaacgtacttgcacagttgcacttgaaaaatacgtatttgaagagaagcaaacgtgtgcaacttacgaccccaatattttagcccctttgattagaaaaaaattaaatgatcgtattgctatagaaaaaactcataagggcattgaaatttgggattggatcatatcttttttgaaattcatatgaaattgaaaaaaatggtaagccccgtgcagacggtagatagtcggaagttgtctatcatatggtaaaagacgttggtcgaaatcgtcatatatctgtgacgttgtcacgtcgcagaagggatcagaatgagcggggcatctagatctatactccctccgtccctaataaaatcaaaccttagcatccaagaagctattaaggaaagaaacaaaagatcaaataacccttaactaatgcaaaaattgtaggcaaaatttgcttcaggacatcgaaaaaaagtgtaattagttaggggacaccgtaagaacgcgtatttgctgtagggcattgcaaaaaactagtaattagctgttgaatacccgcgggattattttattatatccggacgaattggagagagaaacagatgtgtaagtatgattctaccctttaattttttcctttttctttattcttccttattcttttctccctctttcattctttctctctttcttttcttctctttcttcaacc

SEQ ID NO: 834 - DNA, 1501 bp, Oryza sativa
aaagtatccatccctaataaaatattgtacgaaaaaaataacaaagtcagtgacatataattaacaaagggaaacgaaattaatggtaaatcattgaactggaataaactcaaattttgatccctgatacactatgtgagtactaatgagaatatatccacgatgcagcgagagtgcatcgtgtcgggaccgatcgacgggtgcgcgcgagtaggcggatcagatcgacgccgccgccgacgtacgtacgcgcgtttcacagtctagccgggaccgatcccgacgcgacgtagctgcagatcggagatgtaggtatacgtacgtagtactgtatatatagtagctgagacgtgtacgtacaccgagtagctagattggctgaaagctagggcggctttgagctctgccgctagctttagctttgtggtctaaaaagctgcctgtgcggtggctggcttcctgcactgcatgcaggtcgatctctgcgacgggcgacggcgcgcgtcgaggcgttggcggcatgcgcggtcatcgctcacgcgtccgcggggatggtggcctgcggtgaccgcggagcttgtagccatgtgtacatttgcacgcaggtgcggattcataaataaatagcatgaaaggtattccctccgttccaggttaatatgttttaactttgatcaaagtcaaactactttaattttaactaagtttatagataaatatagtaatatttataataccaaattagtttcattaaatcaataattgtatatattttcataataaatttgtcttggattaaaaatgttattttttttctacaaacttagttaaatttgaatcagtttgactttgaccaaagtcaaaatgtcttataacctaaaacagaggtagaggtagtaattaaatttagagcggttcagtgggagctttcatagtcctagtgtcgatagtgagggctcaagctcccacggcaccaatagcagatccgccgttgcaagcgcttccctcaatatgttacacactagtacaaatgttctttattttccaacacctataagcttttagtggtgtgctggatactttctttgtggaagattaaattgccaacaacattctttacatccacatcacctaatgagaggattgtgtgcaggaagggattactagcttgcaccgtaaaacacacaaagaacggtctatacatcacccgacccgagtaaacccctgctcagaattaatattgttggatgtccagaccattgtcgtcaatttggaactgtgagtgtatctcctgattattttttttttataaggaggcgtcactccatttcttgattctagaaagtaagtgcattatatgtatattatcaagattcttatatggtgcgattttttgtaaaagttctatatgtgtataaagccgtggccactgacctaaaattttcatgtgcacatatttcttgttttattcttgatagttcaacttgtgttcgtgatagga

SEQ ID NO: 835 - DNA, 1501 bp, Oryza sativa
gatgaattatagaattatcaaataacaaattaaggccccactatttttagcctatagccccagattatcaataggattattcgtgccacacttccaaaagtacgatttctgtcagcgttgcttagttttttctaagttactgtaactttattttatatatatatatatatatatatatatatatatatatatatatatatatatatatacacatacacacacacacacacacacacacacacacacatatatacatacctataaacaagtagatcatccatcaactttcatccggatttcagctaaaaagaacatgacctaaataattataaaatacctacaacacgtattatcaataatcacataattgatagtactctacaaaaaagatcctaatgtaccgctataataaaaccataaaggctgctttctctggctactcctttcattgatgtaaagaaatgtgaaagcaataaaaatataaaagctgcaggctgaagcctctcactcttcccatctctcataaagcatccaagctgcttcctccacaatctccttgtgctcctgctctcctttctccatgaaggagctgtggaaggctgctgtatttcttcaattttgtctaggagtctgagtggcttaccaacttcctacaacctcctaggctgataggcccagcccacatccccctcgtccctctcctttcctctgttctcatccctccctgccacacttcatgaccatacagcaaaccaagttaactactaactcacggatccacaatgaccctgggtcttgaaatgtggcttcaaccctcatcttttttgttctgtccactaggccaacccacatatcgtcctctctcactcccaggcccttatatgagcttgttcagagtgggaaatggaatagcccccccccccccctaaaattctaaaattaggggcaatttttttttgcttaagtatataatactatggcacaagaaagacttaatggattgcaattataacacttgcttgcatcattttttttaaaaaaaaaattcttacgtaaaaaaaaatataacagttgaaaaatatgtttggcagaagattaattattatcagatatatattgttgaagaatttgtttcaagtaattttagacggatgtcgcttttcagtataagttaagatatattaagtgtttacaagcaatctttactattttagcatgaatgcgtaatataattcttaacattgtgaaatgaaaacatatattgcagtaatataatgagaaatatatattttggttattgacacaaatatatgtatactttgtgttttgcaccagggtctcaaattgttgggtacagcctgctcgctccctcaacctccctggcaccctgcccctctcagtgtctaagcctagctgccacaacagcaagcagcgacagcatgattaggtggggcaagaagcaaagcaaagaaaggatgggggagggagagcagcaaatcaa

SEQ ID NO: 836 - DNA, 1501 bp, Oryza sativa
ctcgcttgtgccatattatttgatgtccgtcctttgtcaaacttgggtgataattcgactagcttgtgttacttatgttgacctagctagaactacatgcttagccatgcttaattaccactagctcacataatgggataattacagttttagacatctagtatcttgacgagctgcatgctcgagacatccggccatgtttcattggtcataattatccaactaaaatgcggctgaatgtgggctgtaggtgcatggttttgctagtcgcgcccatagtaattaaggaccggttcacgggaaaccctggaagacttacagtgcttaacacaagcgggaataggtaactgcttgatctgtagtatagctcgaccctttcctaggcaccggtggcgagggtgggcgtgatggagttgggtcgaacggggtgtccggttttccagatgccagattcaccgcgatgcacgaggggactgcccacctccggggtagggggtgggggtgaaacctttgcgtggtgtggatggttaggggagggttatgtgaagggtcttgtcacaatcactcaacatagtgatgtgtctgcgtaggcacggtgacatgccggtggattgtgacttgtgggtatagttgtgcacctctggcaagagtaaaactattcgaatagccgtgcccgcggttatgggcgatcaaccatattcaccgtgattagtctcacctttaactggcttaatgaactaggtagtttaggtggtttggttgggcctgttcaacgtggtgtagcgttgatcagtggagatttaatattaccttaattaatcaactgttttattgtttcgctcaataaaatgctttgcaaccgccactacaagaatctatttaatctgtgacgaaattttcgtgatgtttttagatattgtcacggatatgcaactatggatacaaggcccataataccgtgacagtttatcgatttcgtcataaaccggcccaaaacctgtgacgttatagcaatttcgttgctatttaaatacttcaaaaccatataagagatatgtaaattttgtgaacaatgttactatcacttcatcggatgaagaaatgaccaaaataaaagttatagatattgatgagttatacaactttgatgttgataactttttcagttgaaatcatttagtatttgaaaatattgtttgaagttgtcataatttgaaattcaaattcaaattattgaaatagagtcatatagcaaaatgaccaaaataaaagttgtagatatcgatgatttatgcaactttaatattaccttaattaatcaactgttttattgttttgctcaataaaatgctttgcaacgcgccttcatgcaaatagccacaagccctccgttgtatccccttgcacgtctgcatcactggtgtggcttgctgagtacagttattgtactcagccttgctattattctccttttttagaagtgtagcgcttctgagctgaa

SEQ ID NO: 837 - DNA, 1501 bp, Oryza sativa
tttccgactttcggagagagcattttgcaatgcattatgatagtgagatatgcacataaaccaaacagatgcaatagcactagtcgcaggatggatgttcatgccgatgatctgagttttctttcagagtccgctgctttcaagactacatgtccttttctactgcggctattacaacaatgatatagtaaatattgcaattcatagcttatacttagtcggcttatgcggatatttggtacttcgtgctaccaattcaccaatcatcaaatgcaatgctagcattgtcctcgcggacttctgaagatgatttagtgagttctattggagttcacgtgatcttgttgaatcagtcttggcaaagacacggtgtctaagagacactggatgtttgctgcttcggaagcgcatttatccatacagtaccaaatgggagccacatatattcttcgcaatccagttcagggatgctagaactatacgctgtttatgcattaatctcctatcggtgcatactagcacacaaatcttcatgatttaggaaaattatgcatatatgtgctatgaccatatgagttgtaatatttattcttataattctaagaccggaatggttgaaaatccgttgctaaaaggtgtagcccaaatcatcacacttttagaaagttcaacggggttgacgaacaatagatgcttctataaagtgcatcatttgttccataggtaatatgaccatggcactttctaggtcgacaaattcagttgttgctgttagcaacggtcataatatttccagttctatgggtctggaaatacctctttctcttaaagtgttatttgtggttatgcggaccacaattcatttttcttttatgtttggacgctacacaaaattgaaagcattataactatgtgccagaaaggagtgataaaatagtaaatgccttaaatatgctattttatactaaaaataattctttattgcagagaaaatgtgtgctctacttgggcaaggaccatttctttgatgcaatgttcaattcaaaaaattgcaacacgtgatgacgaagtatattgattcaacgaagtattccggtacatcggattcaatttacttcatagcgaatttcttgctcaacacctatggcaatgctttactattctggcataaatcttacggccgatcctatctagcataggagattctacggtcatagccatgcaaataggctaggagttctccccctcaattcatgatgagtgtgctattaggattgtccttttcatgttcctagattgttcaccttgacatgtgttctactcccccttgtcctcttctttcattgaggtaagtgcaccgggctagatgctcgtgttaaatttattatcaactgtgctaggtgatttgggaagacaatgttcttctgacgaacactatgccgaatgatacgcaattctattatcaactagttaggcatacttctcgtatgggcaccagtga

SEQ ID NO: 838 - DNA, 1501 bp, Oryza sativa
ctacaatgaatctgtacagaaagctgtctatattcgttatacagctagatagtgtaatatccaatgctacaatgacttattgtagggcaaagggagtatatgattttgtccttttttttcaacctacaatagcgttgcgtttcatttattatgcatggtcgatttactgtttcagcatgcacgggtagctccccgtcgaggaaaaaggccgtgcacggaaaaaagaaacatatgctactggagtactggtcctggtgtacgtactatatatagcagtagatcgatgcatgagcagcacgatcgggcgcgtcggcgctctcttgatcgggaccatggccggccatatattcgatcgctttgatccataatccattgttgttcatgcatgcatgcatgtgcatgcaatggactcgcctgcgtacgtacgccgcgtgcaggggctcgattcgctgtacccaacgttccgtgcatgcacaatcgcacatgcacctgatgatgcacgcatcctaattgctacctttaagttaacctcacctgaacagggaaacgatttggccttttccctcaattagtaatatgttcttgctttacaacgagtcagacctatataatacttcctctgtttcgcaatgtaagtcattctagtatttcctatattcatattgatgatttattaatatcaatatgaatgtgaaaaatgctagaatgacttacattgtgaaacggagggagtaattgattgactaggtgggtggatgaactgagaacaagaacaggattctacgatggttacgtacacacaaaaggagccgaccacctcctgcctttgtcagtaaaactgtgcttttataattagtagagatatatgagaatatgagcatgttcagattatagccaaaataaaccttaccaaattttggcaggatttcttatgtattgatcaaatttagcaacaaactaaacggtaacatttttttgacaactttgcaaaaaaaaagaaggtatggtcgaaaatgacatcaaagtgaacctgccctatatgtgatacaaactatatatgtaatgctaaactatcattggattaaaataggtgtctaaggctgttcacatcagtaaaacttttactactatattaaattattagtaaaaattttacaggcagtacatggataaatatgagacgtctattttttaaccaacggtaattttcacattttctatagtcgtgatttacgctacatattttcttgcaatatgggccggcccatgtggggataaacgttggggggcacacacggcaggagtgactcaaccgcaggccgaccaacatgcagttttcggccaattgggccggcccagacgattcggcctgtccattggcaaaaccctagagtgcgtcgagtccgcgcagccagccgccgcctgcgctagctgcgccgatcgatctctctccgtccggcgatctgctaccgccgccggccggaattatttccggcgacga

SEQ ID NO: 839 - DNA, 1501 bp, Oryza sativa
tggtgggtattttttcacccaataatctaaaaaaagctcacctaaatgagcttatcggattataataagctgtgctctagattataataagctacttcaataagtctacttcaataagttgtctatttctttcagcttactcctaattatctggattataataatctcaatctgaaagaaacgtagccttatgctagcaagttgcttttagattactttagctgctaccactgatttgtctttttttttgtctgccatcctctgtatatggatgtagtcctgaaaaaaaaaatccaattccgaggatgaatttggatatctttagaattgaatttttatcggaacagaatgagtttgttgaagttagtaacattttcatatttctaactgaattactacagtatagcattgcacagcatcaaatgagcatttcaaacaacattcttactcgtaagctgaaacttgtactccctccgtcttattttaagtgtagccatccgtcctattttaagtgtagctatggttttccgcgtctgaccttaaccgtccatcttatttaaaaaaattttaaaaaaaattgaaaacataaaatactattcatgttttatcatctcataacaacaaaaatattaattataaaaaaatttcaaataagacggacgatcaaaatttagcgtggaaatttatagttgcacttagggcagtagcagtgcgtcgtcaaaatttgaggagcctcgcatgccacctgtgcaggagaacgcccaagaacaatactccacagtgcagatttttttaagtggggccaccaatctttattcccttttacttttcatctaccctctctctatcctctagtcttcgttcccaccaaagaaagtcactgaaccatgaactcctccccaccgacggaatcagcaaggcggcgaccggagcgacggctgggcggcccaagcagcgagctcgtcctcgcgcggagccgagcgaagcgctggagcggcgccgcgtcgacgagccccagccggcacagatcgaggggcagcgcggctggcgagccctggccggcacagatcgggggggcggtgcggccggagccgccgctcctttctcccggtcggccccgccctcccctcctcgctcctctctccctctctcctttggcacgtgtgggtcccgccggctgtgctccgcgttctcgaggattccacgcgaattgccgatgtggcaccgaatattcggttcttgggtgcgaggctgaacaccacctcggtgcgttgtaaacacccttaaaatagaatggagggagtactccaaataaaaaaggcaaatctcataatacgatgtgacatatggatatatgatgcatcacatctttaacacgaggttggtttgtttttttttttttgaacggtactagtatttgtgttcaggacaccggtgcaaccttgaacttgattagcatcatgcagagttcatatacacgccactaatatactccattttc

SEQ ID NO: 840 - DNA, 1501 bp, Oryza sativa
tgtaatgtagagaatctatagtactgcatcctgtatgacaccgttgatttttttgacaaacgtttgacctttcatcttattcttataatttattttattgtgacttaatttatcatcaaatattctttaagcatgacataagtatttttatatttgcataaaaaatttaaataagacgaatggtcgaacgttagttaaaaagtcaacagcgtcatacattaaaatacaatacagaggaagtacctggtattagaggaaatggagaccgttcgatcaaaaaccaagaatcagatagtgtgctacagtaaatctgttgtggtactcaactgttactgttgctacaatagatcgacattgttcactgcattgatttatcttgcttctcacattgttcactgtattattgcagaggatccgggcccacactatgtcgatatatatatgtgtatgtgtgtgtgtgacaattagcagcagcaaaaatcaaaggtggcgcctctctctctctctctcttgccaaatacccgaatcctcgcataaatctgttcgaattgacgacacgacttgcaagttgcccatttctacggatgctctgtacttgtatcacggattctcactgtgtggactaagcatggactatgtatgtttaattttatctgcatgtctaagctagcgctttttatgaaaagttctatcatatatatctacttaattatatagaaaatatttttctttctgtaatgaaataagatatctgatctttaacagaagctatatatagtgtctcgtattacaagtaagggtcttgggcactaacgaaaagttaagtttggaacacacactaaaataaaagaaaagagatgcatcttattcgatcagtaatcaatctagcaatctaattaaatataatctgtcgtttaagtgatgcatgatgcatgtatataacagaagaaagttctttttaaataaaaatcgtatctttaaaagtgtgttgcagaataattaatccggttgcaacttaccacttcctccgtttcaggttataagatgttttaaattttgttaaagtcaaactactctaagtttaactaattttatagaaaaaaatagtaatatttacaatagcagcactactttcttttataaaattagttaaatttataatagtttaacttttactaaagttaaaatgttttataatctgaagcggaagggagtactaattaattctagattggatacatatatatcgtcgccgtctcttcgatcgatcatctcaatctgaacatgatatatgtactgtgtcgatctagctttatcgtcttttctttccatgctgactttttgcaagtggtttgactctcaagtgagagattaatttaaccatctcgatctcgatcatgcctgatctgtattaaaggtagatctgtgtttggtagtaacggttctagctagtactactccagctagctatacagctaattgccacacgtgtttagcagta

SEQ ID NO: 841 - DNA, 1501 bp, Oryza sativa
aggagagcgcggccccccggcgacgcggcggcggcggaggaggagacgggggcgcggggaagcggaggcgccgccatcggaagcagcagcagcagcgcagagagggtgacgggggcgatgtcgtgcgcgatggacgcgtcagcgtcacctcgcgatattccggcccactatatctggaccaactcaggcccagcctaaaccggcccgtaatacggcccacgttagcctgctttaggcccgttattaaggttgggtacgtagatggaactattagcgtatgattaattaagttttaattaaaataaaccgaaaatagatttatttatattttaaagtaagttatatatgcctttttttaaccaaaagtcgagataaaatatgtgtcttatttatagtacattaatgcaacaactagtggtagtatgcttttgacgaaaaccgatcgaaaacagtgaaaaaattttaggttcaaagcgggacgaaagcaaattggaagtgaaaattttaatggtttttaagaattcataatacgtttgatcgaaatttggtaaatatcgctgtacttcaattaaaaaggtgaaccggctcggagcgcgcgcattgctttttttaaggaatcataataatgtcatcagcacatgattaaatctattagagaataaatgggaaataatcttttagaaaaaaaagcatatttcttttcgtcgcttttatgttccttttcatgatctatttctgggttggatgaaagcgaaatggcaccaccactgaaacttttttcacgggagaaaagagcatagagaaaaatcaacaagaaattgttggggagtttaaaattaggatgacagagcatcctaggcaataattaagcaggcaaaagccctctttaataactgcctaaaaaatgtgttggattaggaggtcatcactgtaataataaagaggaggctggtggagagcccctccctctctggccctgatctcctccccctctcacttgccctgcccaaggtgaccatctctttttttttttgattgattgactgatttggttgatgatttcctctgattttgtgttctttctccttcgatcggttctgtcaagagcgtgttcagaggaatttagggttgcagttgttctgtttggtgcaaagatttgtggttgctcggttggtttcttgatcgtatcctaatttcgtttgcggccttgttgaacatgttgttagaatcttctgttcttggtgttaatttgtggttgccgttcttgttttttttttgttcctggttggatctgagtggttcttgtttcttgttgatggaactttgttcttgatttggggatctgagtgcctttcgatgatggaaaggaaaaggaaaaagaaatcgtgcattgggttttgatctctcggtttgttgaatccttcgtcgcagcccaagagaggaatccaagctgctgcattgacggcggcggcggcggcggcggcgaggagatcgggagcaa

SEQ ID NO: 842 - DNA, 1501 bp, Oryza sativa
cgtaaatcacgactatagaaaatgtgaaaattaccgttggttaaaaaatagacgtctcatatttatccatgtactgcctgtaaaatttttactaataatttaatatagtagtaaaagttttactgatgtgaacagccttagacacctattttaatccaatgatagtttagcattacatatatagtttgtatcacatatagggcaggttcactttgatgtcattttcgaccataccttctttttttttgcaaagttgtcaaaaaaatgttaccgtttagtttgttgctaaatttgatcaatacataagaaatcctgccaaaatttggtaaggtttattttggctataatctgaacatgctcatattctcatatatctctactaattataaaagcacagttttactgacaaaggcaggaggtggtcggctccttttgtgtgtacgtaaccatcgtagaatcctgttcttgttctcagttcatccacccacctagtcaatcaattactccctccgtttcacaatgtaagtcattctagcatttttcacattcatattgatattaataaatcatcaatatgaatataggaaatactagaatgacttacattgcgaaacagaggaagtattatataggtctgactcgttgtaaagcaagaacatattactaattgagggaaaaggccaaatcgtttccctgttcaggtgaggttaacttaaaggtagcaattaggatgcgtgcatcatcaggtgcatgtgcgattgtgcatgcacggaacgttgggtacagcgaatcgagcccctgcacgcggcgtacgtacgcaggcgagtccattgcatgcacatgcatgcatgcatgaacaacaatggattatggatcaaagcgatcgaatatatggccggccatggtcccgatcaagagagcgccgacgcgcccgatcgtgctgctcatgcatcgatctactgctatatatagtacgtacaccaggaccagtactccagtagcatatgtttcttttttccgtgcacggcctttttcctcgacggggagctacccgtgcatgctgaaacagtaaatcgaccatgcataataaatgaaacgcaacgctattgtaggttgaaaaaaaaggacaaaatcatatactccctttgccctacaataagtcattgtagcattggatattacactatctagctgtataacgaatatagacagctttctgtacagattcattgtagtatgtcagatccaattttagattgttagatttccctagtagctgtcaattaacacatgtttgtaattaaactagtaatgtatccatactctgcaacgtgtcagatctatataactaaaagttgactaggatgttagattgaggataaggcaggagctaagccttatataactgggattgttgggtgagtgaattaagaagaaagtgctggatactataatggttacgcgacctccatggtgagaaaggaataggaggatgaagaat

SEQ ID NO: 843 - DNA, 1501 bp, Oryza sativa
tcgttattcagccgtgacttctgagaggttcttcaattcgctctaatttcattcatgcatgaccgaatggctattttctttttaaactaagtttcagatcatggaaaatagaattgtttttcttgtggatgaaaggtgcaaccagctttgtgtctttttctggatctaggtggcccatttgttggaggatcatttcgatcggctttggcttgtggtggtgaagagctgtagatcgatgcggatgtgtactggttactgatgtgaagttctcctattaatgacgtgacatttaagagataaacttatcgctttggcttatttatgctgagcattgaacacttctcgttaataaatttcctggggcattttctatttttcttgatctgtaatactccacccattttaaaatgtagctatttctaaaatttaaacatgtctaaaaaaatatagctattcctaggtcaatgctattatgtcaattataatcctatgaatccaaaaagccttattcgcgaacgtgcacacaattgctagcgaacacttcctgcctgtataacaacaataggttagggttaaggggtggaggggggctaagggggctgggctgtcggaacgtgcctacggcttgcgaacacgctcgcccattagacccaccctatgaaccacctcgcacccactaacctacatattccttcatgtcttttgtgttttaaagaaggcattgtggtatttttacctttattccttactccctcgaaaaacctagaaatagacattttgggatagaaggattatgcactacaccctccatcttttaattgtagttttagtcttagaattcgtccttaaaaatgtgtggttttagagtggtccactatacctctttaatgctactactaatagtaatctttttttctcatttgtagttattgaatcactacaaatcatttatttcggttttagagtagttgtttggaagaaagggatttgctctgtgcatttgattggagaagtacagaatcaccacttgttttctctcttgtccatacgggaaaatttccatgaagttttgatgtagcttcgttttcgatgaaatggtaggaaaagaagagaaaataaatataaaccttaggaatactattcacgaattcctttgttccaaacggcgcaacagtaaactcctccaagaggttgccctttctccatctcctccatcttcccatatgagcttttacttgttgaataaattaagagcttacataagctgattgtcaaataattaaaacaaatcatgagtatattaagaattgatgcactagaccttggattaaaaccacatgactcttgacagttgccttagcactgtcaagtactccatccgtattagaataaatttattttttggcacatcacatttattctaaaataagttaatttttaagtaaccattataccggagcttataaaaatacaagataaatacataagggtatcctaatat

SEQ ID NO: 844 - DNA, 1390 bp, Oryza sativa
ctatccaacccggccccgccccgccctgttgccatccctaatcaaaactcttatgaatgcaaactcttatgaccagtttgcagttgaccgctactacgtacctcctgcagccgctgtgaaccgcgtcgaagccacggaggtcatgccaacgagcacatccgttagttgaagtttactaccgtagatgttggtatattattttaatataaactcgaccaaaatgtgagaagtttatatacagaagatttttcccggcgaggacccatgtagattgcagacggaccgtaaaggcaggcctcttaacatgttcgcttgtgaaaataagactattttcacatgcgggcctcttaaataatccgcatacgaaaatattcatctgttcccactctttttttatttctcacctcctttctcccttcactaaggcccgttcgatccctaccaatgttgtcaggacacccgaaaatcatattgtccagtgtttattgtgatcaccacataatttcgggagagtgggatccatacatgtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatttagcagtttgaaaagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagca

SEQ ID NO: 845 - DNA, 1501 bp, Oryza sativa
gtttggtagtaaagatgacagttatgtgagtattgatgggaattgaattttaagcaataatgtacatcttagatttatctgtcatacctagaagaaaattgccctttccgattatcacttatccttatttagatattgaaaatgtaaaagtttgctcctaaactcctctttccgaattccgatcctttttaaaactttcacgtctaccaactaaacaatatattttaacagccctatctctctttaacaatttccccaattaaacgtgcctttgattcaaaatacgttttacataaacggacacgtattcagcaagtacggtttttaattagcgagatcacgggaccaggtgcttgcagaaagtcccacaagtagacgtggctgtcagtgtgtcacccatgcggaggtccatggggtccctactccccaaggatggctcactgggctttaattaagagtgctcctagtcctatagcacattcgacacattatatggaaaaagaaattcactctaactacaatgcttgtaatgtaaatacaattacagtataagtatggtgtaaatttgttttgatatcaaaacttgtgctacctcagtggtccaaaaattgttttttttcttccaaaggctatattgtaagttttctagcaattccattaattaatagtagaatgaaataatatagctattagaaaatgtattatgtcccaaaaaccattataagttttctagcaattccattaatcaatggtactatatactatataattagaaaatatattgtggatgatatatggtatgttgaggggtgcgtctcacaatatgatggagacttgacctcagagtttacaatacgtaccgttctgttgttgtggtaaccacctgaggtaatcttcttagttttttaaaacatcagtttttaaactgttgtaaccataatattagggcccatttgatttggatgaaaaatatagaaattttagaggattttaatcctacaggaaaaattcctatgaatgcctttaaatcaaaggattgaatcctatccaatcctttaaaacttctatcgaatggacaatcctatagagattttagaggaaacttagcaaaagctcaaagctcttggaaaatttcctttgagtctatctctctcatcttattcctatgtttttcctacggtccaatcaaatggtcattcctgtgtttttgcagtcctctattttacacttccatcccttattagaatctggtgtttttcatatttctttattttctttttcattcatgcgattcaaaagagacttattggacaacgataacctcaccgaaacggtaagaaaaaccacgcatactatgagcggaggaagtaattgtctacagacatctatggctctaggcccacatgcacattactgtctgtgcagtacagctgcaggtgacagtcccgtccatcaacaggtcccgaacttctaaggccatgtacaacgcgtgaccttggca

SEQ ID NO: 846 - DNA, 1501 bp, Oryza sativa
aattaaccgtatgtgggaccatgcaggcatgtggatgtgtcatcgatcgaccgacggtcggcgacacgctaacgttgaccgatcggatattcggattacgagtagccctatgaagtctgaacttattattatataaacttcgttaatttaataacttattagttgcttaaatgtattaataaattaatcgacgatatatagggccgtacacatatgcatgcagcacgcggagtatgtacagtgttccgtgtgtacctgacctacagtaacagtgaagaatataataaaaattctgggagtactcgtggcaagctgctacgatattatattttgaaaacatgtaggagtagggtgtgtttagttcacgttaaaattggaagtttggttgaaattggaatgatgtgacggaaaagttaaaagtttgtgtgtgtaggaaagttttgatgtgataaaaaaattgaaagtttgaagaaaatgtttggaactaaactcggcctagtataactagaacagcaaaaattagggggtgttcatcaggggtgtaaagttttagcgtgtcacatcggatattatatagggtatcgtatgaggtgcccgggcactaatataaaaaactaattaaagagtccgttctgtcattatatagggtgtagcaccacattgttaaatcatagagaaattaggtataaaagattagtatcacaaattagttgcgatctgtgcaattagtttttttagcctatatttaatacttcatgcatgtattcaaacgttcgatgtgaaaggatgtaaaatttttggtgggatctaaacatgccctatggccgagtttagttccaaactttttcttcaaatttctaatttttcatcacatcaaaactttcctacacacaaacttccaacttttccgtcacatcgttccaatttcaaccaaacttttaattttagcgtgaactaaatacatcctatgttaatatgttgatttttttaggacggagggaatacaccaatcaaagtcaccttttaacagtctgcgagtaggaagtcaaatagaggagcagcatagtaccgaacagtcaacatgtcgttggttgtgtcgatctgcatgcatgtgcatggcaatggccggccgttgatcgacagaacgtgatggggacggcttcgttgggtggctgatcggtccaggccgtacgtagtactctctctattttttaataaatgacacagttaattttttcttatatatttaaccattcgtcttatttaaaaattttatacaaatgtataagatataaatcacacttaaagtactatgagtgataaaacaactcataacaaaataagttataattacataaattttttaaataagacgaatgattaaacacgtgagaaaaagttaacggcgtcatctgttactccagaaaacaggatgtagtaactactccgtacgtacccttaccgaggcgactgattgattgactgtccacggccgacgtca

SEQ ID NO: 847 - DNA, 1501 bp, Oryza sativa
cttcttagattttgttgatctaatggggaaaaggacagcaaagaatagaaacgaaaatacattgagccaacttgatatcattaacatattttgatgagttactgtcatgcatacttttaaatggaagaagctaagttgatgtgtttattagtttgtcctttctttcattgtcaattctttctcaattgacattctgaagcggtgaaaataaaaaagaactgcataggagcaggcaaataggtggcgtgtcctttcaagtttgttgaccttaattctttttaattatactaatcacttgtggaattagcggctttgctagatggatagcttctttccagaagcattccagaaaattcacgctctccactaacttcagagatactataaaaacataattcaaaaatgttttaaaaggttaatgtaataatgctcatggagtgacatctcaatttctatttaaaagtctaatataaaataaagaatgatgtacataacattttgcttctctaaattaattatcaggccatctatagtgcaaataaaaagtgtagttccccatatcatctaaacagcctttgaaaagagttatttttaatcttattttgatggttctaaaatcaattaattcattttaaaaaaaggatcagctcaactgaaataaaggatcaaagactaaagtattaatgatgaagaactttttcaaagatctatctactcatcaaattagttctccgtgactcaaaatttaccttccaagcaacataactccaaacaccatatttttttctgtttgaatttaaattttaactggcctctactgtttaaaagagatagtcatgctccttttctttctctcccccacttcctcctaaaagccacttccttcctataaaaattgattttaaaaaacctattatatcggctctgttcggctgcactcattttcattgtgttgtagccaacagccacattgttttctttgtgcaacagcacaactgctaaacataacagccgaacaggcccattataaaaaactaatcaacctaatatgtttaaaccggatggtatcccacgccatcgataaatgatccagatactacaaacaattaaggtgatgaagtgagcgtagctcaagtgattagattctatgtggttgaaccagtttatccgggttcaagttctagatttgacatgggtgttcgtatttataactaattattctttagatttgacatgagtgctagtatttatggctaattatctttccagcaatagatgcttgtggcgacttcttttgaatctcaagattactagcctagtcttctgaaagtgcttatgtgtgcgtattgtgagcgcatgtatttgtaccgtgtttctagcaaaatatgatgtagtttatgagaggagagttaggatgaacctctaaagtcctttcacagatccgttgtaaagcacgggcctataaataaaaagtcagaaatatcaaaaattttcttttcca

SEQ ID NO: 848 - DNA, 1501 bp, Oryza sativa
cgggtgaaaccaccgcacgcgaaaatgagtttccactgcacggaaaaatcgttattgtagtagtgcgtgtctggctaagtttttctctttgtaactctgcctcccaactaatattagatgggcatgaagccctacaaggacataaccacaaattgatcattagatcaatacaacacccgacgaattcaatccccaaatagaagtagagggcatgaacctgtctaaaccattgacctctttactcattcacttttagaccttgtacactacacccttttcttattgccggtctagaacaatggcatcctccatcctaaaatataaggcataaccaccacaaactcaaaaatgaagaaataatttaattaactagattgtatcacctcgatatatgcacgcaatgtgattagagggcttgatggtagaggattttaaataaaccaaatttagaggaggaagatacactaattaatatatgcatatgtgaacgcattgtattatgagatatgagaaaatgttcaatcttatattatatttttgggatagcgaaagtaataatccagcttggttcagactttccatgctcactgataaattatttatacatgagatgttgtatccagggatgaatctaggataagattggagagaaaactcacattcccctactcttcctcctctccctcttctccatttcctccctccttttataaatggtgaatccgaccatagatgatgttgatgaacgaacattggagttgatcaggtgttacgtaccacacacaccaaaaggccatatatagcgtccgtacgtaccgtacgtggatcggtgtgttcggtcggcatcaattgggagtgccgccgttccgttccgttggggttgcccgtgacgtgacgctgacgcaagcatgacgtcggccgtggacagtcaatcaatcagtcgcctcggtaagggtacgtacggagtagttactacatcctgttttctggagtaacagatgacgccgttaactttttctcacgtgtttaatcattcgtcttatttaaaaaatttatgtaattataacttattttgttatgagttgttttatcactcatagtactttaagtgtgatttatatcttatacatttgtataaaatttttaaataagacgaatggttaaatatataagaaaaaattaactgtgtcatttattaaaaaatagagagagtactacgtacggcctggaccgatcagccacccaacgaagccgtccccatcacgttctgtcgatcaacggccggccattgccatgcacatgcatgcagatcgacacaaccaacgacatgttgactgttcggtactatgctgctcctctatttgacttcctactcgcagactgttaaaaggtgactttgattggtgtattccctccgtcctaaaaaaatcaacatattaacataggatgtatttagttcacgctaaaattaaaagtttggttgaaattggaacgatgtgac

SEQ ID NO: 849 - DNA, 1501 bp, Oryza sativa
ttacctatcaaactatgagcagactactcgattgtccaccaattcgtcagtaacagctcaagattttcgggcgaaacttactaatcggtgcatgaaacccacagcatcaagcagttagccacaatccaaatactataacttcagttttgcgatagaacattgggttttttttagaatgcaacaaattcgtcagcacgagcacaccaaactagagtatcgccattgcaagaaatgtggcgcgtgccccctcaccactgaccccgaagatctttggggggggggggggggggcggccccaccgtaaagcggcacagcagaaccgagattggggaaagggaagcgggggggaaatttgggggatactgactgacaaggagggtgcgggagagcggccaccgctgggcgcgggcgacgatggagaaggggagccagtgcgtggggatgaaggagtgcagcagcgacaccgtcgcgatgcccccgatcgtcgacgcctcctccgccgtccactggaggccgcccagtccgaacccgcctcctcctccgccgccgccgccgtccatggcctgatcccgcctcgcgtcgctggcggcggtggggtgtgggagagagatctgggaggagaagcagaagaggagaggagagagaaggcgagcaagtgggagagggcgaagcgggctgcggtggggcccacctcacctcggcttatggcaaattaatcccagttaattacccgtttgctgtggaagtggaactgtggaaacctgtcgatcgtctccatggaaaagaaaatttttgatatttctgactttttatttataggcccgtgctttacaacggatctgtgaaaggactttagaggttcatcctaactctcctctcataaactacatcatattttgctagaaacacggtacaaatacatgcgctcacaatacgcacacataagcactttcagaagactaggctagtaatcttgagattcaaaagaagtcgccacaagcatctattgctggaaagataattagccataaatactagcactcatgtcaaatctaaagaataattagttataaatacgaacacccatgtcaaatctagaacttgaacccggataaactggttcaaccacatagaatctaatcacttgagctacgctcacttcatcaccttaattgtttgtagtatctggatcatttatcgatggcgtgggataccatccggtttaaacatattaggttgattagttttttataatgggcctgttcggctgttatgtttagcagttgtgctgttgcacaaagaaaacaatgtggctgttggctacaacacaatgaaaatgagtgcagccgaacagagccgatataataggttttttaaaatcaatttttataggaaggaagtggcttttaggaggaagtgggggagagaaagaaaaggagcatgactatctcttttaaacagtagaggccagttaaaatttaaattcaaacagaaaaaaata

SEQ ID NO: 850 - DNA, 1501 bp, Oryza sativa
ttgccagtgaaactaaacacaaccgaactgtctctgatacctacagcttccgggcgcagtaaaagccctcctccgcacgccggcggcggctgcatcgatctcctccacttgagacttgagagcagtggcggatccaccatggggtctatggggtctcgagctcccactacctgtgttgtaatcatgggagtccccataaagaccccactaaaattttctgccatacattcattagaagagggggctataaatttatatagtttgtttaaactctcctattaatcctcctagatccgccccttcttgagagagatggcaacgacttcaatttggaggtgccagcaccacaggcccacagcttagttggttttgctggccactcgcctccccattagatttcaacctaataatacaagaaaacgatgtcctcactaaagactaaactctagctactgtcatagtacatacgtaccgatcaacacctctgttatatattcatcgtatactttatacaattattggagctattagcacactatcagtcgccgtctcaagtctcaacagaccaaattatcaaagcgtcgacgctgaattctttgtggtaataattgctggtggtatcgcatccgtattggtgggacaatatctagtgttagtctaagcacaattagcagtatagtatatgaatgtgtaatgtggatagctagacagatggaaaacaaaccgtcctttgatgtatactctagatcactaatcccagacgtaaagaagaacggcaagcttatgaaaacacgcagaattccagaaaagtttttcttttgtgtgcaatggctacttggctagtggcgcgcatattgattgatcgtattgtagctagatcccattatatggtcctacttgtactatgtccagtagttacccagtcgataccaacgggacccgcgatgtcgtatctcgtatgtgttccaactggcatgacatgattattggaagcgacttctgctatgttggtcaccacttcaccagatactcctcccgtctcgaaaagaaacaacgattgacttgattcgtaccgcgaatttaaaccttgttctttttttagacggagtaagtaggcaattccgcaattaaattagctgagcagtgcactgcgtgcatacacttatgtcttccgcatgcgaaaacaaaaatcacaaaaataatataaaattccccaaaatcaaaacctgaaaccatacccccccccctcctgctccatcgccggcggtggccgatcccatgcccaccagccgtcggaggccgagcctgtcgccggacccactgcagctgctcctgccgtcatgctagatcaccccgctgcctccggatccacgtgcgcactcgctgggatgggggaagggggtggagtggcggcccaatctgcgtgggagggagaggggatgccggatctcaccgttgccacgcctcccgcctcctgcctcccgcccgcccaccgccctgc

SEQ ID NO: 851 - DNA, 1501 bp, Oryza sativa
gaatatttaatgttcaatgtgatcatcatggctaccatctcgggatgctagtagactgtagtagtacttaagttaaatctgaggttgggtacatggtttgattggtttatcatacaaggtcacaatttgtttgaataatctcctgttagttgtcctgaactctaaatccttggccacacttttgagtttccatcagtgagtactaactagattctttctcaagtctagtggcacatgcatgtacattgatggtttataaagcaagtggatggttatctctataagaaatccagtcagtttagtcattattcctcatgccttaatattgctaacactgtgtttcctagcagtctggaaaagaagaaaacagcatgaaagctaaaacttgccaatactgaccttgttgtgttttacttcatggtagtacatcgtaatatttttcaataggatactgagcaatgagttgttttctatttactgtttcaaattgtaattcgttcaatacattcatcttattaacttggttcctgatgtctgactcgcctattttgatcctgcagagaaatgattcagcacaggccatatgaccagaaagtagatgtctatagctttggcattgttctatgggagctcattactggcatgctccctttcgctaacatgacagcagtacaagctgcatttgctgtggtgaacaagggtgtccgtccagccataccacaggactgcttgcctgttctcagtgagatcatgacaaggtgctgggatccaaaccctgatgttcgccctccattcaccgaagtagttaggatgctggagcatgctgaggtggtgatcctgagcacagtccgcaaggcccgatttcggtgctgcatctcccaaccgatgacaactgattgaatgagacaacagagagttgcgaagaccttgatggaaggaagcataatcgagtgtatttatcacatgttagactctgcgccgctgaagtagaaatccaacttgagtgtacgactgagttatatactcaggtgtaaggcagttctatattcaaaatatttctctcttagagtggtgttttcagactgctttggtgtgttaggctctatccttttgtcgaaacatcatgcagatttccttttgttgtaactgacgcatgttcctgctgctttatgcctgtgttatataatccccctgctggaacatgcacaaactttgctgcgttcagagtatatagtatgtacaatttgaaatgttcccgtggcagagttctgctaatgccaagctttcggttaatcttccttacccgtttcctagattcagctcctagttactggctgagtttgtagtgcctgccattgatgaatacacaagtgtaaaatgttctgtgagattagctcatttccatattatccttgtctctgttgattgatactgatggagctgaaattaccaagagtgtaaaactgtcatctcaacaggagaactttgctacagaattgta

SEQ ID NO: 852 - DNA, 1501 bp, Oryza sativa
ggatgtcctctggtttattgcgttcacttcgaagttcttcttttctccgtcctaaattccttctcattttctctattttttctgcagagtcacatccagggcacataatttttcattctaatttcggctaaaaggttggtcctcacgaccactaacccctggaattaatttctataaatatcgaacgaaattcactgactgcaaacatgactgcaaaaaaccttggttacatcgtgagtatctactttccttttttttttgagagagagagtggggatcgcgagcatctctacttggcatggctaaatttgaatttttcaaatttgatttaggattatttccatgagttatttcatcaaaccgtttttcttcttttcataccctgatatcagactgtaaatttcaaaattagctcaaatgaatgctcgatatagctttcgcttttaagcacaagcttatttgaatttttaaaattaattcaattttctagggtgtacgattacaatttgttttcaaatacgggtgactcataaaaataaaattatgatgaaactgtgaatggtgggatggaagtattaaaaatagaataccatatccagtttcaacaacaaatttagagaaattcatgcgataaaactaaccctgcaacagcataattatatatgtggcctcatttttatgttttgagactgctttcaattccttaatttggaccaattttggccttactactgacccattatacacttgcgacattgttacgcggttggatcttagtttacctgattcgatgactgatccatcagattccgtgtcaaatctgtttagtagtactattatttataccctactctctctgtttaaaaaaaaaaaaaggcaaacattagtttttcgtgttcaactttgattgtccgtcttatataaatttttttataattcgtatttttattattgttagatgataaaacatgattaatattttatgcgtaacttgtctttttatttttttcataatttttttaaataagacggacacgttggacacggaaaccatggtttgtctttttttaccgagggagtactaagggcatgtacaacccacagataggggttcgtctccaagaacctcgaagttatcatccagacagatataaagacagctcatacagcccatagacagaggatctgtctgtaagctgtttaatgcttttgcatgtagctttgatcaattgcaaatacgtttgtgtataccattgtgtggctatatatttgaaataatactatcaagcatgaataagatacatgattacaataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataa

SEQ ID NO: 853 - DNA, 1501 bp, Oryza sativa
tcagtatcataaatcatcaatcatctataaagaacaggcccttgcgtccatcgcataattgcaagtatatatacttcaaagttgccattttgaaagcatatgcaaattctagtaaacatccaacacaaattcaatctacattcacatgtcgttggcaaccctcggaggctcgtgtatatgaagcatatattcccagctgaaaaatcaagccaataagcaccgtgcatgtacatatatatgcagacagcaatacatggaatggaattaataatatgcatggtgtcctcctctgagcacaagagcgcaatgatgcagggacggaaccctacgtagctacgtgtgccgagtacacgccaagtgcgcgcgcggctgggtgcagtggcagctagcactacgcagggcgctcggcgatcctgcggcgccgcccgtgccccataagcacaccaccttgttgccatcgacggacagaatctctcttgcatcttgcttgttagaaagtgggaaatgatggagatgagatggaatcgtggcttcagaaaagctaaggagcaagggcttccaggctgatcgatcgatcgatctctattactccctccatttctcgttacaagatgttttaactttggtcaaagttaaactgctttaaattaacgaagtgtatataaaaaaatagtaatatattttcgatccaagataagtttattataaaaatatatttaattattaatttaataaaactgatttgtaatgtaaatattattatatttttctatatatttagttaaatttgaagcagtttgactttgaccaaagtcaaacacatcttataacttaaaacggagggagtagctgataccattggcgcgacagctcaaggctgggccggtgcaagaatatgccttgtctggaatatatgttttcatgagtctcagatgagagacagcgcagacatgcaactggggttagggcataaggtctcggagcccccttttggtgttggacaagatgagaaatgcatctccttcctctgactagctatgctatgagagtgagagggtactttgattgcatgtaggatcgatcgacatcataaaaccaggggttgaacggtatcactgcatatatgctctagtggcctgatttgtggtggtggagtggtcccttgggatcaatacatattggtacagaatgatgacgatataattgaaagcaccatgcatatatgtatgaaaatatcggcattaagaacctgtttggtatagtttcaactctatatatatcctgtagagagacttcatcgtccaaacagtttcagctcctagctgatactgaaatggtgtatgtgggattcatctagaaaggtgatatatatactgaaacatgcattagataatgtttggtattgttgacttaccatatggatttccattggtacccactgaaagtacacattagttaacgcaaaattgagagtaagaaggctataatgtgaaaacaatag

SEQ ID NO: 854 - DNA, 1501 bp, Oryza sativa
aaacaaatctacgcagcgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggtgttcccaacaattggcatacgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattatcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaaatagtgcgactactgggtaggtccgccggtttggcacgcaaactgaggccaagcaagttaagtgtgattctaataatgcaagttgtaaacaaaataataatgacttttcaattataggggcaattgatcaaagggtgacttgccttgctcaaggtcttcacgaagcttcacgaatcatcgagaaaacccgcgatcgacgaaaatccgataaccgcaactatacgcaaacaattgaaaacctaaacaaaggaccaaaagaaagatcctatttagactaattagtagtgccaataaatagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcacttaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaataggtggcggatgtggtagggggaggacgagggagcaaagttagactttgttccacggcagctggtttggaagagggaggcaacatagactttgttccaaggagcgaggagagaggtgaggcccatcggctagcgagagagagagaga

SEQ ID NO: 855 - DNA, 1501 bp, Oryza sativa
tcccttaaaaaaaactaaggcgggagaggtaagacgaacgcgacagtgtggtacatgcatgacagacactggaaaacaaccctggactagggttgaattgttgatatctggtggtcacttgcttcggagatcacggtaaccaaaatgagttgggagaaacatagctccagatgcctctcaggcctataatgcgcacgtgcatgttgcatttttgcccatgttagtttcagcaaatttccatatggctgcttggttaatttatcaggttattccattgcatgcctttgtggttcatgatccaaattataagccatgtgtttggccaattggccacattgccatgatagggcgctggaattagcgtttgattgatgaatcacaactgctctgtggtgctcccaacgtcctaccaggttgaacctccacgagcgctcagggtgagcgaaggtgatctatggtgaagacaagcatgcaggcagggcacacattgccaatgtgacagcataaggccacgacgaatcgatccggcctcaaagacatgatctcacagtgacgctgttgtgtccctgagacctcccatgccggccctccctctgcctaacctgagagttcatgttgctttgttgcacgtctctgggtagcaaaggctattccacccccttgtctttactatccattttaactagctaggtaagctagctctgagctgttcttgtgtgggtgacactcctctctctctctctatctctctctttggttcatgctgctcttgtgtacagttgagtactgtttttccagtgatctctactagtacaaggatattacccttatttataatcagtataggtgatgtagctatttatttacaaaagttctactactagtagaaaaaaatgttttatttatcaatagttcacgtgacagcacaaatataagtgacccatccaataagaaaagatataaagtctagattggttctactatcggtagagaagtagtgagtaccgtagaaaaatatcttcccaaaaattcattcacgtattgcatctcggttctactttccccttttagaaacgggcacctatttaagcgtcatttgattcgaaattacaaaacaaactatcgtcgtggattatcgatatgattataggcctaaacaaatattttgagaaataaacttaacaggtagcttaaaataagtcggattgtagagcaaatgatctattggaataatccggtaaataagcagtgatgctggaggactttgtactgtgatgcaataattattgtgccactcctgcatttaattaatctacttcttttattcaattttatattaagtataagatgaagcttgagctcatccatgtacgtaattaattaatctcgacaacgaaacaaaacaacatgtccaagaagaaaaattcacagcagctgcactctattccaaatctacatgaacgggggttcagcaaaacaccaggccgatcgacgccggggc

SEQ ID NO: 856 - DNA, 1501 bp, Oryza sativa
aaccccggagatgctcccatccctttgaatcgaaccctcgtcatctcgtcgtgttttccccctttttgatctccggtgattgccgccgccgcaatccaccgtcgtcggctcctctcgcgtcgattcctctcgccgccacgctcccggggatccccatgacctccccctggctgccctaaggccgtcggccttctcctttgtctccgcgccgtgtcgccgcttccgccgccgcctaacgccgccgtgcgtgcgccgccggtgaccatcgggtcccgcgtcaccgcgtgtgcgtcgcaacaccataccggttcggctaagcccgagcccgcgcacccttcgctcttctcgcgcgcggccacgtcggcgtgccggcgagcttggtcgccgccgccagccaccgtcgtacctcccctctcaaatccgtgccgttaaacggatcccccctgacctcctctagctgccggcggtggccgctcgctccggtgcgccgccgctcgccggaacgcctcgcgcgtcgtcggccgtccgatcccgggcgcctcctcctcctcctcctcccctttcgcccctgcccgcgtggccgaccacgtggccgccaccctggcccgccggccccgtttgaccaggtcaagcagcgaccggtcagcgtcgcccgcgcgcgcaggcctggctcggctcggcctcgcccacccggccgtgggccgcccaacccgagtcggcccatctcctctctctctctctctctctcgctagccgatgggcctcacctctctcctcgctccttggaacaaagtctatgttgcctccctcttccaaaccagctgccgtggaacaaagtctaactttgctccctcgtcctccccctaccacatccgccacctattggaccgcagcccatctatcctctctcactctcacttcttgttggccccacttgtcaatgagtcaaagatattcttgagaatatcttttccaatactccacaaatatttctcttttctataaattcaataaatcatttttccctctttcagaaatcaattccttattccaaaattccatgaatcattttccttggtaagtgactgtcaataatattcttgagaatattatttccataaattccgacaaaacatttccttgtccagaaaatccatttagacctccaaaattcatatcccttgatccgtagctccgatcgactccgttccacttccaataattccgtaaaattgagatctatttattggcactactaattagtctaaataggatctttcttttggtcctttgtttaggttttcaattgtttgcgtatagttgcggttatcggattttcgtcgatcgcgggttttctcgatgattcgtgaagcttcgtgaagaccttgagcaaggcaagtcaccctttgatcaattgcccctataattgaaaagtcattattattttgtttacaacttgcattattagaatcacacttaacttgcttggcctcagtttgcg

SEQ ID NO: 857 - DNA, 1501 bp, Oryza sativa
taagtagataatccgtgggctttcatccagaaacaatccattcagaatgctcgagtacgattcaagagtccatctatatatacagtgttacttgcaaatgtacatgtgtcgtgtatattgattgagtatttgaccttgcgatgcggtaagttcaccatatttttccttgaaattattcccttcaaatagttctagttttgtccctatatatgacgttgcatatagcattggaagcacacatttttgccatgtgttacatgctatccagctatgtgcattcatattttattctgatagatttttcctactactaacctggaaaactttgtgttaattctcggtactagccaagcccctagaaaaaataatttgcttattttgaactttggaaatgtattctccacatgggctgtgtggacctctggtagcccagttagagcaagatagggacccagaatagctatttgggccacgctgtatgcactatgttgtctacggttttttttttctcgttttcaacccttttactatcacactggattttcttttcaagactgtcccttgtagtgtttgtctacattctaaaacatcgctagagaacaaatccgttaaatcctggaaaaattcgctcccatagggagtcgaacccaggacccaaggtgctactgagacttttgtaactactaggctacaggccctttcgccctttggtgtttttttaacgtggttagcttatttttaactaacttgtaaaatcaaagtgtgtttgattgctattttgtgacgaacaattggcatatgagattattagttttgatttttgtagattattggcaaggtggttttagagatattagtttttcaggtgatgaacagggattattgctgacatattaggtctggtcagaccgggttgtgatagccgttctgaccagccgacgatgtgtcggtttcgttttcggattgcttatttggatacctatggataaatcatgtttatgatttctaggtggatattatggcgtatgtaatacttttgtgtgctaacaatgagtcaaattggtgagaacatgtgctcagatatggtttcttgattgatgcatgtgtatgtgagtcttgacgccggatcgggagtcaacttgggagaagatgatggccggacgatcaagatatcatgcaggatgcttaggctaaagatccatgcacgtggttggtaaagatttcatatgacatacgatctcgaaaccctaacttttctctaaacttaactctctcaatatcgataacgggatgccacaccctccctttctatttatacccgaggtaagcagtctaaagctaagaaccaaccttttacaagaagtcctactcccctaggaaaccttctcgtgcaagaaaaagaactttacaaactcaattgtaccaaatttggactccctccaaattcgactccacatcccacatacacacaatgggtagtcgagatttttgtgaggagtgt

SEQ ID NO: 858 - DNA, 1501 bp, Oryza sativa
cgatgggaggggcggtggcgcgacgccaaaacgcgcgatcgcgtcgatcccgcgtgacaatagcgcgcgacggcgtccattcccagcaccaggagcagttgcgcagaagaatagaccgacgcgctcccgcggaatggtcgcgcggagccgcgccaccaccgccaaatcccgcaacaaacaaaggatatactcataaaactttgattgtattaacaggtagctagctttagcattcactattctgacatgcatgcatgacttcttggcactagcagctcgaattgaacaaaggcagtgaaacgactatattatgtcagcaccggtgccgcacaaccaatctacgggaccgacggatgcggtcgcgcgtcttggcgtcgcgccactgcccgataccgcattcccaatccgcggaaacatatatttttgtaaaattttcaaaagcatgtatatatgtgcaaattctaggaaaatactgtatattttaaaatttaattctggaatggagtagccgtggcaaccgcgcattcggcgtcacacgcgcaggcgcccggttagtaagcagagcgatgccgagctgccaagtgttggatccgacgcagccaagtaatttccgactcctcccatcccatgcctagaagactactagcgagagatcgagatcgaactcgtctcgtccggccgctagctgcacttcgaataccattaggacagatgaaagtttagtcgcggttgttataaccggtactaaatgggataatcacttctccaatagtacaaactgaacttcgagcaatacattaggacatatgaaatcgtacgaccatcccgacatggctggacaaagagaaggccaggccagaacgggcctcgcagccagcatcctccccgtgctcttcatagcgaaaatattgctcgtatgttcatgggcggttgcacaagaagcgcagaaacaagcgagggcgaagctttagttccatggcggctaaataattccccatgcctcccatatctaagctaggatcttaattagtttcaacaaatcaatagagtcgctacggatgcgtgtacgtgtatacatgctaacatccacactgacccggccagctctttagttcgctccagctctcgatgtgtgtcacgcagctttagaagtggagcattgtcttttataaatagatgaactatgggatgaaaatacaatcggaaaggccatcatttatactccctctgtcatgagacatgcatgagacgtcaagtctgtataaggctaaataaacaatcaaggtactacggcgacttaacagcacaagtacagagagaatatgtacgtactacaactactgtctttgattacttgctgcatgccaacaaatatatttagaaaacgatcggcaaataaacgataaaaaatgatacaccaatcacagaagacacaagatttaacgtgaaaacccctcttaaattaggagagaaaaaccataggcgccagctagcaaatatc

SEQ ID NO: 859 - DNA, 1501 bp, Oryza sativa
tgccaagagcaaagaagaaatcactacattgaagaaactgttgagtagtgagtttgatatgaaggatcttggtgctactaagaaaattttaggtatggaaattactagagaccgaaattctggtttgttatttcttagccggcaaagttacattaagaaggttcttcaacgtttcaacatgcatgatgcaaacactgtttgtactcctattgcaccttattttaaattatcagctttacaatgtgctagtattgataaggaggtagaatacatgtcaaggattccatattctagtgctgttgatttttttatgtatgccatggtttgctcttgtccggatttatcttatgctatgagtttggttggtagatacatgactaatcctggtaaaaaacaatggaaggctatttagtggagtttcaggtatcttcgagacacagcaaatgcttgcttgaagtttggcaggactgataagggacttattggctatatggattcagattttgctgctgatttggacaagcgaagatcacttataggttatgcgtttactattggtagttgagccatgagttggaaggcaacattgaagcctgttgttgcccagtctaccactgaaatagaatacaaggctattactgaagcatgtaaggaatcagtttggctgaacggattgtttcctgagcttcatggagttgattcttgcattaacctgttttgtgacggtcaaagtgccatatacctcactaaagatcagatgttccatgagaggataagcacattgatatcaagtaccattatgttcgcgatgtagtcgcacaaggtaagataaatgtctgcaagataagtattcatgataatcttgctgatatgatgacaaagtcagttcatattgctaagtttgagcttttctcaagcttagttggtataatggtttaacccaatagattatttggcgtcgaaagtgtttttctttgttgtgttgagggtgaaggtttgatttatgctacaagaaggaatttgtctcaaggtggagtttgttgagttttaatccaaattcatttgcacacgtataaaggctaacttcggacggagcgaagcggaggcccgtcgccggagacttgggctggagcaaagcggccgttttagggtttcacctttatatatacttctggaatgtaagctgccgttcggcgttctaacctcatccgatatatagtgaagatatttgctagctggcgcctatggtttttctctcctaatttaagaggggttttcacgttaaatcttgtgtcttctgtgattggtgtatcattttttatcgtttatttgccgatcgttttctaaatatatttgttggcatgcagcaagtaatcaaagacagtagttgtagtacgtacatattctctctgtacttgtgctgttaagtcgccgtagtaccttgattgtttatttagccttatacagacttgacgtctcatgcatgtctcatgacagaggg

SEQ ID NO: 860 - DNA, 1501 bp, Oryza sativa
tgaaccaaatgaataatgaatttgacgaactgttacaccatataacggcccattttcttttttttagagcatctccagcagggacttcaaatccagcccctattcaatttttgagagttaagataaaaaaactagatccagcaggggccctactacagcccccaaagtgaggaggccctcaaatcctcccccaaggccccagtcctggggactccggagcacgcccccatcgtcatttttttttggcgcggatataattttgcttcgtgcattttcttgttattcccgcacggctgcgacgacggatcttctccggcgagcaccgacgaattcccagcacctccatcaagactgccctagaaaggtaagacttttccatacctttcttgcccgccgttctcgaggccttcggcggcagtccatgcacatgcccggccgccgatctcccgccatctgcctggccacacgccggccgtcgcgtgccctccgaggctgcccgcacacacgtcgcccacctgcacgccgcctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatatttttttggagaattgtagtggactttgtcggcaagaaaaatctaaattctcagctagtaatggttgtgtttagttcacactaaaattagaagtttagttgaaattgaaacgatgtgatgaaaaaattagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgattttgtgatggcagtgttttttatatggacttctacgacgacgatgacgacgacgatgatctcattaccgattggtgggatcaggaggagttgtctgacgatgatgactactacattgcagctgctcttcttacagacatagagcataagaggaccaaaagaaagcatcatggttcagtcccaggtcgtgagataattcatagggacaggtttgctggcaatttacgcatagtggctgattattttgcagatcctcctatatatagtgcaaaattatttaggaggaggttcagaatgtcaagggagctcttcttgcgcatcgtggctagtgtggaggctcatgatgactacttcaggcagagaccaaatgcag

SEQ ID NO: 861 - DNA, 1501 bp, Oryza sativa
ggtatggttgcgggtttacggcgctctgctaagagcattacaaacagttcccttattctattctctatctttaaatttaggaaattttgagcaaaaatcgtattcaacagattccctaacctatctcctaataatccaggttcccaaattcggatatctcgttacccactttcagggagcgattttttcttcccaatcacggtcttcactctcttgcacacgcacgatgaaaaaggttcccgcgctccttttctcgcctccctcaccccgcagcgaacgttactcttcctcgcaggcatcggcggcagcgaagcagcaaccatgcaaccccttccttgcaagcatcgtcgtcggatttccaggtggcaatgcagcggccgtccctttcctctcagtcgcaggggtaagttgaaatgggagtgtcaattgcaagaaagttactatgttcccttctgaaaattgtggatcgcacacagggatccatgataatcgcaatgtgtatatgcatgggagaggatagtgtagtacaaaatatcggtgaaacaaaaattatttttgacttggtgttaataatcattttgtgagactagagcacgctagctaagccaatgcaaggcactttaggtattttattggatactttcttgggtttttaggtgcaacacagaatcaattgatgcaccctacttggatcattagcacatttgtagtgtcacgccccgaactagccccgaacggaactaacctgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaagggaaagcggaagccaagacttggaccaatcatcacaggcgcgacttgggaactaggccgaaaccctaaaacttatcgtaactgacttgctcctggaagaactcctcgtcagcgggatccacattatcttcttcagcaactggggggggttatttatacagagcaagggtgagtacaggagtactcagcaagccatgggaatttaagtgtttaatgcaggcttcaaggaaaggttgttgtttttgcaattgattttatttaaactcatttttgaaacaactaagtgagtgcttcttaaacgatacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaacccattccacagcagcaatttcacaaagcagtagtcaaacaaaactacgctaggaatcacctcacatccgcccatgaccatgggcacggctgttcaaacagtttaataacctctacagagggggtacactttacacaca

SEQ ID NO: 862 - DNA, 1501 bp, Oryza sativa
tgggcaacttctaggttaagtctctacaagtttggtttataaagattttttgtccaacttttcatgtgttttttctttttgcaacccatactactttcatgttgtatcttttttttctcatgaacacacgacatcaagtgtgtctctttttttcatttactgtgtttttccgcttcaaccatctacaccccagcagcatagtccaaatagcaaaatcaactaatactatacatttcgcgcaagttatgttataaatatatgcaatttcaattaataaatcatgcaactaattcttttttagctgactactttatgatttttttcctaattttggttataaacaagcacaacttcagattgattgtatgctcagatgtaatagctcactacaattttgttttcagggagcgttggatctacagggggaggagcttgctgcaggccaagaagagtacatttccttctgctaagtttttgattttgctggtgagcttggaaatgtgggcggtcgaataatataatgccatatctatccagtttgttacttttatatgcaaaaattgcaccttcctattcctacagtcgccattttttaatgtttgtgcaactttggttattaattcgtgcaactttaattatgattttgtgcaactataatcatgctagtagttaacacattttttcgcaataccaagatgttgtagttgacatttacttatatgagatagtaatcaaattttctgtgcaacacattaaattttgtgaattaataatgttatacctgcatatgcagttttgcacatgatttcaacctttgcacgaattttcaaaaagcaacaagatgcaaatggtattgtttgaatttggcactacttcttttttttttggcatagtttaacatgtgtcttagcagcctatcaggacattgagagtttttttttggtttgattggttacaagatctctcttttttccttttaatgtgcttacttctctagttcttttttccagcatggcaagtgacaggacatcatcagatgatgaatgttcatcaaatagcaagtcggacaacaaagtggcagattctgattatgccaactctatttcagaagaggaagaaaccagtgattctgacaaatacataacaaaaaaagatctcgtcagcacattaaaagatctggtatatatgtttcttcctttttttccaaaatatcattttctactaccacagacagctatcaataacttcatacttgttttgcctctgttagttttcaggatcgatcaaaaggaaaagagctaggacagacaaaccagtaaggagacaaaaacaaaaggtatcactttctgtcttttttttcctaaacatttttttccacatctagtatgttaattagtttatgttgttctttgttaacaagacataattacatctctattttttttcttccagcacacaaaacatgaataaatctagaagtgcagagtccccaaaaccaaga

SEQ ID NO: 863 - DNA, 1501 bp, Oryza sativa
acttatctaatccgtgcaagcgtgtgccgaaacaatcaagggaagcaaattaatttcatataacatggcgcaccctgataacgcctttgcatgctccggatgtttgtagttgtgtagacctgcgcacgctagtttaatttcagttttgtagaacttagcagttaacagtaataattttgttgcaatcttttgcaggtgcttccactactggagtacttttttaaaaaaaaaaaaacaaaacaactgctagcttgcattgctgatcaatttttcatgtgcgatttgttttgtatcaggttcacatggacgtactactatacgcaagttattctatccgaataatcaacttgtaagttgttgttgtacatattagcatccatcctgcaagttcattcgagtgtatgtattaacaagtacttgtctaaatctttagttagaaataaagtttgtgtgggagtgggacagagtaattactgccggtggtgtttgaatctcctgaagatgaatataaaaatgaagattaagtgttttacgtaaaacgagatagtaataacgtgtgattaattaagttttaattattacaaacttgaaaaatggattaatctgatattttagaaaaactttcatataaaaaattttcacacgaaacacactgtttagtggtttaaaaaacgtgccataaaaatccaaatcttaatccaacctttccagaggaaatgaacggggccgacacagaattatcctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttataagtagtctatatttaatactctaaattagtgtctaaagacagggactaaagttaagtccctggatctaaacaccacctaagtactccgtgctggcagaaatgttaaatttatttatcactgacagcctaaaaacactacaagtataaataaggagtacatttaatagtattaaaagtactcgtatttatacaggaaatggaaaatgggcccagctgtcatcgtaggttttccttcggcgtacgcccgcgaatctcccgccgggtataaatagcggcccggaacccacccaaactcccaaattccaatccggtccctcgcctcgcctcgcgtctcctcctcctcctccttcccctccccgcctccaatttcttcctactcctcccgcctccccgcgaagcttccccacgcctcagccgccaatccagccctagtgtggcggcggcggcggcggcttctaaaagccctcctcttcccggactccaggatggcggcggtgg

SEQ ID NO: 864 - DNA, 1501 bp, Oryza sativa
tggcgcacccacttcgagcgcggtctggaggcaatgggcaagggccacacgaacctcatctaccgtcacgagcctctcgtcgaggctaccaacataggcgagctggactcagagcaccagtgatgggagagagagaggagggagggagagaagaggtgaggagccatcggtgccctcccttgctctggctgaccgccgctctcccgtcctctctgctaccggcgccctaaaaaggaaagagaggaaggagaggtggggaagggatactccttgatgaaccctgagttcctctcgacactcacggctgttgttggcctgatctttcggtgagttgataataactacgatttgggagaaacgttgacgacccgactacaaccgtacaagacgttgcgttgcgtcttagcgatcgatacacctctctgtgggttgttgatcttgccggtgcaaatcaaccttattcctgcaagcaaatcgaagaaacaagcaagaacaagataaaagcaatctgaattgctagatagacaagacacacaaagatgaattgatacacgataaagtggggttccgaacaagcagacggacggtctagccgacacgcgcgctgcaagcgaagtagcaatggctaaacttacaattaatcaaaacccgagaaaccctgaagaggtaactagctatatataggggtgggaggatgacctaggggtgcctagggtcgtgctccaccagcttggggcgcaccccacatgggccccacctgggtcggggtcccaaaagaagttacaagcccataggcccattataggtgacgcatcactttgttcctgtgattccggccacacgagatggaatttagagaagaggctggatccgttagaaagagggctccgagagctttccatcaagtactcacgggccgaaaacggaggtcgtatgcagattcggtggccgtttgaagtcagcagtgtagtaggtggccgaatcggatttcagcacttggagtacttgatctcgatatcttcttgttcatccatgatgtgagcaatggttgtatccgtggtagccatggtcacatcactcctatgaattagattctgttggtgacatgggaccgggagtatcgtgactagaggcttgggcagccgccctcacccacgtggcctgaccccctcaggggggttgggcccgagggtgacgtggacaccccaccctctgtctccccgaggggtcgggccgctcccgtttcggccccgagggctggggcgccccgaccccctgtggtgttggcgccacgtgtgtgggttaggtgagcacagcggcgctcacctaaccgcatttatagcgggttatacgagcgcgccacgctgcatttaatgcagcgcagcgcacgcttatccggtccgtgaccggtcgcagcgtatgaccggtcacagaccggtcagatcgtgggttaggtggcagcaggcggccttttcactcgcctcgccccgtcccgtcggaa

SEQ ID NO: 865 - DNA, 1501 bp, Oryza sativa
tgctacagttctgcttgcttgttgttaagatcgagctcacatgctcgcactgtttggtttggtgattgccactgatttgaactggtacaaagttaatggttgacttaactccaggcgggcgaaggcggcgtggggaggagccgcgcgcgtgcggcgggcgatggagcggcgcgcgggcggacgtgggcggcgggcggcagccaacgggggagcagcggggcgcggccggcgtcgggtgcagccgcaacgtctccttcgccacggcctgcaggtcaccgaccaccgcgtcgagctccgcctgtcgtccccgccgcgaagatgtcctggtacacgagatcgccggtgagctccgccgtctcggcgaccacgctccgcatctcctccatgtcgttgtcgtcgccggtccaccgccggcccatcaccatgcgagggacgatgttgctggtgacacccatcagcgcggcgtcgacgtcgacgtgctcggcgtcggtggcactccagctgagcgagccgacgaggcgcgccacctcctcgcggcggacatggcggagccggtctagcgttagtccggcgaggagctcgtgcacctccgcccagctcctcctcggccgctcgccgcctgcgcgcggcctctacccacgccgcctgcgcccgccggccgccgcccgtcacgtgcagctgctcccccgcgcgccgcccggaaattggagaaaagaggagagaggaagagaggtggagagaggaaggaagaagaggctgacgcgtgggggcccacgtgggtcccacgctgagtcagctgccacataggataaaaccgagtcaaaaccgcctagaaccgccgagagatctaatttgcactggttttgtaagtttggagatgcgtcatccggttttacagttgaaggacgattttgtaattcgatgacaagttgagggacctttggtatactttttccttttgccatttatagatgagattatttgctccgtttgcaaaacggaagaggcaatccagccaggttgcttccggcccggcccaacacgacggcggcacgaggacccggtgatctctccctcccatcctggccgtccacgtgtgcagcccgctacgcttccaagcgctagcgccgccgatccgacccagccgaatccgtctttcctctcctcctcctcctcctcctccgaccaccggccagccggcgaagtcctccgccgcggagctcacctcctccggcgccggcgacgcccccctcggtagccccggggaggacgcctttcctccggcgaccacttccccagtcgccgcctccgccgctcctcgaaccactcacgcgccgcgcgggctcctgtcccaggctatcagccgcgatttccctacccctctcgccggatacctcgccgccgtccaagagctagcgtctctgatggtaacttctctgtgagctcgctcgctcgctcgtagagattcctgattctgtatgattgagctccccgggctgtt

SEQ ID NO: 866 - DNA, 1501 bp, Oryza sativa
gattttttttttgaaaaaatggatattcagttccactgtaacaccttgaaaatcatatcggatccatgccatgttactaggatctatgccactgtaacaccttgaaaatctaatccatgccatgttgtaggtctgatacacgttttgaatcgtattttcccatataccaaaataggcatgcctcctgttgcccaagcattgtctatttgtctactacaatttaatgctccacgttatatgatctcctatgatgctacaatttaatgcttcgtgtcagatcagatatcctatgacttatgcattgtctatttgtctactactccctccgtccctccgtcccataatataagagattttgacattttgcttgcactatttaaccactcgtcttattaaaaaaatttatgcaaatataaaaaataaaaagttgtgcttaaagtactttaaataataaagtaagtaaaaaaataataattccaaattttttttgaataagacgaatgatcaaacaatgtaagtaaaatattaaaaatccttatattaagggacggagggagtataatttaattaatgctttgcgtcagatcaaatccacaacattttgaatcaaaatcactcgggcaaaagaatggtgatggaggagttggcgtagaggagttgccgaccacgagcaccagctaaacctagaacccaccagtggccgccctacatctgcttgcgtcacgctgagccactactaaacccgctatctctgagtctcgtcaccatcgccagatatgcttaaccactggatctacaaggtcctcaacgaacggagtgaagaaagagagggtgggattatgagatatgctccgcacagtcctgaccttgccaccattgccgcttgctccaccgtcgacacggtcagcgccacccccggctgcttgtttcgctgtcgacgccatgtcgcgaaccgatggcacttgctctgttgtcccctgctcgctcagttggttggaggaatgtagggtagagacgattgggggcagaggaacccacggtgtctgacacaggagggagaggcattttgatccatataaaattataaatagccaagaaaaagagagttgaaatgtatgtacacatgatatagatcagattttaaaagtattctagtagcatgattcctaatacatcaattgcagtgaaattttaaaaccataaaaattataatggtatagatccaattaaaacccaatggttactagagtttagtaaagggttttttttttacatgcagtgatgtacgccatgcctgcacacgctctgctttggcacaaattaggcccaccaatatcatcagctcgtcaacgacaattagatccattatacaggcaagttgaatcccaattggtttggtgggccgctagtggcccacacgctccagcagagtgcccacagcccacagggcctttggctctgcacacgtcgatgcactctctggtttagtcccataccacgg

SEQ ID NO: 867 - DNA, 1501 bp, Oryza sativa
atcttggaatgaagaaaaagaagtcagaatagtttgtatttttttaagtaaactagacattacgcttcaatgaacggaaaagttccttttctcgcatgcattttagtttactcaaattctctcacattggaagtaaacgagggcatataaatacagcaacgaatgaaacaaaacatagtttaatctagaacctacagatgcttttgaggagagatgtcattgctgtttgcacttcctcaccaattcgatcataatctcttcttcaagcaaagtagtaggaaattgttctcaaatgccttccagttcggggtcgtggggaagatgccatcttcagctgcatttgccatacgatggatatcgatggcacgacaatttttcccgctgttgaatgaagaggagattgctgaatttcggatgcttcctagtcctagcataacactcctatagtcccatttgacgcttatcatggacatcaatgatatgcgaggagatagctgaattttggatgcttcctagtcctagcataacactcctatagtcccatttgacgaattttccccgctgttcgatgaataggagattgctgaatttcggatgcttcctagtcctagcataacacttatatatagtcccatttgacgcttatcatggacatcaatgatatgtggggttgcgaattgtgatggttgtgctggaaaaaaggtggctacaaccgattaaatgccgcatctcggttgcatatcatcagttgtaagtcatcaatttatccttatacatctataccatactattattatgtttgtacctatttgtaagtgagagctaataataagtaaaaaagaacaacttaagtggtgatttcaatatatgtctaatgtctatgtcaagtgatcaaactcatccaacttatataacaattagataaaaataactatgcaaaaccaccttaggtggttatataaatggtattgtaaaattgaggggattgaatatccggtttcaaagtttagggtgctagataaactttaatttaaagtttttttttggggggggggatctggaccttttcctttaactatttcctacaccccaaatacatgcaaaagtctaacaagttggatctgttctagtttaagccagaggagtccagtatgattctgcacggtggtgacattcgcctcgatcttctttttcgtggcttggagagagtagtccacaccgctaaaaatttccgatgtctcctagttccaaggttaccaatatgatgtagagtattccattgtattggtatgccattccctaggcagagacaacatcaacaatatgaccttaccatcctgatcccattgtatgttcatctatatatatagatagatatataatgaaagtataactcctggtccccggcgtctgcattaactagaatacataataatttgtgatacaactacagcagaatcatagacaggacttgcagaccaaactctggtggacaaaaaga

SEQ ID NO: 868 - DNA, 1501 bp, Oryza sativa
ccccggcctgagaacggagaactcactcccgcaccgtcggccactcgtcacggtgccgtcccgactcggtagtgactccctccattctccttcctcgttctccctcgccctctctagcttgcgtggtagctctactagcccctcgaaagcgcgtagacaccgccccgagctccgccgccgctcggcatggcctcgccgccattgccgcccgcttccggaggccgccgccgtcgctagccctcctcggtgctcctccgccccatccgatgccggaaacggatttcttgaaccccggacatgcccccaccgccttgaattgaatccccgtcacccctccgccgtttcccccttttcccgccaccggcgtgcgccgccgcgattcgtcgtcgtcggcccctcctcgaaggatccgagccgttggctcaacccctctcgtgctcccctttgtaccggtgaactccctctcgatcgaatcgctgcgtcgtgctccggtgaaaccccgccgtcggccaccgttggttggagctcctgttcttcttcctcctctcgcccggcccgcgtggctgccacgtcggcgccacctcgacgcgaccgggtcaaagctgacctcggtcagccgcctccctccgtcccccaccctcgcgcgcggtccacggagagccgacatgctgcgcgtgggcccgccgcacaccgcgtccacccgcgcgccgcgcgtggaccgcttccccccccgaaccctagcgccgccctcgcgtgcgcccatcccaccgtgggccgtatcaccgacaagcgggccccacccgggaccccgcgcggtggaatcggtccaccgggccgtctctctcacccccgcgccccctctgttgggccgcctccccgtggccgcgcccggcccaatggctcggccgagcctccttcaaccctttgggccgcaccaatgccacccgagacaagtccaaatcacatccctcatccctttaattttccaagggatttaataaatccttttcctttgtttcataaataaaattctttattccaaaattccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccaataattccgtaaattgagatctatttaatggcactactaattagtctaaataggatctttctttttgtcttttgtttaggttttcgattgtttgcgtatagttgcagttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattataatcacacacttaacttgcttggcctcggtttgcg

SEQ ID NO: 869 - DNA, 1501 bp, Oryza sativa
ccaaaataagagataaattccgaaataaaaaatcttttgtcaggaaaaaaactaatattgaaaatacaagcatgtgtgatgcttactttggacagtaaagtcattctttatggcgttcccaccgaggaatggggaacgcagagatgcaagtccaaccaagggcatgatactactatcattcaactcattttcagatagatcgaggatttccagttggcgtaaattagaccatacttcaaaacctgcagcgaatgatgaaaaacactataaatatgaaaattagtaaaaataaagactaatgcaacaggagttatccgactgcgtgcatacgtatgcacctacctagagaaggtccaacaaaaggacaccaaggtgaccattttacctaagcatcacacaccctagggagctccctgatcccttcctcggtgggtcacagggacaaggtgtttacatctagcaagacaaccttggtgtggtgaaatccaagttattctgaacagagacttcttagttgctacaacttgcggcccaacgattggtaaatccgtaaatgagtgattttaaagtcgttgagaaggtaccgaaagataccgtattttctactgtaaaattttgtacctctcagtaccggaggtacggaggtaccaaatttgcactaaaaattgtggtacctctcaaggattgtaaaatttctcttggtaaatatataatatcaatgttcctaaatgccttcttcgatatgtgaaacagcttgagggaggagaaggaaggaagacctgctgacctgcaccaggcatgcatcccgcgatgccggcatttcccaaggacaaattctgcagctcacggaatggaaggaacatactgcagttgagtaggccataccacgacggataagctgcatcaagatcaagggccgtgacacgccctgtgatggagctgcaggtcaccctctcccaccggcagcaatctctgctactccagtcaggcggattgccagccggccaaaggaacgcatcgcaaatgtccataagatgtttcctctcttcgtgcaaacaactgtcgcagaccaccaaggtcagcagaaccaagcaacaccaaatgcaggggttcctcatggccaccacaattcccaatcctcaaatacgctagctctcaagaaatttaacccacaggcaccgattttatactgatggtctcggtgcatcacactcaattaccactaccagcagattccacactccccatggtggcatcaagcaggtcgctgatttcgacggtaatgactgcctacctgaaatgaaaagaaatcggtgtcagcatcggcctcgtgactcggcgtcaaccgtgaagctagccagcccgcgcacattatctcttagtagaagaaaagcctgagatttctttattccagcaagcgagtggggcttggacttggagtcttggataagtggactgccggcatgcttgctccatggtagcaatgactaaatccacgaga

SEQ ID NO: 870 - DNA, 1501 bp, Oryza sativa
agatataatatgattatcaaaactaaaacaaattgatagtacaattttgagtctaaaaataattgagattgcatggttttatgagagaataaagaagtgacaatttgaaccatagatctatcatttaaaggctagaaataattagggtgatgtggcttaatgagagaagagagaaatagcattaactacacttagtggcgatgaactatataagggcaagttttatagtggaggtgagtgccacatctaatttaaaccatgttatcttctcattaattaagaggtaacaagtacaacatgtcacctctagtacacaaaccccaatattagtttactcccacatcatcttatatttttattggagattgtgtgggagattgccacttgcatgaggggtggctcattctcatcttatatttttattggagattgtatggatgttgcctcttgtatgaggggtggctcattctttctctcctaacttctctcctccaactcatcacctaatcttatgtggtaaatttagaggcaacatgaaggggcttatagtactttccctaagtactactccctccgttttacaatgtaagtcattctagcatttctcatatttatattgatgctaatgaatctagatatatatagtatcaatatgaatgtgtaaaatgctagaatgacttgaagtatataggataacggttcaattcaaagacgagattcatattcgacgttaaggatgagggacctaatcggagtttattccccctcctcctcctcctctgttccttccggcccagcccaccgcgtcgcgcctgtcccagtggagaatccatcgcttttccgcttttcccgcaccaaatccaggtactaccctcctccctctgttccatattaattgacgttttgaataaagttgagatcaaacttttataactttgaccattaataactttaaaaatatttagttttttaaagcattataataaaaataaacatgcatttatttattatatatattataataaaaaaataagatcaaagatatatcttgtactccttccttccctaaatgtttgacaccgttgactttttaaaatatatttgaccgttcgtcttattcaaaattttttgtgaaatgtgtaaaactatatgtatacataaaagtatatttaacaataaatcaaatgatagaaaaagaattaataattacttaaattttttaaataagacgaacggtcaaatattttttaaaaaatatatcgtatcattgtccaaaatgttaattaaaatgaaaccggagggattactggtctactactccaaccccgtggccaccgtggccgccccggcacagtccccgtccgtcggacaggtcccaatccgctctccctttttaacacctcatcccccaacccaacctgctctcgctcccaccacgcttcgctgctgctgatcaaaccccgcttctcgatccgaccagggaaggaggaggggaggatga

SEQ ID NO: 871 - DNA, 1501 bp, Oryza sativa
ttcgtcttcagatctttggtctgcagcgtcacgatcgcatcccgcagcacgtcggtgcccagcccggactgcagagccctttcctccctgtccatctctcgcagcttcttgagtcgccggctcagctcctccacggagaaccactccttcccatccttacccaccggtggccgcagttcactgagcttcttgccgagctcattgtcgctgtacaaccggatgaactgctgctcctccactttgccgtcacggcctctcctcgcctcccccctcgtttccctcccgaacaccgactccggcagcggcttcccgtcgtgtctctgccgcgaggagaggatggagctccagtccggcgaactggcggtggcgccggggaggggcaccgccgacgccgtggggctcgttcccaggttcttgttcaagctctcgcggagcgcgctgaagggaaaggcgtccgctccggtggcgcggctggtcggaggggcgggcctggcgcggaagacgtcggcgaaggaggggctggggttcgcggcggcggcggaggtcgcgccggatgagggatgggggttgcggaagaggtggaggctgcggcggacatcgtcgggcggcggtgattcggggatgcggcgcggcggggaggagggaggggtggcgttgaggtggccgcggatttcggcgaagtgggaggagagcttggtggtgcgctgatcggcggatgcggggtcggacgtcggaggcgggaacataccctcgccggaggaagaggagaaggcgcgcgggaggagggttttgtggccgcggtggatgcggcggcggaggaggaggagcgccattgccggcggcgaggtcgagtgaactgagaaggtgacggaaaactcgcgggcttcgtgtggttggtttcgtagggcattcggcgagttgggcctcaacgggctagcccaaacggcgcaggcttcggcttaattcggcccaaattagcgaacagcgtagaattttgacaataagtctattttgtccttttgactacaaaaccggatataacatctattccatctaaaccagtgcaagtcgattcttttgcggataagtctatttttgtctgataacgtctctcccatcttcgaaaaccagtgcaaattgactattttgggggtttaggaagtggtttatgttgatgtgcaccggcttttgaagcggagacattatacccggttttgcggttgaggagggtgattcactcaaaagcatgacagggagacaaattagacttactccaattttctctgatttcggcccaattttgcgtatggcgtgggatttggggctgaattcggcccgtttttatctccttcgcaaaaatggagttgaatttgggccgaattcgtcgtcttcttgtcggcctacgagtggtggaggcgagctgcagtgtgtccgaagcttttcttctctaccagcggcagcggcggctggtagggaggaggagatcgccaccagatcgcca

SEQ ID NO: 872 - DNA, 1501 bp, Oryza sativa
gacgccatcgccatcgccatcgccatcaccatccgaggaatcgtagtcgaagtcgaagtaatccacgatggactgcagcgtggagctcccactccaaccggattcctgatcgcccgcggcctcaccctcacctccgcccggctgctgctgctgctgctgctgctgccaggggaaggaggcgcgctgggacggcgccctcgcggaccagcggcggatggcctgcttctcgaagctcggcttcagggacctcctcttcttaccacccctcttcccgctggcgacgtccagcgccggggccttctccggcgaggaggtcgagggggaagaggaggagactccggccccggcggcggcggcggcggcggtggcgcggcggagacgcagtgacctcgtggagcggagagtggaggggaaggggggtttgggggagagcgcgtggggtggtggtgggaagagcagcgccattggaggcgaggagaggagctccgatgagagaggtgggagatgatggtcgaggagatatgagcggccatgagaagtgggccttgggccataatttttctctgggctagttcttgggccgtcaatcttttagttttgggctttaatgtttgggtctgcacccacaatatttataggaaaaagtacaccagaggtccctcatcttatcaccaaattataaaatcatccctcaacctaaaaaccagatatataacatcccttaacttataaaacctggtcactctaggtccctaggcggtttttgccccggttttgtcatacgtggcagatgagtcagcgtggggcccacgtgggacccacgtgtcaatgactacttccttttctctctctacctctcttcctctctcttcttggcaaccggccgcgcggaaggactgaggagcgcggctgacgacgggcggggagaggagcggagggggagatggacgcggcggcggtgccaccggcaagggcgaggcgacggcctcgccctcgccgtcgcctcgctctccctctgcttgacgggaggcgactccagcgctcggccacgcgtccccctgggtgctgcgccctccaccgctcccaacccggcggcggcggctctcattggcgggatgctgagtcgagagctgctactgattgacaagaaagaatcaactagcgtctcgcgtgttacttgccaagtttcagtacgcagcgaggtaacgaacaataatcaactcgatttgatcgagcttcgctcccagctgatcccatgggggactgtttcggctccgaggaggctgaagctgctgcgaccgtgagggcaccaacataaggccaccatggacgctggcaaggtattcaaatgcttgtggcatttcttctcccttggttctttgacaacatattttaatcaaatttcaaacctcgcagcagaagcagccgctccagcaaataggcgtagtcccatcatggcactacacaacgtgtttgcttccataagcagcgccaccgggca

SEQ ID NO: 873 - DNA, 1501 bp, Oryza sativa
tttatttgatgtaggattaatagttgttattgttattaatgatttgaacgctataagtatggaaggttaaaatttaatctctactattataaaaattgaaaatatttttatcaggatcttcgtacgtcatccgtttctgagtcgatttttagttggttttttataattcatatctatatataactaattaaaaaatacataaaacttttgtttttttttctgtctcgtattatttttttgtcgctggtttcccgatcagccttcctccggtttttctcatcgccattttttcgttgtttttttaccgccgtattattttttccgtcccgctgtcccgtcggtttgtatcaccgtatgttttctccttcaattaattaaaaaatcgattccacacttatctttcattattttcctcgcgttttccctttcaattggactttaaattattcagatttaatctcaattcgccaatgatggccgaccggtgacttcccctaaccatttttatcccgagtgttatggatttactccgattttgagaaaaaaaatataaaaagggatcgagcggatcaaacaccctcagccaattttggaatatcgagaaagattcagcccaatttgatagggaggatcggctctggcatacgggcacgtgattgtctctcgtaggttgaagatgccatatgtgcgagctacgcaccgtatgtgcgagctgggcctgtggcttcacttgtgggctaagtcaaagagaggcatgcaatttattgctcaattcttaatagttgttgtatcactgaaaaaatatttttacccgttgcaacacatgggtattttttctattaaagtaaaattgataaaattttagttgttgcatgacatatatgtaataataaaaatgtttagaaataataacgggtagcaggaccacaaaatacattatcctgtaatacgaacgactaggtcatcacaaaatacatccttggatacatcatgttttccttaaatacaagtatatgcatcaatctgaaataatgtcatagaaccgtggaaacaacttgtaataaatcaagcatacaacccaacccacctacagacattatcatctcaccttgaaagagaaatagagaacaaaacacctgctgtgattcaatgtaccccgaaaaataaatccatcccacagaaatcatgcacctttgaaagaaaaaattgggggatttctaggtgtttgaggaggggacaccgtttggggcttgggggagggggggagggatgggggcttgcttcctcacgcctccaccgtcacccttgtctgtagcaagagccaccggtggtcaaaatctcatggacaggagagggaagagacatgaggggagaagagaaagaagagggaaagagaggggaaggaacctgcactacagccgctgtgctgccgacactactagaaaaactatttttgctggcggccaaaatgagtttttgctgacggccaacgccaccgcca

SEQ ID NO: 874 - DNA, 1501 bp, Oryza sativa
agtgtaacatttggagctaaaaatgagttcacaattaatagacgtatattaagggtttaaatgagttcacaataaaggagggtaactcatctgggtttaaaattcgttgtccacgtatattaagtacacaataaggacgttttcagtgggatttattgatggtattgggagttgctgctggtctctactccctccttccaaaaatataaggcctattcctttttcatcaaaacatcaaaaccaaaaagcaattaactcactcaccatatagcaaaaccaatgaacatgtaaccaataagtattagaatggcttcttggttttcaatcaacaatttaatttagcacacaggactcatattttttgagaaatcgaagaatgaaatatgtctcatatttttttttgaaggagggagtatttattttcttctttttttttttgagaaactgcgtacttcatccatcccataaaaaaccaatctaatactagatatgacacatcctaatacaatgaatctggacatacatctgtccagattcgttgtactaggatatgtcacatccagtcccagatttatttatttttggacggagggagtaagtagtaactctatttaagtcacatttgtacaatcgtcctcttgagaagatagaataaaacccttaggaacaaataccctgtaaaacagctagagaaacaacttcttttacgagcctatgtgctaccatattcgtcgagcaatgaactctgaaagacgtttaatctggacttaaactaacttcatgattctataaatagaacggtttagttctgactaaaataccgtcctagtcatttccatagcatcattattcaattagaacggtctccatttcttttaatgtgggttagaaacgtattagtgtgcgtatgttcacaaatgcttcattcattataaaaacttctgctagtagaagcaccagtgatgcgtggtagagttgtgggtgtataattttacccaccataatttaaattctggtgcccacgaatattacgtatatgcaaatgaactttcgaacatgattttagtgagatcagtgatgtgtcgctagtttccgtctcttagagcatgtgttaggggacatattagtggggtgttacgtgtgtagtggtgtgtgcgtgtgtgtaaaaagaaaacttccgctatataagtaggagtatgaaacatgtggagtagattcggatgaaactgacttttttttttttttgctgtgatgataatttgactgtcactgtcagtcgttggctagacgttaatactcctacttccgatagattataaaaccaaaccccgcacgcttcgcctttgctcgccgcgtcttcccttcttctctctctctcggccttaactaaacccgaatcttttctcttaatcccgcgcgcagtgcacgaatctcaaagcggccccggctccttccccttcaccggcggcgatggcgccggctccggctccggcgggctcgg

SEQ ID NO: 875 - DNA, 1501 bp, Oryza sativa
caccgattaaaataatgtatccgtgttgacaacgtgttaggggggccgattttttatgtcgagtgaccgaaatgcccttgcaccttttggtgatattgaccaggtcggcggtgctatttgccgacaccgaaggcgaacagcggcgattcgcacgttgtggccaaaagaaaaaaaaatgtagaggaggtcaagacgaacacaacggtggtacatgcagacagaatggccacgggagtcaacgccggttgcgatgcaagcgggttggagtttcggcatgtgtgtgcatgttgtgctataggctcgatttggctaggggagtgcattcatgtggctctggggtctctaacggcagccccaacccttcatctagaattgtgtttatggcattaactatattgtcatatatgacttttagcttatgtggcactatattaattaagagagagagtgaaaaaaggaagaaactgggtctcatgcaagatacagcttcaacacaagaacctatgtactagacgctatcaagttttgcattgggagataatagtgtcttcataatagatgaagaataaatatgattggtagataagagagataatgtatttattaatggcccactttaagaaaccatgggttgtagagtgtagtttctattgtgatgtcttagggcagtcccaacccatagtgtctataagtagtgtctatgatgctatgtcaataagacccccgggggaaatagagatgtctcctacgttacccataatatgtagaagtatcgacgtaatttcatagagtcattcgatctgaatgttacatgaagaacataagccagatgacggaacgcggagacctaggatgtagaacatcataacatgagcgattcggcagatttggattcctttcctatatatccactcatgtggtacttcatcatgcgattcatataagatccatctgtctagagatcgtcatatacatctagaaagccgtatgctttggaagaagcttgtacagtttgggaagaggttttttgagagaaaagaagaatctacttcaaccgatatgcccttaggcacggccatacataacatagaaatcacacgtggaaggggtggctaattagctagagcagcaggtgttgtagcgaaactgattgcaaaagaaggtaaatcggccactttaagattaccatttggggaggtccgtttggtatcccaaaactgcttagcaacagttggacaagtgggtaatgttgaggtgaaccagaaaagtttgggtagagccgggtctaagtgttggctaggtaaacgccccgtagtaagaggggtagttatgaaccctgtggaccacctccatgggggcggtgaagggaaagcccccattggtagaaaaaacccacaaccccttggggttatcctgcgcttggaagaagaactaggaaaaggaaaaaatatagtgatagttttattcttcgtcgccgtaagtaaatacgtaactaggaata

SEQ ID NO: 876 - DNA, 1501 bp, Oryza sativa
atctcaaatacttacttatattgaagaagcatcagccgaggtacaaacgaggagagagggccaacaactccggcgctcctccaggactctcttgaagataggccaacatctgtagaacatcccagacagaaaaccaacatttgggaaccacacataacttccattgggactttaggatcttgctccacatatcagcagatggcgagaggaaggaaaggcagttcggccgacctagtggttcaaccgactcctttggcccacctcttgacctcccttctactggggggctgcctggtgggccctttgcatattgtatcttggttgggttcaattgttggtggttttgattgacatgtgggtcctctaatttgtgtattcgtgtccgactatccggaggtgtatttcgtcgtatggcggatggttttcgtccataattcacctgcatacaaatattcaccaagatttgtgaaaatagttagtaataaccactacctctaagtttggtattccactttatattctttcatttgtttttatgcatgaattgacggtcggatttggtacttaaggaccgtcaacagaatgcctcccctccagtggcacgacacaattttggctgaaattttcaaaaatttcctttttttgtgaatttaatcaaaatttcttcatttttttttaaaaaaagaattaatgaaattgcaaaccatgcttatcacacaacaacaatgaaagccatatctgaactagtagtccagtaggtaactttcatttcatgaatatacaaatgcaaaattacataattaaataagtttgaaccatatatatgtgacaaacagagaaaagtttcaaaatggctattaacatgcatgcttgaccgtattcttgttagtttagaggaattactatatatctataaaatccacagataacttaaatgaaacaaagtcatgtcatgtgattgacacatgatcaaagtagcactaattcctattcgatgtaaataaaaactttatgaagaattgatccttttttttctgaagaaagatgatagatcatactagacaggaagagtgggaaaattattttaacaatcaatccggccaattgaatttagaatcaatggatagtctccgcaatggcagacattttaaaaaaatggaacatatatattcatactttcacgatcaagacgaccaatggaattccgaatcaacatgaattgcgagcctcgacaatatcagtgtggatattatgggtaccccatacccatacggcatggttatccgactagtcataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 877 - DNA, 1501 bp, Oryza sativa
aacccatgccaaaaccatgcatatatttatgtgaattataatataatagtactttttaatacatgtaatgagtggactgcaagcaggatagcatgcaaatttatcacaaccagacaagatggaagaactgactgtatatttgtcttccataaacattgtcatttgccaatcaatcatcacctcctctggctgtatactccatgtgttgccaaacacagatttcttgcagaatctctgagtgttttcagggccagatgtaaggagcagagaggaactacaattcagagccaaatcacacaatattttgagacctgaaaactggggccttggctacccaatgagggagcaaaacgacagctcagcaatcaccatgaagcagttggcagcctctgattgggctgctccttgcttacctgtcccttagtagaaccccactatacctgtttctgtttgttcttcctgttgacagcttacttacaactgaagcacaaaggcaccaccatcattcacacccagcacacagcaaatgcatgaccccatgttttcagttgtgcagaattcatgcccaggttgtagtggcctttcagaaactgaaaccagttgagagtgggagccaatgcaatcatgaggatcgcgccaattttgcgcaatattcgcagtatttacctagtaaaattctctgaaaattaatcttgatatagtgttccgttcaaagaggtggatcaaatcctgaacaattttgttcggttcaataactcacgctgtttgcgcaaatattattcggcttatattttcttaactagtatcacaatatatcactattaaatttatattgcagattcagaaaggaaagaataatcaaattatgaaccaaaaaggtagcccagcacaaggaacacaagtacatcttcctttcctccctggtgtccctcctgcagtttccttttgcttagcacaggggggataaaacttttactgctgacaatggccggccacagcaaaagcctcttcatctgtggggttggctgatagctatcctgccctactacatacctttccatgtctaatatctgaagtcggttgagaggtgaattcagcagaaaggggttgttgcagggggcaaggtatctcaggggaaacttcttgcagcaaactgcacacggtttggcttagctgtgctgccacattttctcactggctgcaagcagcttagctagcttgtactcactactcccctatctatatatacaggcaccaactcttgtaaggttcagagttcaggtccattccaaagttgcaatcaatctgtctcgattattgcctctctgctctgagtgtgactgtcaatctgtgagcttagctagtgactggccattgcacgagaaaagaacaggttgatcgatcattagtaggtgaagtgttcttgccctgttcttttcttggtttcttgggtaaaccaactggttgggttcggtgagtttgagaacttcagaaactgtaa

SEQ ID NO: 878 - DNA, 1501 bp, Oryza sativa
gctgcaatgatgtcgctacttaatatctgtgaagaatccttgttaatacaaacaaacatacgaccaaaatctctctgaattcatgccagaagcatcaaatttctgcagttcttggaacaattcatcgatcatgcatgactgacaactgaattcttgtttggatttggatggatgcaggggtgcagtcggtggagataaacaggaagcagtacaaggtgacggtgcaggggttcgtggagccgcacaaggtggtgaagcgggtgcaggcgacggggaagaaggcggagatctggccctacgtgccctacaccctcgtcgcccacccctacgccgccccggcctacgacaagagggctccccccggccacgtccgccgcgtcgacgccgtcatgcccgtcgccagctacggctccgccgccgctgccgccgcgccggaggagcgcctcaccaccatgttcagcgacgagaaccccaacgcctgctccatcatgtgaattactgtaactgaatattagtgtaatctcttcagagttcagatgaatgtacgaaatgtatgtgcagatatgagagattgtactccctccatcccaaaatataaaagaatctagaatctggatagttgtctagattcatagtattagaaaatatcacatctagtcatagattcttatattttaagatgagagtagaaaggagggatttttctgcggttttggtctcttgtcgcatgtgcattggaatcttagcccatatagctttatttatactactccgtatatatagtttaattaggttggtagattagattacaatatacatatatatatggagttgtgtgctgttatgagacatatggttgagttaataaaatacatgatatgcttgtacttggtggtgcagctggatttcttctgtccggccattgccttttggtaatagcaattagaataagcaagttaattaaaggtacgtttgattggttggcggctacagttatcattctaaaccttagacgtgtcacgctttgttaaccggttagctcttataattatgatgatgtgccagtacttcactagttcttatgtgtacactccatttctcgccaaatcttgtcacacttgtgaccaagatagaaattgatcatcgcacatagcaacattagtccccagatttctctaggacaagagcaaacttcccgttgatttactgccactcatcccaggccgcctgtgcaaggtgcattttcagcccatccatgataagataaagggttgtctctcgggattggagccatcactgtttgtatgcatgcggggttgggggggggggaattatgatgaacaaagttgtaagtgccatcccgacatacattatcacaataatgaaacaacaaaaacaatcccttcaagaaattgacaaaacgaggcgacgcttcctatgggttggaaatgagaacatgcatggaggcaaatgcaaggtcaattggcccaaggtttgctct

SEQ ID NO: 879 - DNA, 1501 bp, Oryza sativa
ccaaatctcgcgtcatctctcttgacctgggccaagcaatcgatcatcccgatccactcgggctttaaacaaatcgctgcaaatttgttgttttccccttaaatttttatgccaagatcgcttaaattcaaccggccaggtggggatttcctaggagaggaaggcgatggcgccgccgcggaagcagcagcaggaggaggagatggttgccggcggaggcgaggcggcggcgctgcgggcgccggcggacgtgatcgcgcgggtgttctcgcagctggactgcgtcgacctcctcagctgctcgctcgtgtgcaggtcagtgagcagagcacgacgcgattcccggttcttgcacgcggcgtgttcgacgtaatgcccaccccgacgcctcgagctcgctcgatgcagtgaatcgaatccgttttgctcgatctctccgagtcaatggctatgatgtagcttgctgtctattggtatctgccttttgcttacaggctggatcatagctctgctcttaacagtggagagttgaattgatgatggatcatcgctggtgaattagggagatccctaaatccgattaattttcgtgttttaagaacatttcggtcaagcaaacggccatcatatttcttgctgaattttctgaccaaagtgaaactacagttagtttaattggtgcttgatcagttgctaaaagaagtgaatactcttttttttttttgtaaaagaagtgaatactgaacacaagaatattcatcttttcttctgttacctcaagcaatttgctcagtactagtacccttctgacctgaaactttgctcatcattttgtgaatcatcaggcaatggtaccgcgactccgcggagctgcgagaggagtggagaaaggagtacatggaggcctggaaccagtttggtctctacgtcaagcagcagccgcagcagccatgcccgacctgctcaagctcgatcagaaccctgcgaggcctgtgttcctgagaactgctgctccctccattccctgtcctgccattttcacaaaggcaaaacatttgtagatggcaccaacttctgtattgcacatgagcattggtggtggcagacttgtgtgttttgggtagtgtcagtgctgcctctgcaacagattcatcagtatgtgtgtacatggtgaataaaactgatgttagttacatggtggattgctcttctgtataattgtattgttgattggtgtgtaatgcagtaatgcaatgtgcctcttgatatatgcaagaaaattcatgtgaacaaaaccaaacagcaaattcatgtgaatctgccattattgagccaccaaaaaccaagtacatgcacacaccattattatgaacattgcctctaggccctgttcacataaacccctccagctttgcacaacacaaagcctgataggcacacatcaagctcaatctgatggattttctacaaccatacaacacagcataatatcaccaaattc

SEQ ID NO: 880 - DNA, 1501 bp, Oryza sativa
gaatctctcaaagctgagagcgcgattgctaatccgcgcgcgcacgtttccggcccgccgccggcgcgcgcctcccactcttttttttttcgtttttctttacccattttttttcgctttttccttttttctgattatttttttaatttttagcatgttttgagtttgaaagttttaaattttgagttgaaaattttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaaccaagaatttttttcggttttagattttttttaaatatttacataaataatctatcggccaaaaaaattacaaaaataaaccctgtcgcccacctctggggcggcaagctaacgtggcaaacgggggaggaacaggcgttgatggagggagggttttttgcaggaaaacccttgccgccctctggtggggcagcaaggggcccgaatgcaaaaaagccagtcggggctggccattctgcaggcggtcccttgccgccctctagccgggtggcaggcctcgctgcctataaaaggcttgccgcccagcccccagccctcattcctcccccctcaaatccagtgaaaaaaaaaagaagagaggggaggagaagagaagaaggggcgaagccctgtcggattcagacgccgatttcaggtaatattcatagatcctatatgtgactattgagataaatagtgtgtattttttaaaaatttgtttgaataaatgcattatatttttagggttttagttgtactaatctagaagtgcgtattgtagatatcggtaactacgtagatctactagtttggaatcaatacattaccgttgcattggcttacacaagaagatattacgttgtagatgtttattgcatgaaagagtaatatgatctagttatttcgttgacagata

SEQ ID NO: 881 - DNA, 1501 bp, Oryza sativa
tttatcaggatcttcgtacgtcatccgtttctgagtcgatttttagttggttttttataattcatatctatatataactaattaaaaaatacataaaacttttgtttttttttctgtctcgtattatttttttgtcgctggtttcccgatcagccttcctccggtttttctcatcgccattttttcgttgtttttttaccgccgtattattttttccgtcccgctgtcccgtcggtttgtatcaccgtatgttttctccttcaattaattaaaaaatcgattccacacttatctttcattattttcctcgcgttttccctttcaattggactttaaattattcagatttaatctcaattcgccaatgatggccgaccggtgacttcccctaaccatttttatcccgagtgttatggatttactccgattttgagaaaaaaaatataaaaagggatcgagcggatcaaacaccctcagccaattttggaatatcgagaaagattcagcccaatttgatagggaggatcggctctggcatacgggcacgtgattgtctctcgtaggttgaagatgccatatgtgcgagctacgcaccgtatgtgcgagctgggcctgtggcttcacttgtgggctaagtcaaagagaggcatgcaatttattgctcaattcttaatagttgttgtatcactgaaaaaatatttttacccgttgcaacacatgggtattttttctattaaagtaaaattgataaaattttagttgttgcatgacatatatgtaataataaaaatgtttagaaataataacgggtagcaggaccacaaaatacattatcctgtaatacgaacgactaggtcatcacaaaatacatccttggatacatcatgttttccttaaatacaagtatatgcatcaatctgaaataatgtcatagaaccgtggaaacaacttgtaataaatcaagcatacaacccaacccacctacagacattatcatctcaccttgaaagagaaatagagaacaaaacacctgctgtgattcaatgtaccccgaaaaataaatccatcccacagaaatcatgcacctttgaaagaaaaaattgggggatttctaggtgtttgaggaggggacaccgtttggggcttgggggagggggggagggatgggggcttgcttcctcacgcctccaccgtcacccttgtctgtagcaagagccaccggtggtcaaaatctcatggacaggagagggaagagacatgaggggagaagagaaagaagagggaaagagaggggaaggaacctgcactacagccgctgtgctgccgacactactagaaaaactatttttgctggcggccaaaatgagtttttgctgacggccaacgccaccgccagtgagtaaaggccagtgataatacagtgttttcgctggcggtagccaaccgccagcaccaatccattttctctagctgtttttgtaagctagccaccagtgaaaat

SEQ ID NO: 882 - DNA, 1501 bp, Oryza sativa
aagagaaatgaagcaaactttcagactcccagatcaaccaaaggcgcatacttacttgccagcgtcaattaggatgttcgccgtgccagacggcgtggcatggcgcaggaggatggacgtgttgcgcctcctgttccgattccctggctcggctgccttggtacagacctgcgtgcaggaaaggacaaagaagaaagtgagcaaatgacattgagcaaccaatcaacacaaagtatgacatagaaacgacatcgcgctgctgcaatgaagagggtggccgtacggtgcaggtcttggagggattggtgaggcagctgacacgcgggatgccctcgctggtgcccgtgccgaggaagatgagctccgactgctgccgctgcttctcctgctcggacggcgaggtggacaccgcgccaccgagggacgcgccggcgctgcacgatgttgaggaggagaaggagcgagctggaagaaacgggagcaattcatcagaaggagctaggcattacgtcgaacagctgaggcgcgagctgtatgtacgtcatacggcagcagcaattcacgccaggcaacgcaccagagctgaggcgcgggaggtaagggcagaacgatgacggcgcgatggccgccgccgtggcgcggacgagaggagggagcccgcgcgccgcggcgaggccccgaatcgagcgcgcgcgcggcgccggcggcacgtgcgcggcgcgcaggagagcggcgatcgcgcccgcacccgcacccgcgccggccatctccggagaggatagagagagatacggccacggttcgccggcgggctgtggcggcgggcggcggcggcggcggcgggcgaatcggggacggtcaaacgacgtctcggccaccggccgctcgcttgtcgcgcgcggcggggttggagacggagcgacacgggcgacgctgacaggtgggccccgcgtaaccgcacagaaagtccccgacctttccgtccgttcagcgcccatcccattgacaggtggggtcaaagccgatatgggcctagtagatgtcagagggccacatgggcctctttaagctagttttgggtacattgggcttttgtgttgggccggcccaagaatattccgttcctccctttcccttctccatcgtctgggttccattccacgaactacccaatccatccatccgccgcgcctctctctccttcatcatcaattccggtgaggatatcgccggatcgacgcgccgccggcgggagccagccgcaggtgcgcaactatatctttctgtgtaccccggcgacatgttctttttccatagttaggtttgggatctgacgagagagagagagagagagcagttcgtatcgttttagcactcgccgcgcagggcagggatccgcgtagggttctcctgatctggggatggggaggattaggagttagggcttcgatttgggaagctgttgattccggatcagtgagctctcgatcaagagtactac

SEQ ID NO: 883 - DNA, 1501 bp, Oryza sativa
ccacatgccaaggttgttgcatcgtgggtgcaatttactcgtaagtttatttatccattttaaactaaatcgtagcactactgcaaaacatcaaatagggaccagcctcgtaggtgcagatttatctaaaaccggcacctatgagacgtcgtccaccctcccaacctctcaagcaggcctagaaaaagcaggtataacttcttacccaataataggaatacaatgatttataccagtactaataatagtatggctagtaggaattaaaaccggcactaataataagaattcattttattttataccattgagtttactttaatccaatgatttatcatcgactttatcccctctaaaatacaccattgattttatcgattttttttacaatatactgtcggagtggatagttttttttaaaaaaaaaagtaaaatatcctttaatagagcaattgatttacagaagtttaaagaaaatatgaaaactttatgtagactccttacacaatatataagtgtatgtatatttcaagatttttaatttacatatattatttttttctgaaaatatattttatgttttatatgctaatggaatactttttttatgttgatgttcttttatctaaataatctttcatatgctataaaaatatttttccactacggctatcttttgtgtatgtgattcctttttccatatgctacataaaaatagttttttttaaagaaaagcatatacaaaatcttaaaatacacacacaaacttctatacagtatacaccctctattccatattgatcatccatataagtctttttttatcaagacaaaaacagcttaactttttttttgtatttcatttaatgtaagtatgtagtgggaaaaaaatcaagaaacatataaaatataactcccccgcatgcacaagaaaccagtgttttacttcccctaatgcttgcatgcatgcatgcatgcatgtagactcaatttgcatgtataaaaacaataatgcttcacgtcaaataaaaacgcaagggttatatgatgatcaacaagaacggaggaagtattatttaaggagactacgcaaaaactttcatatattttttcaaaaattctaatgggtcaattaattgccaagtattcaaggacattttaagcttttttttaaaaaagtatttacttcactggcatattgtattgtaaaggaagataaagtcgatcgtaaatcgttaaactagagtaaattaaatcaatgacatactccgtaggacatattctctcattatcccaatccacacccctctcctcagtgagtccacacccttcctgaattatccgccgccactctctcgatccccaccacttcgcctacatgcgtcaccctcccttctcctcccccacctttaccggatctaccaatgacatcgtattttccaggtgtcatcaagtccagcaagattatccacaccaggcctcctaaactacatgacctcct

SEQ ID NO: 884 - DNA, 1501 bp, Oryza sativa
aacacgagctaaaggctggatttaatttatttttcttaaaaaatgaagctcgtggatatgcttctaggcatccctctcactagttacgtgggccccacttgtaagtgaactgtctagaatattcctaagaatattcctttatgaaaatccaataaattatttccaatgttctagaaaatgaattaaactttcaaaatccatatctctagctctggtcgactccttccacctcccgtagttctctaaaattgtgacatatcaaaatgtcactattactagtcctaagtatgtctttttcttgatctttgtgtaggtttcaactgtttgcgtataatttgggccgtcgaaaaatcgttcgaaagtggtttcgagaagatttgtgaagccccttagcaacgcaaatcacctttgaacatattgtgtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcgcaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacatgcaaggggatacaaggaggggtttctggctatttgcataaaggcagttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagtgtgagactaatcacggtgaatctggtcaatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccttcccctaaccatccacaccacgctaaggtttcacccccacccctcaaaaggcagtgggcggtcccctcttgcgccgcggtgaatccggcagctggacaaccggacaccccggccaacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaaca

SEQ ID NO: 885 - DNA, 1501 bp, Oryza sativa
cccctttgactcgctgacgtgtggggcccgcgtgtcggcgccggccgccccttgctgacgtcagcgaggtccttttcctttgtaaaaataaataataattgcgcaataattcgttaataattctagaaattcatataaatggctcaaaacttctaaaattcatatctaattcattcgaactccgaattgagccattcaacttgcaaaattcatctaaaattgagctctacatgtttgtttagtttttatgtactgttttcttggtttttattagagttttttctcgttttgcgtgccagcgtgtagaatccgtcgtttcggaagttcgcggtcgcaaggataagagttcggaagattgtttgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcaatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggttggccggggtgtccggttgtccagctgccggattcaccgcggcgcaagaggggaccgcccactgccttttgaggggtgggggtgaaaccttagcgtggtgtggatggttaggggaaggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccagaaacccctccttgtatccccttgcatgtctgcatcgttggtgtggcttgctgagtacggtggttgtactcagccttgctattattcccccttttcagaagtgtagtgcttctgagctgaagat

SEQ ID NO: 886 - DNA, 1501 bp, Oryza sativa
agcggaacagccgaagtatatatataaaacgaaaaagagcagcgtaacaactttccccagtccagcctagctcggcctggtggtgagggtacgaggccagcccatccaagctggcacgggctgttcaggccagcccggctcggcgagctcagcgggtcgcccctcgaaacgttttttttttttttcccatggcccgacggccgcaaacgcctcggtggccttctcctgccgcgtggcgcggcggcacggggcaggaaggcgcgcgtcgcggccacccgcatgcggtaggctggccagtggccggccacaggccaccagcagctagaggccgagagccagctacgccgcacagcgcaggctgccggctctagaacctgcaagattctctcgcaccgcacgcagctttggcgccgtctgcggctggtgtgcggccccgccaccaccaacccatttatgcccatactccgtcaccgagacgattaggctgttacactctttcgagttccgtccatgaaattccctatttcgtggacaggttcggaatactccctctttataatatgttcgttttaactcatcctatttatatttattttttttaaataattactgtattggagtttataaaagtgagaaacgcgtaagggtcttccagctagctctacaaggtggttggctagacgacctaagtttgaaacctcaccccttttaattatttgatattacgttcttctctaatattcgcgtcttttagtttataaaagtaataaataattgtattgaaaatagataaaatgagaaattgttatattaaaatttgataaaataaaggtattctaatgttgggatgagtaaaagatgaatttattttgaggttaaagaagtgtatcggaactgtggcaccggttgagcgccgcggtcattgcgtgcacttgcggtcgagcttggtccatcatttttttttctaaaaatgaaaatagaatctggttccgctatatatttttatggccggtgaaacacgagagacaccgatgaaatctcatgctcctctgcctgccatgtgtctgcacgatacagatttaacgtttgccccgtagcgtgagttgggagtaaaataggagtaattcttttcaggaggaaaacgctgacatctgtactgcaatatcaaattttactcggaacaatccgacaaaatcctctctttctctctctttaggcgtacgcaagcgccgaaagaggcaagctgcgatactacgccggaaggaaggatgccgaggcgaggaggaaacggaagatttcgccatgttttgcccgcctccgcccacgcgtcccttgttgccacgcactacccgagtactccgcctatttaggccccaccaccgccaccaccccccaactctccccctccgacggcgtccaccacccgaccacctcccgcaccgttgcgagttgcgacccacccacccacccgaaccgattcgaatatcccgcacaccgcccc

SEQ ID NO: 887 - DNA, 1501 bp, Oryza sativa
ctgtttatcttttagaatggctggtgggctttttgtctatcttagaatgtccggtttgatcttcagaatcagttgcattgccctaaaacttttagctcacaaagtaactatatatacccttcgagcttatattacatttaactgatgtgcaaagcagatgatatctggatatgcgatggtgagacagaaaaggcgtgttcagcaggtgagaaagtaaagttttggggtgttagcatgcaggtttgataacttgtttatccctcaaactctacagatcttagagcatctccaacagcttctctatcccactctccaagccaaaatttagccattttgaacaaaaatcccactccaacagcctctccatcccactctccaagccatccggatggccaaatttcttccctcactagccaaacttggccagcctactccacttgccattcactggccatccatgggtcccaccacgctcctccttgtcttcttcgtcgtcgcctccaaatggaagccgcggcgccagcttcccacgccgccgcctccagtcgcgcggccgcctccggcccgcaccgcctcggcgagcccggtggccacctcgccgaccgcgccgacctccgccgcctcctcgtcaccgccatgtttgccgtgggccacctcgccgaccgcgccgacctccgccgcctcctcggtgccgccatggtcgcctccggggccacgccggcggcgcggcgcagcctacttcctcggcgtgcacagcctcgccttcttcctcgccgccgaggtcgccagcggagtcgtccagttcgcctggtggccatgcgtcgtcgccgtcgtcgggaactggttcggtcacgagtcgccgccgccaccgcctcgcgcacctgcgccttgcgcgcacgcgagtcgccgccgccgtccgccgtcgcctcgcgcatccgcgccttgcgcgcacgcgagttgccgtggccgtcgtcatccgtcgtcgccgcatccaaggtaaaggcgaggggaggaggcagtaagtagtactggaggtggtagaaggggtggccgggtggggaaaagagagtggaagaagggtagtagaggctgacgtatgggtcccatttgtcatagacttgtaatggagatggtagatggagaggctgttggagtaaacaacgagtttggcttgtcaaattagatggagagttggccaaatagacatttggagagtgagagagactgttggagatgctcttacgatggacacgtgagataagacaagaaaaaagcatacttcagaaagatatgtggtaactcccgtagttgttcaaatatttttgtttactgtcagatgccaaaaaaaaagtgataggctttatcatccgcattaggtattaagggggttatcagattagactggaagcatcatagaacaactattgagtaaacagatccattttattgtagaaaagctcaaattcacaaacttctctgacccaaaaggtcaaaagaaatt

SEQ ID NO: 888 - DNA, 1501 bp, Oryza sativa
aaactgagaactgaccgccactaacaaatgtacatgtacgacactagaagtctctgtcggcggcgacccacctcgtaggaaacacaatgatccaaaagaagaaacaacagctgcaataaattctggtttaattaatttagttaagctttttttatctccttgatatatattttttctgcgttgaataagaatattcgtattcccatttgaaattttgtcgaatgattctatttttgtattaccgagtttttccagaggtacagagcagaggaactccaaactccggagtccggacgctttttacagcacacttttactaataatggtaatagtgttaaatcatactccacctatttcacagtgtaagtcattttagaattttccatatttatagtgatgttaatgaatctatatatatatatcattaaaatcaatatgaatatgagaaatgttagaatgaattacattgtgaaacggaggaagtaccattgatttatatagatattttagatctttggttaaagtaataattaattaatttattaaatctaataattccgtgaggatctctctttccatctcgcatggcccccaacttaacgagcgctgccactgtcgccgccagccgccatctctctcaaattaacaacagtaacagcctagcttgttctcaaaaaaagaaaaaaaaacctagcttgcagcataaaaagtccttattagagcccgggtttgcatgcaagcatgaaagaatgaacaggcatgcatgcaaccttcttgtttaatttgaggattaattactgatcatagattgtacgtgcttttgcaaaatcctgttcaatcgaatagagaagaaggaaaagaaaaaaaaaaacgaagatgctgttcatagctatctgccggtgcaataatttggatatcttctctccaaatatgaaacaataatcaagagataattaagccaagaagtgcgtggattatgagcaacggaagtccgcgtatgacgaattctgacgcgttggatcaaactaaatggacggcctatatatatatctagggtatcttaaaaaaaacctcaaagtcaataactacacgagcaaccaaacagggaatactcttttgtaggtggtgttcggatatgaggagactaattttagtccttgtcatatgcgctaattagagtattaaatatagactaataaaactaattgtataaatgagagctaattcgtgagaaattttttaagcctaattaatctataattagcacatgtttactgtagcatcacatagactaatcctcgtgaattagtctagagttatgaaatggtttttatcattaatctctgtttaacacttttaattagtgtcgtaacgtccgatgtgccatctatccattccaaacaccaccgtagtctcgccttttactattctggcacagtagcaccagtcaaggctgaactatataattgctttcctcccagcaaaagaagccaatcactaa

SEQ ID NO: 889 - DNA, 1501 bp, Oryza sativa
attaggcttaaaaaatttctcacgaattagctctcatttatacaattagttttattagtctatatttaatactctaattagcgcatatgacaaggactaaaattagtctcctcatatccgaacaccacctacaaaagagtattccctgtttggttgctcgtgtagttattgactttgaggttttttttaagataccctagatatatatataggccgtccatttagtttgatccaacgcgtcagaattcgtcatacgcggacttccgttgctcataatccacgcacttcttggcttaattatctcttgattattgtttcatatttggagagaagatatccaaattattgcaccggcagatagctatgaacagcatcttcgtttttttttttcttttccttcttctctattcgattgaacaggattttgcaaaagcacgtacaatctatgatcagtaattaatcctcaaattaaacaagaaggttgcatgcatgcctgttcattctttcatgcttgcatgcaaacccgggctctaataaggactttttatgctgcaagctaggtttttttttctttttttgagaacaagctaggctgttactgttgttaatttgagagagatggcggctggcggcgacagtggcagcgctcgttaagttgggggccatgcgagatggaaagagagatcctcacggaattattagatttaataaattaattaattattactttaaccaaagatctaaaatatctatataaatcaatggtacttcctccgtttcacaatgtaattcattctaacatttctcatattcatattgattttaatgatatatatatatagattcattaacatcactataaatatggaaaattctaaaatgacttacactgtgaaataggtggagtatgatttaacactattaccattattagtaaaagtgtgctgtaaaaagcgtccggactccggagtttggagttcctctgctctgtacctctggaaaaactcggtaatacaaaaatagaatcattcgacaaaatttcaaatgggaatacgaatattcttattcaacgcagaaaaaatatatatcaaggagataaaaaaagcttaactaaattaattaaaccagaatttattgcagctgttgtttcttcttttggatcattgtgtttcctacgaggtgggtcgccgccgacagagacttctagtgtcgtacatgtacatttgttagtggcggtcagttctcagttttcaccgtagcgggccgggcaccttttgtcaactccggcaactggttgtttggtgactatcacagattcagaggctcgcagccatgattctctcaaccatgacggcatgacgaactctcgcttccggatcatccaaagaaaaactctagggggcatgtactatcccctagcagcagattgatagcttgacaaagaaccaacggtgcaacgattcattaattaacatgttattattattttctacgtatatct

SEQ ID NO: 890 - DNA, 1501 bp, Oryza sativa
ccactcccctccttgagctcaggggtggtttagttcacattaaaattaaaattttgattaaaattagaataatgtgatgaaaatgttgaaagtttgtgtgtagaaaagttttaatataatagaaaagttaaaagtttgaagaaaaagtttgaaactaggcctccatgtgttagggttctacgatacagctctgctccatttgcctccatgtgttagggttctagtgggtgggctctactggtcagaagattattgtgccaccggtcaggacggctcaacattgccgacactggaggtagagacaaaaacagagaaacgaggcgagaacgatcgtggatttgtggtgcgtctttgttgttgattggactgactggcaatacctatgtgcaatgaaaagtgatgtggtggtcaagccactagctggatcaacttttgctagtctaggagggggtaatataagccatgtttagttcgcggaaagaaaattttaggtgtcacattcgacgtttgaccggatatcaaaaagggtttttggacatgaataaaaaaactaatttcataacttgtctggaaacagcgagatgaatttattaaacctaattccggatatcgaaaagggttttcggatatgaataaaaaaactaatttcataacttgtctggaaacagcgagatgaatttattaagcctaattaatccatcattagcacatgtgagttactgtagcacttatggctaatcatggattaattaggctcaaaagatttgtctcactatttccatacaaactgtgcaattagtttttctatttatctatatttaatgctctatacatgtgtccaaagatttaattcgatgtttttagaaaaatttttttgaaaactaaacaagccataatttgaccgatatggatagtttttatgggtgtaaagtgtaacatggagtgttagttacagtatgaaaactgccaacacaagtaatttagagggggtataagatacatttatttgaaatttcacatataaatcaatgtactatgtggacaaaaggctatctcagagtgattaccaaacgttaaagaaagaccccaagccgcacaaccaattaaatcgcagtttttgaaatgtacgttcgaaatttccgagtgttttccttggcaaactcagagggcacctgttgactgactgaagtgctttacacggtagaccgaactgttagctagtcagcacccactaatctccttcctaagcaaacattaatcacaacctacacaacaaacattagtatacggtggttaattacatgacagagtgatcaaacaccaaccaattaaaccgacctttacaatgtttataataaggtattccctttcggcaaccactccaaaagctctcctcacctgctgaatgctaatctctgttactgaaaccactcaaacacttgattagatcgaaaaccttaatcagagcctcccactgcagctgcagcgaggacagccatgg

SEQ ID NO: 891 - DNA, 1501 bp, Oryza sativa
tctccgccgccttccccgctgccgatcatgtcgacgccgtcctcctctcctcgccaagcactgccacttctcctccccggagctcgtcgccaggaacgcgctcaccttcttctactgggccgcctcctcgtcgccgtcgtcgtcgaccccccactccctccgcgcctactgcctcctcgtccagctcctctcccgcaccgccgccgccgccgcccgatgccgacgccgctcgctctcgctgtccccgcgcgccaccagccgaaggggaagaaggggaaagaaagagagagaagggagagagggaggaggaagaaggtgggcccacatttctttttgtgtgaatgactaatgggtcccacgcatactttttatttctaccgccacgtaggtgccacatcaacaccacgtgtaacaaagactcggtcaatattgccacgtaggcgccacatggcgccacgtcagcaaaaccgtcccccaaaaccgctcagggagtccaattacaccggttttaggagtttgaagatcgagatatctggttttgtagtttagagttatggtttagatttcgatcaaatgggtaatgaagtgaacttattccgactagaaagcctgacgtttctctctttggaacgttttagaataaaactacggttctaggaccactttcaagcgattgttttaataaaaacaattcctcttttttttccaatttttctactgtcatttcagttctctgtagattttcgtgggaggcaatttttctacaggttttaacagtactaaaacagctacgtaacgataataatattgcaatttgcaaacattacacttgtacaggtatagtactacgtagtagtgcacccgctactagttcaacaaaatactcctatatattctatgtagactggaaaagatttgaagggagcaaaacattcggaaaaaacggccgcaccgttttgcgcgcaggcgcgagactcacgccatcacaactcacacgtgatactacttcacagttcacacggtatgcgaaatcagatgctaatgggccaatggcccggccgaaaaagatgccaaatgggcccaatgacacaaacgaaacctcctgagctctgactttccgactccctgacgaccccccctccagtcgggccccacccccgcgacacgagtctccttcggtcaccacttgtcaagttgtcatcatcactggcctactcctagtgcgcctagtacttcgccttccccccacaccccaatgcgctctcacatggagtcgtcgtcgtctccccaaacacgacgacctcgaaccgcctccgtccccgcctcgccaacccgtccccttcccctgtagccaccgcgaccaccaccaccaccacgccgcggcatccacaacgccaccagagtacagagacgttccacccaccccgggccaccgaacccaacccccccagctcgctcgatcgatcgctagctccgacgacaggtttgagcgcgatgaggc

SEQ ID NO: 892 - DNA, 1501 bp, Oryza sativa
atgaaaataagtggcaggtgtacgaacaattgaatcaaaataagtggcaggtgtacaaatataggtgaacattgtctggcaaactgcaagaagaatcactagagacatggtggtggaacaagtgaagacttggacacatcatcgcacttttcaaggcttaaatcccactatctacctccgtgctaatacaagtacagtctaggttttatctaacttttaaccttccgtcatatttaaaaaaattataaaaaaattaaaataaaataatcacacataaaatactattcatgttttatcatctaataacataaaaatagtaatcatatttttttaaataacatagatagtcaaacggaaaaactcacaactacacttatattgggacggaggtagtaatacttaccattatactcataaaaaaaatacatttacacttttaatggaattttggtggaaccagcacaccaaaatttaaatttagacttaacacggtacttgaatttacggttatttactctttcgatggtagatggtgtacatgtttacagcgaggcgtctgtggtgaataggggtcttcttaataggggtaagatgtgagtgtgtgcgtgttgtgaactcttgtgtttgtactgtattcttaaaaaaaggggcttgtttggttgtcactttgaactcaacacaaagctttatgtggaggtgagagaacttatataaacaaagagtgttgatttctatacaagagctagctccttatatacttcaagataaatacattaaatgtaccggtgaaaaaaatatgagaaaaaaatagagacaattttatagctcatctattatacatatcagctctaatacaaaattataactaatagctggctctactattatatttggttattgatcatagcctgaggatagattacattaaatgtcaccagtggctcccggctagtataggcagcttcacaggtttgccagtgaaaactccatttaattttaatattgatttgtgaattgttatgaaatttgtacagtaaatattagttacattgaagtttatctgggctcaaaaaaaatttttggttccgccacttagggctaatttgttggagcttctagttgctgcagcttctctcagaatcaaatgctcttctaagcataccagcttttggttaaattatttatagaatccagaaaataaactagaagttagaagttagaagctgaaaaacttaatttttctagattcccagctatttctcaaaacataaactttccaaacaggctcttaggccatgtttctttcagtttgggattattataatctagattattgagtcagattactataagctagattgttataatctgtagtagaataagcggttagtttgtttctttcctagattattgggtttgcaagtctaaagagggagtgggtggcatggtgggtaatttttcatccaataatctggaaaaagctcacctaaatgagcttatc

SEQ ID NO: 893 - DNA, 1501 bp, Oryza sativa
atccagccatctgatcagtaccaagtggaagaaggttcacgccagctttagatgaggagcctatcaaagactttggtttgacagcagagccaagatcactcataagggttgcactagcaatatctaacaaactggtgtcccctgcagcattgtcgtgattactgacaccactggcgctgatgctcgatatgcttatcccttgctcgcaattcggctcaggagctacattaggaatatccgaaacaaatgtccagatttttgaaagttctgaagatgatgggcaccctgagtagcagtttatggtctgcctcttatgaccagcagctgaagacccagcactatgcccattccaatcacaattttggcaaagcgaggcattttctacaaggcagcggaccatggcaggctgtgaagcacatctatcacacagaagtgtccttgtatgggcgccgagaaagagcattagctgaatgcacattacggtcacacgataagcacaaggatgctgcatctgatcggcaataaaccatagacctctgctccccgcagaaatcacaaagagcgcccatgatattagctatgggcaaactttaagccagctttaggtatgtgccacactcttttttcacaaactttctggatcgatcagatttacataaacctgtacagtatcaacaaacagttattagaaaacattagtaccagcacataaaaaaatattcccacatactattggaaaaccgtagagtattcataaatgaatattcatacatttatgggcatccacctacatgagaacatagattttatattttttactgtttcagttgctatgacctaggaccctaggtagccatccttttcagttttcattcaaaccaagagaaatgttcaaaacaggtagcaacaagtatgttccactcagcgtcgtcttgcatcagctatcaataatataatctaaaggataatgtagatatatttcctaattaggacatattaccgccatctactttaggtttcaacggactcattaatctgtggactccgcccccatttgccaaccgaagcataaaaaatcgaaatcccactacaaaagtatcagcaactagtctttggaatctcctgctcttggcacatattatataattccagcacctcactcattgcttctagcatatattcccattcccataggtactaagtttgcaagggaaaaagagagatgtagaaaattatcacaagaaccaaaataactacattacgagtcaacgacaattatcggtttcattatgaaaatagtatattttatcacaatttctccaagcaacgaacgacaagccgcattagttgaacactcgaaataggggggaaatatatctaacagaagaggctgaaataacgatataagcaaagaaagacggagctatcctagtcttttttataaaaccaaaagaagggtcaatttgcaggataaaatcatagcatcaggggagaaaaaaag

SEQ ID NO: 894 - DNA, 1501 bp, Oryza sativa
ccaaaagcacgcttatctacccagaagtcacggaatacaccatggaatcaagaaaagcagaggtatcacctttagcaatttgctgacaaggaaaagcactaatgacacgacgagcgaaaacaacttccaaaagcacccgaaacaaccgcacctatggtaaatgacgtttgccatctatcaatcgatcggctctactccataatccatatcctaatccaggaagaagaacataccgatgaaaataattaaatcacgcatcaaactttcctaaaaacttggagaggaatcgatcggaaccagaagctaacgcaggcagaagaagccactaacgagtactagtaagcaacaggccatttcatcgaatagctcatggtcatggacagcaaaaaaaacttggtcagcgccgagtggacgaatatatctgcaaagcaatcagctgtttatagcagaggggcgaaagaaaaaaaaataccagcgacgtcctggccgtcgtagacgccgcggtggacggtgccgaacgtgccgcgggcgatgacgcctctgatgacgagcttggcggggtcgatctcccagtcctcccggcgccgctgatggtgcggcgcctgcggcggctcctccccgagcccgagcctggcggactcgccgcggcggctcccgctgcccccgtgctgcgacgcggcccgctccgcggggcggccgaggtggcgctccagctgctcgtcgaggctcttgaggtcgatctggtccgcccggacgaacccggcgtccccgctcccgccgcccgcgccgggatgcctcatcgcgctcaaacctgtcgtcggagctagcgatcgatcgagcgagctgggggggttgggttcggtggcccggggtgggtggaacgtctctgtactctggtggcgttgtggatgccgcggcgtggtggtggtggtggtcgcggtggctacaggggaaggggacgggttggcgaggcggggacggaggcggttcgaggtcgtcgtgtttggggagacgacgacgactccatgtgagagcgcattggggtgtggggggaaggcgaagtactaggcgcactaggagtaggccagtgatgatgacaacttgacaagtggtgaccgaaggagactcgtgtcgcgggggtggggcccgactggagggggggtcgtcagggagtcggaaagtcagagctcaggaggtttcgtttgtgtcattgggcccatttggcatctttttcggccgggccattggcccattagcatctgatttcgcataccgtgtgaactgtgaagtagtatcacgtgtgagttgtgatggcgtgagtctcgcgcctgcgcgcaaaacggtgcggccgttttttccgaatgttttgctcccttcaaatcttttccagtctacatagaatatataggagtattttgttgaactagtagcgggtgcactactacgtagtactatacctgtacaagtgtaatgtttgcaaattgcaatattattatcgtta

SEQ ID NO: 895 - DNA, 1501 bp, Oryza sativa
cgggctagttccagtcggggctagttcggggcgtgacaatatctttacaaatatacaactttaaatttgacatttacgaggagaaaaaacatatttgaatgcgaatagtgcattattcacaagaaaattgttgtttttatttttagttgtgtatgtcaaattcaaacttgcatatttattatggaagaacacgttttcaaaaagttatatgactatataggagatataattgtctacaaggatgaaaatactctcacctaatataacgaataattcacttgatgggcatgtcatcgcttattaacacacttgtgacattttgtgctctttaatttatggagaatatggtttgtgctcatggttgggatttttcttgaaacaaagccaaaatttattgtattatcggtggagagcatctaaaaaactgccgtaagtttttctagtaaaaaaatttcagatgtaactatagtataattgaagtgtaattacatgtagctgcactataaccagggtttgaaattttagtttgaaatttccgaaatctcgcccgaaatttcggtaatctcgccccccgccggcatgctcaaatctcatccgaaatttttggctttttgcaaatttttgtgaatttggtcaaattttattcaaattcattcaaaatcaatcaaaatttcaaataatttcgttccgaaatttccaaaatttcagtaacccttggcataaagtccaaatttgaaattgtcaaccttgattataactacgttgcaattacggtataacttacataaaacttgtattcaactgcgctttggttaggttaggtagtactgaaatcttatgcgtaacatgtataaaaatttctttccagcaatatttttccttcatgtataaatctcaagatgatccgatggtcataaatccgaaagttttaggggggaaaaaaacttgtggaagtttttttggcaaatccgctgtaaaagttacacgctcgtgatgagtgccgtggagtgctgtatatatagagatcgcgcagagctagctgcttttgccaacaaccaagaagctagctagtgatcgcgaagagatggcgtacaacgacgacgagcagactgctccgacgagcaccgccaccgagccggcgaggccgacggtggggatcacgggccaactggtgaagcaagtgcgtctcaacaagtaccacaacgacgtcgcgtccatggcaccccatgaccaggagctgctgctcgagctcaggggctcctcctcgtccaccgacagggcgggcctggacctcgtcgccgtcatcgacgtcagcggcagcatggacggggacaggatcgacaaggtgaagaccgccctgcagttcgtcatccgcaagctcagcgacctcgaccgcctctgcatcgtcaccttctgcaccaacgccacccgcctctgcccgctgcgcttcgtcacggcggccgcgcaggccgagctcaaggccctcgtcgacggcctcaag

SEQ ID NO: 896 - DNA, 1501 bp, Oryza sativa
tatctcgttgtcttaagatttaaaagaccaaaccttatcatcgttgtgtttctaattaattttatagtttttaaaagtcacaccagttgctaccctttatttctgtcatattattctttattagcttacccaatctaccgtactgtttctattcattctccttgaaacctttaaaaattggatagtaagtttttagagtttattatcacgttgggcttcttatttataatttatagaagtcctatcaaacgctgtcattatacttctctatgactgtccactgcatcttctctatatttttaaaaatcaaacataattatcgtttatgttcatttttctactttctagaagtttcgccaaaacgccaacgactttgtctctatactcctctatggctcgcccgctgccgtccttctctattgttattgagattttaaaatcaaacatgattaacattgtggtttatttttttttactttttagaagcacgaacatttaaaaattggaccttatagtttttgagtttattgtctcgttgagtttcatgttttttataatttttagaaatctcgtcaaacgcagccactgtactcctctacgacccgttcgccgcatactctttattgtcattggaattttagaaatcgaacataactaacattggaattcatttttttactttctagaagacccaccaaccatcggtggctctgccattttattcctatacgacccgcccacagcctctcttttttattgtaattgagattttaaaaattaaatatgattatcattggggtttatttttttattttctagaagtcctctccaaccgtattgaccgattgcttcacgacatgcccgtcgtctttccttttaatcatcattaggattctacttggtgttttattaattgtttttcgatatttcatcaaccgccaccactctgctcctctataggcctcttacttaattaatctcgtcatgtgttttagatagtattttctttcaatagtcttaattattttatagttatttataaattgtattctagttgaaatcttttttttctttttctaatttctaaatttatttcattttttgtattatatttttttgatgtttttattttttatattcaacttcagttattttacaattgtattcctagtttaactctctttttaatttgcccaatttcggatgttatgttatttttattccaaattttaattaatctactatttggttcaatattgcttatatttaattccgaatttcagttaattttaaattgtattcctacttgaactcttcttttattatccttttttctaattttgattttttatttttttattctgaattttaattaatctcgtattggattcttgtatggactcttctttcaatatttcttattttaaacttcaaatttcagttatttttaaattgtattcctacttgaactcttctcatttttctgaatttcgttattttt

SEQ ID NO: 897 - DNA, 1501 bp, Oryza sativa
agaattaaaatcctttaaaatttctatgtttttcctccaaatcaaaggagaccgtagtagtatcgcgtagtagaggatttgctggatcgggggagtaggacaagattcaatattttaattggattgcaatgcgttaccaaattaattaatcagtggtcagtgtacaaatttaacaacatgaaagtgatactactgttttgcaccgagatacatatacaatcataacacgatgatagccatgagacgtacctgacataatagctaccgatcgagtgacataggctgtgtgtttagatccaaagtttggattcaaactttagtaattttccatcataacaacctatcatatacacacaatttttcagtcacatcatctccaatttcaaccaaaatacaaactttgcgctgaactaaacgcagccatatacgggaagctacctggcaactcgcataacgccaacacgtaaatttgaatcctacagcattctctccatctcaaaataattttatttttatctacttcacacataacaatacaaaactaaaaaaataaaatattcttattttatcaaactccgatgcaattctttctcactttatctattttcaatgtatttatcctatatatttataaactccgatacaatgattactcaccaataaaattattcagggacaaacaaaagagataaaaataaatttattctggacgctgggatgcctgtagattaataagcagaattgattgttacgacaggagctatatatatacattttgctctttcattatctataaaagaacacacgattgacaaaacatcgacgcgaccgtcacggcaagccacaggcgaagcggcacgatgtagaggtgccgaagcagaacgcgctcccttctctcagaagctttctacagatttacgcggcttaaccctcaaataaagcgagatcagaggcgtgatttcctcatttaatagccttccaatgaaactgaaccatttctaatcaagagacttttccaagttttgtctctactgtacaagtgtacagtgatgtacagatgtgatagatagcttagctggggctttaacgcggtgagactttgatatatactcctttcatcctaaaatgacgaaattagactcatcttaggcagttgtctggtctcattctagattatactctctacattttatattataagactttgtagtattatccacatttatatagattttaatgaatctatacacatatatgtctagattcattaatatatgtataaatgtgagcaatgctagaaagtattataatatgaaacggagggagtaatattttaggacggaggaatcatctagcaattgaacggagctctcgtcgactcgttcctctttcaatcgattacatcgaattgagttttacgaaatgggtgtacaggattcagtgctaccactcatgcagacgacaacaagggggtgagacaccctcactacgcccaattagg

SEQ ID NO: 898 - DNA, 1501 bp, Oryza sativa
aaacagtacggacttaaagcacggattagagtagaacttgaagatggatacatccaattcaaaacagtatgcgcatgtaggcgaaggcaaagaccaagacaactcatgcgttcctcagccaaaaatcgaatataccatgcatgaaaaagaaaaaaatgactaacaatgtggaaaaaaaatcattcaatgaagaagatcatttgcagatacactgtaactaattaaaatgtacagcggtataaatagatcatggatatatataaaatattgttatatttattaataaaaatatacgatgacgtagaaaggttgtcaggatcgggatactaggtagtatcgttttgctcaaagtaatatcgtatcgtaggatcgggatactatgagattttttaaaaaaattaattactatttatattaattatatatagacattctatataaaaaaatatagtaatgatatatgtcattcaaatagagacatttattaagagaaaccacgttggttttgatatatttaactgatttttatataaatttgagcatatttatttatattataaaaataacgaaattcagaaaaatgagaagagttcaagtaggaatacaatttaaaaataactgaaatttgaagtttaaaataagaaatattgaaagaagagtccatacaagaatccaatacgagattaattaaaattcagaataaaaaaataaaaaatcaaaattagaaaaaaggataataaaagaagagttcaagtaggaatacaatttaaaattaactgaaattcggaattaaatataagcaatattgaaccaaatagtagattaattaaaatttggaataaaaataacataacatccgaaattgggcaaattaaaaagagagttaaactaggaatacaattgtaaaataactgaagttgaatataaaaaataaaaacatcaaaaaaatataatacaaaaaatgaaataaatttagaaattagaaaaagaaaaaaaagatttcaactagaatacaatttataaataactataaaataattaagactattgaaagaaaatactatctaaaacacatgacgagattaattaagtaagaggcctatagaggagcagagtggtggcggttgatgaaatatcgaaaaacaattaataaaacaccaagtagaatcctaatgatgattaaaaggaaagacgacgggcatgtcgtgaagcaatcggtcaatacggttggagaggacttctagaaaataaaaaaataaaccccaatgataatcatatttaatttttaaaatctcaattacaataaaaaagagaggctgtgggcgggtcgtataggaataaaatggcagagccaccgatggttggtgggtcttctagaaagtaaaaaaatgaattccaatgttagttatgttcgatttctaaaattccaatgacaataaagagtatgcggcgaacgggtcgtagaggagtacagtggctgcgtttgacgagatttctaaaa

SEQ ID NO: 899 - DNA, 1501 bp, Oryza sativa
gatcgcgtcacgcaggtgcaggcgtccgccttcgagtactcggagcaagtccgcgctctcaacctcgccgtcgagcgcgtcgaggcttcccagcgcgcggccacgacgaacccttctggcttggtctcacgtcagccacgcgacaacacaccgccacaagatgacgctgacgcacgctcgcgacgcgaccaacacggcgacgacaccgcgatcgacaacagcttccttcctcgcgccaaactcgagttcccgacgtacgacggcaagggcgacccgctgccatggctgaaccgctgcgagaccttccgcggacagaaaacgccggagacacgcaaggtgtggtatgcctcattgcatctaatcggggacgcccagttgtggtattacaggattgagctcaattctggcgaaccgtcgtggcggaggttcgtccagttggtgcacactcgtttcgggccacccatgacggacagcccgctaggcgagctcacggccctgcgtcgcactggcacggtggagaactacgtcaacagtttcctcgccttggcgtgccgcgacgtcgagctatccgagtcccagcaggttcagctcttcacggctggcctcgtcaacccgctcaagactgatgtcgccctctgccgcccgcgatcgctggacgacgccattatgctggcacgcgcgtacgagcagcgcgccacccttggcccgactgatccatccgcgccgcgcacgggacgagtgccgcggccttcactgccggcgtcgtcggccgcatccgcatctgcatcgaccacttcggctgatgttgccgcatcgaccgctgctggcaagcagcccctggtgtcggatctgccccgcaagcgactttctccagccgagatggcccaacgacgctccgaagggctatgctacaattgcgacgagaagtacgtcgcaggccaccggtgcaagaagtcgttcgtgatcgaggttatcagtttcccggaagacaccggggacgaggaggactccacgccagaagcacacgccatcaccctcgacgagccgagcatcttcctccacgccctggctggtatctctgctcctaagttcaatactatcaaggtgtgggctcgtctcggctcgcaggaactcgtcgccctccttgactccggctcaacacacaacttcatcaacgatgccatcgcgcaccaggctagcgtccctctacagcgccgccccggcctcagcgtagccgtggccaatggagatcgcgtgccgtcaccgggcaggtgcccgccacagcgcgtctccatcggctcgcacgagttcgacatcgacttctatgcactcccgcttggcggctacgacattgtgctaggtgcacagtggctcggcaccctcggaccgacgctatgggatttttctcgacaatccctcgccttcggacccgcccacgaccgcgtcacgtggacaagtatcgacgccgcaccggcgcccgcccttgctgccgccatcgacg

SEQ ID NO: 900 - DNA, 1501 bp, Oryza sativa
ctgtacttaagttgaggtaaaactctatcgattgctttggacaccggctctcccatgatctgccaagttgagccggcctacctaattttctacgaagcacacaacaaacaaaggtaaccactaatctagacaccacgcctaagttatcaattactactctagtctcgcgtagaaacttcattctttatggagagtgctagtactagagtacttaatataatagtaagcgacaaacccacgacgatgagaatgtacctcacttacgtaagtcaattaagtacgaaaaggaaatctcgaacacttagtttattaaagaagtattcaccgaggtacaggagaggagagcacgccaataactccagcactcctccggaacctttctcactctctaccctttttctccacacaactaaaatgatgcctaatgtatgaaagtgagttgtactctattttgttgtgtgtttggaagtgaaattagctcatccttttatagcagcttaatggtcggttgtaggtcggtagttaagtcggtaaacactcacaaccaccatcgtcaaccaataggagatcgccacatgatcgaacgctgacagttaggggtgccaaccctgttttgtccgaaccaagcaaacaacctctagctaggacctctcttctatgtctgacaagtcggcccatatggcggtgcactatggattaggtcaatttcagtcgttttggactgtcatgtgggcccttccaatccttgtgctcccatatgattggtcgaaggtacatttaattcctgggtgagtgctagaactaatatgatagatgtgctcgggctcctgggaaagaggccacttgacatacttggtgtagtgccccaagggtattccctatcgctttttcataattttctctctccaaaatcggatggaaacaataaaaaagagaggcgatgttcatcggcaaatatctatttttttttgatagtgtcttcccttaaaacttgatttttgcgaagtcttccggctaaaaccatgaaattagagtgccttgtaacaaatttaatttgcctaaatacaaaaaagatcgaatggagatagcattaaacttgctccatacgaatcatattagttggaccgtaactcatagaaaaagttgcaagttggttgacctatcaaccctcttatgttgacccgtaaaccctgttatgcattaaggattaagtacccggcagatcgtcactactcacgaatgcacaaatttccggtacgtaggatgggatgagttggtcagaaacgggctcaccacgtcgcccaacctgccgcgatcgagccattggccggcgatgcacgcgctttgacacagccgcccgccgccccccggcccgcccccgctctttaataaaaaccggccgccccctgtcaaaggtgtcaaagtgtcaagtgcatcagagctaagctagcggtcacccagtcagctcaccccgagacgcaccaggggatctatcggatca

SEQ ID NO: 901 - DNA, 1501 bp, Oryza sativa
agggcacctcggctgcacctccgtcggatgcctgcacgatgcagcacaactgcgcatcatcctcggcatcacccttgccctcgtcctcggcgtcggcagcggcggcgctgggaggagctggtcgagagtggcgtggaggcccaaacttggcggtggtggccgctgccggtgtggctaatgctaggatcgaccgcagtttggttcgtcatcttcaacgtgggggtgtgcgccgtcggcgtgctgttgtcgcgtgcgcgggagtcgctctcgccgcgctgcggcagtggcggcggcggcagagtcacgcgcacggcctcgtcagcgccggagcgcatccactcgtcgttctccatcttctccttcccgtcggtgatcttctatgagttccatcttgacgccggcgagccacaaacgccgatgccgcgcaagtatttgtcggtggaggaatcgcagcccacgacggatctcgcgggaaggaatcgacaagcatgccgccgtttcgagcttcctcggcgactttccctgccagcactgtgaacggccgccgtgcttgtcccccacccttgtctcctgcacggcaatgtcctccgtgacgacgccagtcacccgagctcgccctgcctccaccgccgactgcctgagttctctctgcctccgcctcctccaccggcgcggagctcgcccctcagctgctgctgcggccgctgccttccccccgccgcagcgtcgcaccccgtcttcctcccgagctctgcctccgttatcggccacccaagcgagcgagaaagagagagagcagagggattggggaggggagagagatgataggtggcgccagtagtttttttttaattttctttgctgactggattgccacgttggcgccatgtgtccaagctcaagtcaaaaacagctcaaaacagtgctttggggggggggggttattttagttgggggtgaagaatgtctggttttcgggtttaggggggtaattcggtcgaccatgatagttgggggggggtaattcgtagtttttcctaaataaaataagagttcctccaatgacattctcatatcgcttaatgtgtataattcctcaccaagacattgtgttgcctctttttcatcctacctctaaaaggtttatatgtgaagctcaaggtggggaaaataattaggcaatactcttgcatcacatatattgcaaaatcgaaaagaggatcaaggagaaaacaaatcatacaatctgatcaagatgtgcaaagtgtgtggctatatggtagaaagtggtatgtggtactctttgtcatatattgactatattttattcctactttgagatatgacatttttttctaactatttttttctcatgcagatcaagaacattgatgagcattcacttcttttgcaactactctttttttttccacagtgcttgagaatattttctattctctatcgccttctcgttgtttttatcacagccatctcttttgca

SEQ ID NO: 902 - DNA, 1067 bp, Oryza sativa
atttagatgactccttggttctaatcaaatgtttaatttatctcttcatttaatttaagtcttcaatgcataaagactaatataggaacaacttatttagaaaaacttaaatataaaatatgtgtaacttttgtggatggagggagtatttgaaaataaaggtgaatgagtactctctccgtctaaaaaataaactcaacctcgtaagggtgtgtttagttcacgcgaaaattagaagtttggttaaaattggaacgatgtgacggaaaagttgaaattttatgtgtgtagaaaagttttgatgtgatgaaaaagttaaaagtttcaaattttttttgaaagttgagtatttttttttaacggagggaataatgttgtgcagtaaaacccgtcagactgctgtgtggactgttgtcccgtggttcagtcaaagatgccatttataaacccttgccttaaaatatggagggatgtgtagctcagctcctggagctgacaactccgttagaatagtgcaggtatgtgaagaagacttgtatggccaaacgtaagggttagggtatgtactcctagggttagagtaaagatggaagctttgccgtgacaacatatgcggactgtatcaccgcgttaggttttgaagctgggaggggcggagggcagcgattttggttggtagtagtacgggacggcggcgaaaaaaaagaagcaaaagcagtgctcccgctcgccgcgctcggtttcgacttccaaaggcaccgccgcggcggcagcttccccgtctttattaccccaccacgccatcccttttttttcacactcccgccacgcctcccaacgcccccgaaatctcgtgtccctacgtgccggagcagctgcgagcttttgcacccacgctgtgagccccacccgcgtacgccgcggcctacgccgcactccactccaccccaccctactgcgccgcgccgtttcaaacccgttcctttcgtttcaccgttcccaccacgcacccctctatttatccccgcccccaacaacctcgctgcactccacactccacgcctccg

SEQ ID NO: 903 - DNA, 1501 bp, Oryza sativa
attctgttccttgctgtgctgccatagcactccaaggaagagagtaaacagataataatggtataatccagttggtatcacagtttgagaaagaaaaattccaacagcatttcaactccatagcttgctttttgttaacagaaaaagaagaagctacgtgagacttacccagacaaacaaggctgctaacgacaaacatttgggggttgataggcttccacgcagacagtgtagagtgcatctgcctcatagataacaaaagaaggtcattgaaaacagtaggataagaatctcagcaagccaagcctttatgtttccgtagtgtaacatcaaatctagcaatcaagaatgaatttgtattttactccttccgtcccaaaaagaatcaacttagtataacctatcctaggacaatgaatctggacaagtgtttgtccagattcattgattcttgttgggacagagggagtaggtgaacggcatcactccagaaggattatagtccctttccttttctttttttttctcattttatccacaattgcatacctcctaaaagtgggaaattttatctacatgtttcttttcggtaaggtatttgtggctatttgcagctccatccccaaaacccatctgtcaatttattgccaaaaaactaaaaaataaatttgtataatagctcatctgtttttctttagaaaagtatagaaattacatgacaatttgatagtgtgcaaaaattctgcagactgcattgtcatgcaggccttacatatagggtcatgagccccttttcccaccactataacataaattcagcaacataatcttcagagatctccttgcctgaagtgtcttatgtttcataaagaaataacataggtagtgatctatgatactccctctgtttttctttaatgataatttagaatgattgcaatctatcctagtaagatttagattatgctacaataaaaaaagggtaattggatttgtcatgtaaaatggtattaataggactgataattaaaaacctgtcatatcaatatattactaacatatagtgagataaattaatggtcaagtttgtgtccagagttgatatccaaaataacaagaaaaataaaattactttaaaaacatttaatttcaatcaaataaaaaagtaagtgttttcttaatcttcaggacatgcatataaaattataaataatcaaaagaaggcctggaatagaggaatatgtataaataagatcaaacaaatatgcacattcatacatatcttatgattctggtggaaaattctatcatatatccctacaagtctacaacttgaaagaagacagcatgcttcttgccactataaatagaggctcatcactctacaatgcccaataagcaaccaagggcacattgaagtgcactaggttttgtcatttacaactagccagagcactaatttcggaaaatataattacctgtccctccaaggctccaacca

SEQ ID NO: 904 - DNA, 1501 bp, Oryza sativa
tactttttttagaacaatatctgtatacttaattgtttattaataatgtaaacacatacaccgtgcagttagggtgtcacataagcatggcagctcatacacgtagggtccatgcatccattatattcagatctcaaatcagatttgggcatgcaaccttttttgagattccaagccatcgcactcaaatcaacatttcatccaagttactactaactagtccgttgattaagattatatactcctacttaagtttttgtatgtatcttcaaaaaaatgtttcgacatgtgtattctaaaatgtgattgctgttttggggggggggggggggtttggaaaactgaccaagttaattctatatattaattccattgactatatagctcatgtatttatgaagtaaaggtgtgatttggcacgccaagctacgcatacaaaaggcatgagcaggtcagaaaccaccccatgttttatttgtatggagtaatacgaattgtatgttggtatcatgcatatgctgaatcgatcgatcatctgttggagtgttaattggacaactttaattgtcgtgcaggttgttacatgtgcaattaattggccagatagtagtaggagtactactgtgtttttagtcaagtcgtgtacactcctgagagtgattaactatcggcaacctagcttaattactgatttgtcggtgtgtgtacatggatgcacatgcacctgatgggccaagtaagcagcaaaccatctttagcttttcaggcccgtatgtgattgggccgaactacggcccaaagtcaaaacgtattaataaaaacaaagatcccttcacctagatttctttcataaccacacaagcataatagattaatagtatcattttggtgttaaaagcaaaatatcatgtttttttagaaacattacgagcgaagacaccttcgaaagattggaccagcaaatattaagattaataacgaagtcatcacagttattatcgacagatatattatatatcacttaagaaaataattagctataaatatagacacctatgtcgagtgtagaacttgaacctgatgagctgattccaccacagttgagtaacattcacttcagaaaaaaaaatcatttcctctctaaaaagccaaaagcagtgctgcaggctgcagccatgatgcgactgtatacgcgtacctgcaccgacaaattacgaaccattagtccatttgtactctcctggccaaaggaaaaaattggaaaccattaatctagttgccaataagcaatcaatctcaggagtgtacacaacgttgactaactactacaactcacacgagatatcatcgatgatcactgaattcagcagggtacaatatatccgtattatgggaactagacatggattttcaatgtgatcatgccctccctacgcatagctttcgcgtgccgaaccacacctttacttcacggaggaattgaccctatatcattgaaaaa

SEQ ID NO: 905 - DNA, 1501 bp, Oryza sativa
tgccgttgtcgcggtgcacgccgcccgaggcacatgccggccggaacccgccctcagcgccggggccgcttcgacgcggcgccgctcctgccactgccgtccaccgcgccgcgcgacgaggcgacaaccccagatccgaccgctagggtcccggatcggcgcgccaagcctagccatcaccgacgagtggggagaggggggggggtggcgccgacgaggtcgtgccggcccgccgtcgctgtagcatgcgccgctagccgccaccgggcaccgggtccagcgctccccgccgcccccttccagtcagaccgcgggagggccagctccgccgcgcccactctggcctccaccccgcccactccggcctccaccccgccgaccgccagcacaagcgccgccgctccgcctcctccgtgcggatggtagtgacgctcgcctccggccaggtccagcggcagggcgccggatccagccacgggggtgccagatccggtggtggcaccgccggatccgaagcttcatgccgcgccgttgccgtcgcccgcccatcgcgcgccgcgtcgtcgtcctcgcgctgagtcgtcgcgtcgccggggaaaggcctcgccgccgccctcacggttggtcgcgcggaactccggcggcggcgaggggtgggagaggaagggaggaggcggcgggggctagggtttgccctccgtgtcgcccgcgcgagagggcgacgcggaggtcggaagatccagtactgtttcctgtaccctcggctataacatcctggattagcgtattcttttatgtgagaccctggttaactaaactatgtgtcacttggttttgaaggatttgatgaacatggaagatcccaaaaagtactcgcaaacagcttaagcaacatgataggagtagaatagaagttcaggcatgatggatcacgtgaagctggactgaagtgccttcgccatcagtgtggcgaagatacgaagaattccagcatttttgatcttcctcttcttcaaccattcaatactcgtaactcgtagtaacatgacaaataaaatagggataattacatatgtacccctactttaaaagccaattgctgttttacccttatttttcagggtttgcatttttacccccactttttaatctgaagcaaccgtctaccctcacttgtgacagccgtttgatgggtcccacattgtgcgttaaagaaatacaaaggaaaataaaaaaagggtaattatgaaattacctttgtacccctgagagtggatagggttgagtgagtcttccacccgtgcgtacgggaaaagcaggtcgaatccctagcgcggggcggcgcggaggcgacagcgagagcgcgcggcggggaggcggcggtggccgagggcgtgcggccgcgccggcgcccgctcccaggaggtagacagcccgcctcttcttcctccgcacggaacagtgcctcgccgcgccgcgacaggacgggaagccctggcgg

SEQ ID NO: 906 - DNA, 1501 bp, Oryza sativa
ttcagaaattcagagtcaggtccaattgttgtacacgtgtgggttgctcaaccaaggactgacttcaaagtttgagatagtccacgcagcgaattcaggacgttttcagatcagtaaacacatacagccaccacgcatcacataagcaccgtgcatacaagtactattagcagtggaatgtgtactagaattcaacatattttcaggcttccgaggaggaaagggtttgtgaagtgtgaattcaaacgttgaaaatctaatcaagccatctgggattctctcttcttttttcaaggcactcgtaacagtagccaagccaaatttcagtaaattcccaggattaaagcaaaagatgactggtttccagaagacctagcaattgccaagaaaacctcatactttggacctcagctccattcaaacaacaattttataggatctatggatggcattcaaacatgaaatgcatcagctctggtgtaaattcacttgctcttgtactgcatgcattattgccttgtgagcattggatgcttggcatctcaggagtactagggtttattgttacatctcccagtgaagtagttgaggaggaatcaccacagcatattcattggcaaactgcaacaaaactgttttccttgcaggggtgcagcatcatcataaagttgtgaactggatcataacagaacatactattatagcctggagactggaccacagcaaaaagccatgccaccaggcaccagcaatgtcacaaagaaacagaacagttgtatggacaaacacatagatcacatgaccacagaaagtatatcttatctggccaacaagagcacagtgatctcagataggtgctcagaatattttctttcaggatgctttcactccagactatatttagatccatgctgcataactaccattatcattgtctgatcatcatcaatgtgattacattaacaagtagtagttcttctgaacatcatgtggctatatatacatacatacatcattgatgataaacaaaacttcgctgagactgggttaccatgagtataatttgtacacacgtcgtatatttgtctcaccagaactacaataggacatcagtatggttatgaagcaacatattgcatgcccattgcagactatatcacttattgcaatcggatcaatacatgttgaagccaaaacaatgaaataaagtaagcagctggtcatctagagatggtcaatgaatacaccatttggcagcatatgctatttattttatactgaaaacatgagttgggtacaatcaagtatgagctagacatcacacatgctcactaaataatttatggtcagcaggagtacataatgaaagaaatatggcatgttcagagcagttgaatctcataatgtacagccctcaggacaaataaattgacatcccaataatttgaaggaatcaaataaaagcaagaaagtggacctgatcctgaaagggatatcaaac

SEQ ID NO: 907 - DNA, 1501 bp, Oryza sativa
cagaagcaaaccgtgtgcgcggcggcgaactgtgttcgcacgcggtacctacgtacgttcatctgccaacagaaacccaagttcttagcccaaactactggccgccattaattaatggagacggccgggaccatgaaaatatcgatcggcatccaccatctaatcatctctatctactactacatgatttgtctaaatcaaagcattctcggttttcaggaatgatacacggcacgactgaaacatctaggatgtgccacgcccacgagtcctttcaattgaggatcttttccatttgctcctttttgttttttaatataagaccccgtttagttcataatttttttttaaaaaacgtcacatcgaatcttttaatacatacatggatcattaaatatagataaaaataaaaactaattgcacagttaaggaaaaaatcgcgagacgaatcttttaaacctaattagtccatgattagccataagtgttacagtaacccacatatgctaatgacggattaattgggctcaaaagattcgtctcgcggtttccaagcgagttataaaattagttttctcattcgtgtccgaaaaccccttccgacatccggtcaaacgtccgatgtgacacccaaaaattttcatttccccaactaaacagactcaaatacatacgctaacaacacacatacacttacctatataaaaacccacgcacactctataattatgagtatatttgaaaaatgggcaagtatattttgagattgatgaaattatcgtagacttttcgctattgagaagtacatcacttaccaccaaatatgagcacacatgccgattataaaacataaactagaatggctggttttcacgacacataaccaactactccctccagttttattttaactgacgttttggacaataacacggtctacaaattatatctttatccttatttttctattataatatatacaataaataaatgtatggttacttttattataatacttttaaagacaaatgtttatatattgttatagttcgtttaaactaaatttttttgaagttattggtggttaaagttatgaccgtttgatctcaaccttgtttaaaaaatcaattattataaatttggagggagtatgtgcggatcggtgaaaaatgaatttattttgaaacgaacggtgtgttaccatgcaataattctctccttcgcttcccgccaacgcaaaacccctactgccgccgccgccgcgccgtgtccgtcgtctccttcttcttcttctccatggacgagacacgagttgaccttcgctttccttccatctggagtgatcgatcgatctcatccccgcacgcgctcccttcacccacctcgatcgagctccatgtatttatagacgagacatggttgcttccaaccaagcacatccacgacagtggcatgcatcttcttgacctgatgaccatggcgagcgtttgttccgcggcgg

SEQ ID NO: 908 - DNA, 1227 bp, Oryza sativa
ctgcgcccccattacaattaaatctttacaataagatgtcacacgattgtagtatgtagtatgttggtaaaataaatatattttaaatgttgaaatttgatgtttaatgtatgagaagcgaatgcttcaactggaattctactctatcgcacattttaagttttgattaaaaacaaatatatttttgcttgttataattatttgtgctgtttgtgagccaatatccatgcaaaatagaccattttaattcacataataatcttataaaagtctatttcataaaaaaataagttttatattgttatgggcctatttggtttgcattgggtgaccttaacttggctcgtacgggtcatcctatttgggattagcatggccataggacgtagatggctgaatggtgctgtctggttacatgtattagtttaactaagataggttgggataatgtttggttggttatatgagatgcaacacttgggagatttcgcatgagtttcgatacctattctatcctctatgtgaagtgtaaggttacatctttcatctcaaaatttatcaaatctaataaacatatcaattgattttagttacattttaaatgtttttaactataaactatacaattaatatgcgtggaaaagatgctaaatgatttatcacacacatttacaatgatatgttatagtttttatataatggcaattatggcagtaaagaaaaaaaaagtcactccgcctctcgttgttcccttgcccctccgttgccgacctcttccctgctcttctcccactctgccgctcgcctcctgctctcctgctcctttcccactccgcagctcgccgttccctgggttagggtttgcactttcgattttggtcaaactttcggtagcaccaaaatttacgaatttcggtacttctggatcgaaattatttgaaactttaacaaactttaactgagtttaaataaattttgattgaatataaaaaaaagagaattttcaaaaattttggatgagagaatgatttgacggtgggtcctagatttcaaactgaaataatataatcacttccccgggtccctaccagggtgtaccttaccgccggtaaccgcgcggttaccgcgggggtacggtaatataaataccgcggtaacctccttaaattcaaataaattttaaaaataatttgaatttttgataaattttgtacggtttttcacggt

SEQ ID NO: 909 - DNA, 1501 bp, Oryza sativa
cgcgtcgagcgcaacgacgccaccgccgagcaccccggtgaaccgcgccacggtctccccggcgagccactcccggtccacggacaccgaacgccggctcgaggcgttgacggcgcggccggtggcggggtcgatgagtatccagcttagcgtcagctcggccggcgtgatcggcgccggcgccgagaagccctcctggacgagcgcgtcgacgcggaacggcgagcccaagaaccactccgacgaggcgtccgtctccacgacgcgcgacatgaggcagacttcgccgtggtgcaggtcgacggcggagacgagccgggccgggaggagggaggccgacgacggcaccaagccgcgggcctccgccgggagcgggaacgcgtcggcgaagagcgcccggtaccctcctccgccggtgacgccgccgcattcgtctaggccgtcgacgtcacgcagcgacggccacgtcgcgaggcagaggccgcgccacgtctccgcgtcggcggcgagctcgcggaaggcggagcacgcgcagccgagcgcggccagggaggcgccgtcgtcgagccggcgtagcacgagggagagcacgtcgcccggaatgtcctcgatggccgtcgtcgtcgtcgcgcccgccacggcgccgtcgagcgacaccgccgccgcggaacaaacgctcgccatggtcatcaggtcaagaagatgcatgccactgtcgtggatgtgcttggttggaagcaaccatgtctcgtctataaatacatggagctcgatcgaggtgggtgaagggagcgcgtgcggggatgagatcgatcgatcactccagatggaaggaaagcgaaggtcaactcgtgtctcgtccatggagaagaagaagaaggagacgacggacacggcgcggcggcggcggcagtaggggttttgcgttggcgggaagcgaaggagagaattattgcatggtaacacaccgttcgtttcaaaataaattcatttttcaccgatccgcacatactccctccaaatttataataattgattttttaaacaaggttgagatcaaacggtcataactttaaccaccaataacttcaaaaaaatttagtttaaacgaactataacaatatataaacatttgtctttaaaagtattataataaaagtaaccatacatttatttattgtatatattataatagaaaaataaggataaagatataatttgtagaccgtgttattgtccaaaacgtcagttaaaataaaactggagggagtagttggttatgtgtcgtgaaaaccagccattctagtttatgttttataatcggcatgtgtgctcatatttggtggtaagtgatgtacttctcaatagcgaaaagtctacgataatttcatcaatctcaaaatatacttgcccatttttcaaatatactcataattatagagtgtgcgtgggtttttatataggtaagtgtatgtgtgttgttagcgtatgtatttgagtc

SEQ ID NO: 910 - DNA, 1501 bp, Oryza sativa
ctggattaggagcagaatccctttggttttcagcttgtagcctagcttgttcagctctctcatcctcagctctaagtccaacgaatgcatacatgtcatcttcccccatcaaaggcactgaagaacctacatcagcttctagaattggagctatctccaatccatcccaatcaatgacttggtgatgaacttgctcttgtggaatttgagctatttccaatccatcccaatcaatgtcaggcagattgtttgattcatcaccatgtctagctgtcacaacctcatccataaataactcatttacctctgaaacggatgaattagtaaccaactgatcatgcttgtcctccacatcagcatacagaaacaactttttatcacttttcctaacaaacaatgcatgcactacatccatattgtccttaaacggtgtttcctcacccgtggtcatgtcatatccactcatcacaacctgttggcacttgccccatgttacccttgctgcaaggtccttctccaagctctccaaagtgcattgctgatagtccacaacccattccaagcactttcgtggcacatgaacacaagttccatcaacaagtttagctgtaaattgaccaaactgaacgcacaccctaaacaccgcatcgggatcaatcctatcgaatagtaacaacaaaaacgagagaagtaaatcattagtttgcccgcttaatcgttgctgacctacacgctcttgagcttgcacctcgattctgcaataatagatagcaggggagcatgatcttaccccgaagaaagctcattatgtagcaatgaggccgtcgcctgcggcacgccctcttctcgagccgctgtctcccccctctccatctcctccttcaaaccctagatatttagggtttccattgctgggcgtggtggcatggcgcggggcgggggtgaagctgccggcgaggcgcggttgcacggtgcagagcgggggacggagctgccagcgaggtgtgggggcggggcgcggtcggggcggcggctcgtagcggcgttgcgtctgtcggccgggaggaaggaggaaggggatcgatatgtttcccttttttttgttgcgatagatcgatctgttccctaagaggaggaggctatctctctactctcctgacaggtgggcccatgggtaaatccgtccggtcaggtgagaaagatgaaggaaagtattagaaatctgagaaatttgggaaaatagagaaaaatggcatggaatgaaggaattcgtgcttccaatggcatattctgaaagtcatgcgaattaagtggcatatcctgaaaatggtgcgaattggatggcatatactgaaaaatctcgatcaaggctactcaaaagaatccaaacagaacgacgcgacgagcctcatttttcctccgtgcgtatggtgaacagtactctacgacgacagatcagaaaaatgggactacatgcgtgcacgagtgtcgttaagagcaa

SEQ ID NO: 911 - DNA, 1501 bp, Oryza sativa
tcgtcgcgtcgttctgtttggattcttttgagtagccttgatcgagatttttcagtatatgccatccaattcgcaccattttcaggatatgccacttaattcgcatgactttcagaatatgccattggaagcacgaattccttcattccatgccatttttctctattttcccaaatttctcagatttctaatactttccttcatctttctcacctgaccggacggatttacccatgggcccacctgtcaggagagtagagagatagcctcctcctcttagggaacagatcgatctatcgcaacaaaaaaaagggaaacatatcgatccccttcctccttcctcccggccgacagacgcaacgccgctacgagccgccgccccgaccgcgccccgcccccacacctcgctggcagctccgtcccccgctctgcaccgtgcaaccgcgcctcgccggcagcttcacccccgccccgcgccatgccaccacgcccagcaatggaaaccctaaatatctagggtttgaaggaggagatggagaggggggagacagcggctcgagaagagggcgtgccgcaggcgacggcctcattgctacataatgagctttcttcggggtaagatcatgctcccctgctatctattattgcagaatcgaggtgcaagctcaagagcgtgtaggtcagcaacgattaagcgggcaaactaatgatttacttctctcgtttttgttgttactattcgataggattgatcccgatgcggtgtttagggtgtgcgttcagtttggtcaatttacagctaaacttgttgatggaacttgtgttcatgtgccacgaaagtgcttggaatgggttgtggactatcagcaatgcactttggagagcttggagaaggaccttgcagcaagggtaacatggggcaagtgccaacaggttgtgatgagtggatatgacatgaccacgggtgaggaaacaccgtttaaggacaatatggatgtagtgcatgcattgtttgttaggaaaagtgataaaaagttgtttctgtatgctgatgtggaggacaagcatgatcagttggttactaattcatccgtttcagaggtaaatgagttatttatggatgaggttgtgacagctagacatggtgatgaatcaaacaatctgcctgacattgattgggatggattggaaatagctcaaattccacaagagcaagttcatcaccaagtcattgattgggatggattggagatagctccaattctagaagctgatgtaggttcttcagtgcctttgatgggggaagatgacatgtatgcattcgttggacttagagctgaggatgagagagctgaacaagctaggctacaagctgaaaaccaaagggattctgctcctaatccagctgcagatgttgcccaaggggacttaaaccttaacgaggcagagatagatgttaatgatgtggttcctggtgaagctggagttttctatgataggg

SEQ ID NO: 912 - DNA, 1501 bp, Oryza sativa
atcagctatgggaaaatgggtagaagacctattgtcggtgctttgggcattaagaacgatggtggttcgatcaactggaatgacaactttcattctagtttatggagataaggcaatgaggccaagtgaagttggagcaaattcacctcgagtcatatttcatcagcaagatgaagaagagagattacactagaaatgctagacgagataagagttgaagcattgtacaaaatgacaatgtacacagaaggaaccaaaaactactacaacaaaagggtgaaaacaaggaaaatacaagtaggtgatttggtattgaagttgttgttgggaaacttgagtcaaaatgggaaggaccatttatagtgaagaaaagaatagaaacaagcgcattcaatttgccatatcttgatggagaagaactaaagcacacatggaatgccatttcattgaagaagttatatgttttaaaaaaaacttttcgtgcttatagtatattactcagtttgtaaaatacctgccagcctgtaaagtactcctctccaatcttaatatatataaacatgtcacatcctgatttttgtttcaggatttataaattatttaataaattattattagaatttatattaaatgttcgttaatttacaagtgaagttaaatgtgggaaataaaatttcctaaatataaagcatggatggatttaatttttattaaattctccatggttaattatactctctggaattttctcggatttttcggagctcaattattaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagccgagccgcccgccccctcctctctcaggcgccgacatgtggggcccacatgtcggttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctcttccgtcctctcccgtgacccgtagagccgtcgccaccgtgcaagccgccgccgccgtcgcttct

SEQ ID NO: 913 - DNA, 257 bp, Oryza sativa
aggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgttta

SEQ ID NO: 914 - DNA, 1501 bp, Oryza sativa
agatcctgggaagaacaaaccattaataaactagaggagagtaccaatatatataccctctccaagtgaagatgcatatactctcgtgagctgcaaggcaggttggctatgccttaatgagttctgttggttttaattagcgaagatgttgtcctgcagagcattcttgaaagaactcacctttgtgagcttgactgttggtcgcagtctataaagattttgggtgaatcttctaggaagcttactaaagacctaggagtatgacttatacgctccacccgaggggtagtctacagacggtctagtaccaggtaagactttgagtgaaacttgcttgcacaagacttgcaattcaaggcgtagtccattgttcaagttgtgagtaagtgtagcttggagttctaggtggatgctcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgcctggccgggcaggcggcgcgcgtgcacgacgtacgcgtcgaatggtccgaaaaattggctcctcacccttacgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcaggcgccctgatcaagcgacccttctctatataaaccgacctgccgtcttcacgcaacacacgcgaaatcaatctagggtttgcctcctactctgtactgcgccgtcgctcgtagactactccatcccgcttgccggcgtgcaccggcgatcgggagagcaggtctctggaacctctgccttcgacgtcctgcaccgggagaaggcggcaataaggtttttgggaagcgcttcgcgcgactgctccttgttcgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcttgttatactgtgtagtttacatgtgtagatctaatggtgcgttcatgctagttttcatctgtaatgtcatgatttatttatggaatagattaaatcattatatgtctataatctcaacaatccaaaaaccttattataggtactgtgattttacta

SEQ ID NO: 915 - DNA, 1501 bp, Oryza sativa
aagctgctgaagcgttgagcatcttgtcatgctgatattcttatgagtggttcaagatggtttgttctgttttagtggaagtgaaagaaggggctgtcccctgcttatgggaagagaaaaagagatgtattttagcaaccatgtgtttacagtacaatccaattagttcactaagctattatttatggctgttatatcctgttctgagtatttatttgttatactgtaatggtattaaatttctggcattgttatacatgattatattcgatcatatacagctattagtaattcatgtagttagagctgaatgggagttttgctagaaagacattgcttctttcaacgacccttattcaaacaaaattaaagtacctttttctctgttgtgctgattcccattgttacatagctgaaacttaagtaattgcaaaatttgatggaactcatatattcttctactcttataataagggaggtttgtatgtagctacactcatgctatatgcatgcgctctgtctatctgacttttgtatttacatttgtattcaagacattgaggtcaactaaattctatgcccaatggtgcagccatatttcatacatgaatatggctatctctttgcctggtaggttatgaaatatgaactctatgtgtttattttgatgtgaaatggcctcagggcaactcattttgatgtatgagtatacatgtcaatccacacagtaggtcctgagatattttattaatgaccttttcacttttcaccatccttcacttgagaatatgctctggttgatagtagttagtttccgtgctttgacttattgccgaacccttgagagcatcttgtaatgttcaactcttatgaattgttgatgatgaccttatctcttttgatgaataggatgaatagcggcatggcaacccaagggccaaggccagagcactagggcctagagccgcaggagtggagctagagcgaaacagagggtggtgccacttgcttaatttactctactttagatcaagtttaagctgatacgggtgcttaagtttgtattgaggagggtgcatacatggtgaaaataggtaaggtatagctaaaaaaatttcttgatcgggttcctgggcacccccctaatatatactagctccgcccctgcctagaggcattcctagaaacttaggagcaaacgaagaaaggtagcagaaccagtgtagaggaggcattaggagaaatcttaaggacatttggtaactttgaaataccataatgcgtctcataaaaaatattctaattttaaaatttgtactatgtaataggtggttaaatgctgttcttctgagtgatggagttgcagattgtaaatcaatctttacttatacaaacgatgggccaatcattggcttgttctcgtctcttttttttttgggtcaaaatgaattggaatagcaggtgcctttgaagtgtaaatataacagaacaagtgggtaaa

SEQ ID NO: 916 - DNA, 1501 bp, Oryza sativa
tgccccgaacaaaataaaaagagcacgggacgggtcgacgtgtacccgaaggccgaacgtaaactgcagggttatctatgtgcgttcgcccttcgcagaagcttctctaatctctctccaccgtagcgcagaacgtaaactgaagggttattagtaccttggaatgactggatgacaagtgggcccagtacagaaggtcccattatgtcagtggcactagatcgagcactcgcgccgcgagcccgcgattggaatgccatgtgggtctttctcttgactactccatccgttgaatgtcgttttcagttttatgtcaggtttggtaggtcgtgatctttttactattttgcccattgtgcaaaattttctactacatgcaaaatccgtcgaatgtcgtcgtttcgtttgcgtccgcggggttatcactatatattcctctctctctccaggaaaccaagccttccccacaggatcgagtcgggcagccacgaatcgatcgagagatctaatggcggcggcaaagctactgctgggtgatgctcgccgcgaaccggaggcctcagctttgggcgcgctcggcgtcgccgccatctccacggccaccactttggccaccgcggcgttcgagccgccgccgggcggcttcggcaccaccacctacaaccatctcgccgtcgccgggctcgcagggaccttccttggcggggtggccctggtcggcacttcagtgtgggtctctgacaacccagctgcccgccgtggcaccggcaagaagctcctctacgccgccgtcccgccgctcctcgccgccgtcgttctatcggtggcggcgctgctctggtaagcatgtacaagcccctgtccgaccgcattactatccgccatgatcggagccaagccggccgtccctagcgtgctccttgtgtcaatcaaatgcaatcttaattattccatttgtattgttcatttgtttgttttgttggtcgatcgctccgtcatgtgttatgtctcgtggagttgtagtatcatcatgtaatagtgcttgcttcttcttcttctagtccattgtgtgtatcacatatgtatgatcacgtctcctgttcttggtctgtcaaagtgttattcgattgatggccggcttaatcgacgagtgttttgttaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctcctttttttttcttttctttttttttggaggcaactgttagaagagagggaatggtgggccatattaagtggggcccacatgccgtatcatatccatgacctttgtccttgcgttgccggcggcggc

SEQ ID NO: 917 - DNA, 1501 bp, Oryza sativa
cctctattcgtggtatgtgtcgttactgctgtgattatgatggtgatgtttaatactataatatctaatctaatgttctttgtgtatgatccatggtggtttcgtgtaatctactgttttttcatgtattcatgtccctgtgatgtttaataaattaggcgggtcgttaaagtatgcagtagtactcctggttcctgtgattgccacaacgaagggcctgtaattaatttcttttctaattcaggattctggattgtcgcgggcatggtttccaagttccaagctcctaaacaatgtgttttgtgtaaaattaattggtaaagaaacattagaaacatcacatcaaagatgcaggtcatcagcacaaatgggttgacaaagaatcatcatttagtccctatttcatttttgtataaagtactcgtatttgttcttctctttttgagaggtactcgtatttgtttagtgagaagagtattgaaaaaattgggccatttgagactcctgtgtctcgattcccttagtatctcggtttaatttgcgtctccaccacagaatcagctctaaaccaaacataccatcaccagctcacctgaaaaactataggcatagcacctatcagttatcacaaccataatggctgtcaggtttgcacacccgggcacaggtttaagttccaaggtttttaattttgaaactaaaatttctgccgcaggtgggtgatagaaccgaaatttctgagtttttttttatttttttcgtacaattttttttgaatttttgactgattttgaataaatttgaccaaattcggaaaaaaaaaagcaaaaaaccaaaattttgggcgatatgtgagcatttcggttgggggggggggggggcggggagtttcgaaccctgggtttaacaagagtagcaaaattcacagctgcaggaaaaaaatgctgaacattgcccttgctgccaagctttcagaatcagtcgcaacagcgcaatgcattcaactctagggtgttttatcagtgctttttttttttctgcacaaaagacaggaattgtagacacagtttaatcataaatgtcgtcatagaaaacactactgttataaccatgttaaactatcaaggaactacaaaagccttacaagagaatttgcctatgcctcttctaaacaactcttctgattacatgacattccagaaaattagtacacacaccagtctccacatatacaaaaatacagaccatggcaattatacgttaggttgattcctcgttataccagtgatccataattaccggaggatagaaaacaccaacttcagactactgtacgatcgctcaaatgtgcatgaattttcaccgaacgtaccaaactgcttgatcaagtcctgataccagggtttaacaacagaacctccaccatgctaccatcttatgccagcagaaatgcatttaagagaaactgagcaaatgtttaacaatgccatagcagtctgtg

SEQ ID NO: 918 - DNA, 1501 bp, Oryza sativa
tctttctcacttttttttttgttctgttcgaggagatccagtaccatgccgtatttttttgttacaacacgtcccgcgaccaggtagatgagttaggaccacttttgttgttattacagtatgtgctatgaccattttagatgagttaggaccactttatgttctaggaggtccggggtccagtaccatgccgtccatatatagcgcatttgagttgcacatctccagcaaccaactccctcccaaccgatcgatctctctcttctacttcatccaggtccaaggagcggctcaatcagtcgagagattaaatggcggcacagtatgaggtgagtgacgcattaggcgcgctcggcgtcgccgccatctccacggccaccactttggccaccgcagcgttccagccgccgccggcgccgggcggcctccgcaccaccaccacctacaaccacctcgccgtcgccgggctcgcagggaccttccttggcggggtggtcctggtcggcgcttcagtctgggtgtccgacaacccagctgcccgccgtggcaccggcaagaagctcctctacgccgccgtcccgatgctcctcgccgcggtcgttctatcggtggcggcgctgctctggtaagcctctcaaattaacgctcatgtacaagcccctgtccgaccgcattactatccgccatgatcggagccaagccggccgtccctagcgttctccttatgtcaatcaaatgtaaccttaattcttcatattgtttgttttattggtcgatcgctgcgtcgtggttgtgtctcgtggagctgtagtatcatcatgtaatagtgtttgcttcttattctagtccattgtgtgtatcacctatgtatgatcacgtctccttctgttcttggtctgtcaaagtgttattcgattgatggccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggc

SEQ ID NO: 919 - DNA, 1501 bp, Oryza sativa
cagactgctatggcattgttaaacatttgctcagtttctcttaaatgcatttctgctggcataagatggtagcatggtggaggttctgttgttaaaccctggtatcaggacttgatcaagcagtttggtacgttcggtgaaaattcatgcacatttgagcgatcgtacagtagtctgaagttggtgttttctatcctccggtaattatggatcactggtataacgaggaatcaacctaacgtataattgccatggtctgtatttttgtatatgtggagactggtgtgtgtactaattttctggaatgtcatgtaatcagaagagttgtttagaagaggcataggcaaattctcttgtaaggcttttgtagttccttgatagtttaacatggttataacagtagtgttttctatgacgacatttatgattaaactgtgtctacaattcctgtcttttgtgcagaaaaaaaaaaagcactgataaaacaccctagagttgaatgcattgcgctgttgcgactgattctgaaagcttggcagcaagggcaatgttcagcatttttttcctgcagctgtgaattttgctactcttgttaaacccagggttcgaaactccccgcccccccccccccccaaccgaaatgctcacatatcgcccaaaattttggttttttgcttttttttttccgaatttggtcaaatttattcaaaatcagtcaaaaattcaaaaaaaattgtacgaaaaaaataaaaaaaaactcagaaatttcggttctatcacccacctgcggcagaaattttagtttcaaaattaaaaaccttggaacttaaacctgtgcccgggtgtgcaaacctgacagccattatggttgtgataactgataggtgctatgcctatagtttttcaggtgagctggtgatggtatgtttggtttagagctgattctgtggtggagacgcaaattaaaccgagatactaagggaatcgagacacaggagtctcaaatggcccaattttttcaatactcttctcactaaacaaatacgagtacctctcaaaaagagaagaacaaatacgagtactttatacaaaaatgaaatagggactaaatgatgattctttgtcaacccatttgtgctgatgacctgcatctttgatgtgatgtttctaatgtttctttaccaattaattttacacaaaacacattgtttaggagcttggaacttggaaaccatgcccgcgacaatccagaatcctgaattagaaaagaaattaattacaggcccttcgttgtggcaatcacaggaaccaggagtactactgcatactttaacgacccgcctaatttattaaacatcacagggacatgaatacatgaaaaaacagtagattacacgaaaccaccatggatcatacacaaagaacattagattagatattatagtattaaacatcaccatcataatcacagcagtaacgacacataccacgaatagaggga

SEQ ID NO: 920 - DNA, 1501 bp, Oryza sativa
ccggatgtatcacaaaaaaatgcaacgcacggcaaataaaaaaatttggcacattagtttgagctcatttgttccgttagatctagcccaaataaaaggggaccacctatatatttgtcgacaaattttcttctaaaaaaatttgacagatacaattatagtacaatcatagtgtaattaaactgtaacttgtatgtaattacactgtaacttgtatgtaattacagtgtaacttgtatataagtttcacgtaattttgaatcgttagatctattaaaaaatttattctggtgacgaagaagaaaaatcacatcacacacatatgtgaaaggatttgttctcacaacctccattttaccgaaataaatgttatggagagatttttgaaagttacatacatgttacattatagttatagtgtaattacatacaagttacagtgtaattataccacgattgtattgtaattacatctgtcaaatttttgatggaaaatttgtcgacaaatatatatcaaattcgcccaactaaaacgggttgtaatgctacctaagcgccacgtgggatgaagaccagctcaacaccgccatgttagcaaaaccacacttcaaaaccactaagggagttaaattacactagtttcaatagttgggaagttgtcttatctggttttctggttgagaggtacgaattagattcgacgtacttttttaagagagttaaagtgtacttttttcctgcacgtaatacttttctggcccaactaatgttacaaattgggcctttctcaccaacgaatccgaaacagccacgccccctccgatctcgaatttttttcggttttagatttttttttaaatatttacagaaataatctatcggccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggtccgaatgcaaaaaagccagtcggggccggctattttgcaggtggccccttgccgccctctggtggggcggcaggcctcgctgcctataaaaggcctaccgcccagcccccagccctcattcctccctcctcagttccagtgaaaaaaaaaaagaagagaggggaggagaagaaaagaaggggcgaagccctgccggattcagataccgatttcatgtaatattcatagatcctatatgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 921 - DNA, 1501 bp, Oryza sativa
caacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacatgaaatcggtatctgaatccggcagggcttcgccccttcttttcttctcctcccctctcttctttttttttttcactggaactgaggagggaggaatgagggctgggggctgggcggtaggccttttataggcagcgaggcctgccgccccaccagagggcggcaaggggccacctgcaaaatagccggccccgactggcttttttgcattcggaccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttaaaaaaaaatctaaaaccgaaaaaaattcgagatcggagggggcgtggctgtttcggattcgttggtgagaaaggcccaatttgtaacattagttgggccagaaaagtattacgtgcaggaaaaaagtacactttaactctcttaaaaaagtacgtcgaatctaattcgtacctctcaaccagaaaaccagataagacaacttcccaactattgaaactagtgtaatttaactcccttagtggttttgaagtgtggttttgctaacatggcggtgttgagctggtcttcatcccacgtggcgcttaggtagcattacaacccgttttagttgggcgaatttgatatatatttgtcgacaaattttccatcaaaaatttgacagatgtaattacaatacaatcgtggtataattacactgtaacttgtatgtaattacactataactataatgtaacatgtatgtaactttcaaaaatctctccataacatttatttcggtaaaatggaggttgtgagaacaaatcctttcacatatgtgtgtgatgtgatttttcttcttcgtcaccagaataaattttttaatagatctaacgattcaaaattacgtgaaacttatatacaagttacactgtaattacatacaagttacagtgtaattacatacaagttacagtttaattacactatgattgtactataattgtatctgtcaaatttttttagaagaaaatttgtcgacaaatatataggtggtccccttttatttgggctagatctaacggaacaaatgagctcaaactaatgtgccaaatttttttatttgccgtgcgttgcatttttttgtgatacatccggtattaggtagggtgaaaacggtatggaaatagacggaaaccacctttatcgtttttgtttttatattttttttagaatcagaat

SEQ ID NO: 922 - DNA, 1501 bp, Oryza sativa
atgccgttgatgttggatgggatttagtgacgtggcattatagtggtctcttcccccaaacacctccaataaagcttttttggattgttttgaactgagttgcacaacacaacaaaacaaggttgtgttcgcttagctggggtgacagatggacggctcagatgtgaacctcaagaaaaaggaaaatttaactttttgccacttttaatatgtggcaattaattatttaccactcattatctatgatatgtagaatctcatctatctgtaacatataggtttagtggcaaatcctttatcactactcgtaaaagtgacaaataattaattattccccagaaatgagggatggcggttccttttctaatgggtcttttttatgtacaaaatgtcaccgttttgcatttggcatggatatagctgttacatattactcagttaattgctacagctaaaagaaaaaaaaccatgatattaactgaaatgaataaatagttactttagtttaattttatttgtaactatatatccatttaaatttaagtgttatgtaatattaagaatttcaatagataatatgtaaaactacaatataagtagatggggtggcagactgtcaccttcattggagtttttatttaaaaaaaataaaagtatagagtactatctccgtcttaaaatagttatctttctagaatttgaaatttgtcccaaaatacttgtcactctaatatactacttgtactccctccttacttgtaaagaaagtcgtttaggacaatgtttaagttaagccttgggaatataaatcatgaataactctcaagttgttgagtttgaaaatataaaaattatataaatagatttgtcttgaaaaatgctttcataaaagtatacatatatcagttttcaataaatgtttttatagaaacaagaagtcaaagttgtgttttggagattgtgtcgctgtccaaaacgacttccttcctttacgagtacagagggagtaccatttatcacctttcattcaattttttcctattatactctcaactactgctcctcccaacaatgtaacaattaattactccttaaaatgtgtgaatgcaccacatttagtactcaccttgaattagaacatgcagggaatcatgtataacgacatcaccctgatttaaatatagtggaattaatcataggaccatggagcatattttgtagcattgacacaaaatcatctatcaatgcatttttgtttgtttgtgtgagggtttcactgatttttaaatgaaggaagcaccaaacacaagcacatggtaaatgtacacaactagggatgaaaacggatcggaaactagctttaatatattcattttcatatttttttatttccggaatcgtaatcggaatcaaaaacccggatatggaaattaaattgaatattatcaaatacaaatacggagcgatacgaaacgaaacaaatacggtaacgaatatttgc

SEQ ID NO: 923 - DNA, 1501 bp, Oryza sativa
ataccggatgtatcacaaaaaaatgcaacgcacggcaaataaaaaaatttggcacattagtttgagctcatttgttccgttagatctagcccaaataaaaggggaccacctatatatttgtcgacaaattttcttctaaaaaaatttgacagatacaattatagtacaatcatagtgtaattaaactgtaacttgtatgtaattacactgtaacttgtatgtaattacagtgtaacttgtatataagtttcacgtaattttgaatcgttagatctattaaaaaatttattctggtgacgaagaagaaaaatcacatcacacacatatgtgaaaggatttgttctcacaacctccattttaccgaaataaatgttatggagagatttttgaaagttacatacatgttacattatagttatagtgtaattacatacaagttacagtgtaattataccacgattgtattgtaattacatctgtcaaatttttgatggaaaatttgtcgacaaatatatatcaaattcgcccaactaaaacgggttgtaatgctacctaagcgccacgtgggatgaagaccagctcaacaccgccatgttagcaaaaccacacttcaaaaccactaagggagttaaattacactagtttcaatagttgggaagttgtcttatctggttttctggttgagaggtacgaattagattcgacgtacttttttaagagagttaaagtgtacttttttcctgcacgtaatacttttctggcccaactaatgttacaaattgggcctttctcaccaacgaatccgaaacagccacgccccctccgatctcgaatttttttcggttttagatttttttttaaatatttacagaaataatctatcggccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggtccgaatgcaaaaaagccagtcggggccggctattttgcaggtggccccttgccgccctctggccgggcggcaggcctcgctgcctataaaaggcctaccgcccagcccccagccctcattcctccctcctcagttccagtgaaaaaaaaaaagaagagaggggaggagaagaaaagaaggggcgaagccctgccggattcagataccgatttcatgtaatattcatagatcctatatgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacag

SEQ ID NO: 924 - DNA, 1501 bp, Oryza sativa
ccgtgtcatattgttagaatcggctgtatcggctaaccctgttcgactcgaactctgccaatcctgtctgtagccgatttggatcgtagccgattcttgctctgtttccgcaacgatcttcgtcttggattctgctttgatctaatcttcttttccaacactgatattaccaaatttggtcgttaacacatgccccccaagtccgaaatatttggtaatgtttcggatttgccatatgtcgactccgagtgaaaatcgcacttgccgttttccgaccgttactccagcgctttaaatgctaaccgtcaccttcgagaaacttcacgctgtttcctccgttttcactgctgaagcaaacctagttttctctctctccggcgatcccctcggtgcgctcggcgatttcaaggtgatctcctccccggccaagcttccgctcacgatgatgtcgacctctgccggcttgtccgctgcgccatcaaccagcccgtctgttgcgccgtcatccaagtacgcagaggtatgtatccatcggctagatccctttttcccgtgcagtagatcgattttcttcatctcatcttattttcttcttctctatctcttttgcacttgtagcatcttaccaatcttgttgcggttcccagtttgtcgcacgaccatcagtactttctcggcccaattggcaaccttgacccctctgaatttatcattgttgagaccaacagaatcccctttagactggccaacccaaacttaagtcactggaaaaacacctttaaatcatggccatctattgagaaaagtacccccgagaaaagctggcctttgtggttcgaatgggtatcggctagcaaacaagcccactgggatgaaatcggaatcagccaagcgctagcccttactacagcaaatttggctaaggatgagcctctgatggccgctgcaatctacttttggtccaacacccttaatgccttcttgttcaaccaagggccgatgacccctactttgttagatatcatcatgattactggtctggatgtgacctcatcggctaatcccatgagcttgaataccaaaagcacctttgaattcaagaccaaaagcattagggttggtcggggtatattgtagcatacatgggcaaagggccagtcacctctcgagagcatgtagcttttctactgatgtggttggagaaatttctttactgtggatcaagttgtggccctgcaactgtggagattatggataccccatacccacactgcatggttatccgactggttataggggataacttatatctatggaatatataacggatcatgacttgggtattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcata

SEQ ID NO: 925 - DNA, 547 bp, Oryza sativa
ttcgtctcgcggtttctaggtaagttatgaaattagttttgtcattggtgtctgaaaaccctttccgatatccggtcaaacatctgatgtgacaaccaaaaattttcttttcgtgaactaagagcgagtacaataacatgctaagagcgagtacaataacatgctataagtcagctgtaagcacatgtggagtagagaaaagaagagagagaggaaagcgggctacagatttatagcaggcggcagaatggactcctaagtcaactgtaagcacatgtggaggagagaagagaagagagagacgaaaacgggctacatatttgtagcagactgcagaacggactccaatacgttgagtgtgtatgagaggtgggactatatattgatgatataatatatatttatagttaactattatataaataagatatgattagctatagataaattgaagctaataattacctatactattaaactttctccaaacaggtccgaatatatgataagtacggtggtcgcgcatggggccggtcaaacggtcacg

SEQ ID NO: 926 - DNA, 1501 bp, Oryza sativa
aattgtttgaatatgaattcctcactagatttgcctttatgattcctactctaaggtttgatatgtggagcttggtagggatcaaacatggcatacttgtattctcatttattactaagtcaaaaaacttggactaaaatagatgactaatcatactcaagatcaagatcgtgcaaagtgtgtgtgaataatatggtggaaaatatgatggaaaacaaaatgtggataaagaaaatgcttctcatttgtgcttatgcttttcctccaaaatatcctttaattttcatagagagggtatggctagtttttctcttttttttttctttttttttctttcatgctccaattttgggagagcaagaatttattatttttctcatagccatacctttccctatttttttcctttaatttttgcaaaggatttttctttggaaagaaagcatggatggagagcttatttgtggataatgatgacatggatatggtggatgatatgaatgctatcttccaatgtagaagcttagcatatgtgtgcatatgtgggtgtatgatcttgatcataaagcatgaaaagtatctacacaagtcacaaggatttgacaaagttcaatggaattacaagtaaccataatgtatatggcttaatcaatatatatatttttggctctagtaggaattcatatcaaatgaggaacttccaaatttatcattttgaaaaataaaacatccggaattcaagtcaaatttagaacagggtcgtagcatgtcacgtcctgataaattcatcccgaaataaaaatcattctctaaaaggaataatagaattaattaaaattcaaaaagaaattggttaacactaaaatacgtacaagaaaaattcgaatgtggcccggagaatttttgttaaattctccttggtctaaaatgagccctcaaattttacttgaattttcaaagcaccggaaatatttattaagcaacaaaaacaattatcaaagtttattaaaaagaaaaacctaaaaataatcctccttcctcctttgggccaagtctggcccaaagtcctctctctttctctctctcggcccgcggccaaagtcctctcttcctccctctctttttccttccctctctctctcttgggccgccctccctccttcccctcggcccagctccctcctcctccctttttcccccgggccgcctttccctcctctcctcctaggctggccgcccggcccaagccgcgcccccctgcccgagccgcccctccctttcgcgtgcacgcgcccgtcacgcgcgctgaccacgtgcctgaccggtgggtcacacccccaggtcgtctttctccttccgcacggcctcctttccctttcccggaaacctagcgccattgctcccccaaatccacgcgattcaaaacaggaattccaaaattgattagagggaattaatcccctttccttcctcttcaattccccccaatttcccccttgat

SEQ ID NO: 927 - DNA, 1501 bp, Oryza sativa
gaatttgtgggactgtttttttattcgatgaactaaaaaaagttatggatcttaggattgtttttcttttttttattcttcgtatgttgtcactaaataaaaaaatttcagcttttttctattgtgaaatatattgtcaatatgttcttgctttttttttcgtactatggtctaagaaactggagttaaaatgaaagagaactcggtctttgactaattctacaattttttaatgggacatcttttctacatcttaaattccatcgttttcataaaattttctttcgtgcagctttttttttcttgcttgccatagctattaaaatctttagttccttttttttaatctttatccagacatagcttgcctagatgcaaaagttgtgtgttttgctatgcccgcctaaaataacatttattttgccatgtcatcaaacatttttctttctgccaatcctgcatgtccatgaaaacatttcttaataggcttccttaccctactttttactggagtactagtactcaagactgcaattttttcttcaccttttcgtttacctttataaggctttttttctcccctgatgctatgattttatcctgcaaattgacccttcttttggttttataaaaaagactaggatagctccgtctttctttgcttatatcgttatttcagcctcttctgttagatatatttcccccctatttcgagtgttcaactaatgcggcttgtcgttcgttgcttggagaaattgtgataaaatatactattttcataatgaaaccgataattgtcgttgactcgtaatgtagttattttggttcttgtgataattttctacatctctctttttcccttgcaaacttagtacctatgggaatgggaatatatgctagaagcaatgagtgaggtgctggaattatataatatgtgccaagagcaggagattccaaagactagttgctgatacttttgtagtgggatttcgattttttatgcttcggttggcaaatgggggcggagtccacagattaatgagtccgttgaaacctaaagtagatggcggtaatatgtcctaattaggaaatatatctacattatcctttagattatattattgatagctgatgcaagacgacgctgagtggaacatacttgttgctacctgttttgaacatttctcttggtttgaatgaaaactgaaaaggatggctacctagggtcctaggtcatagcaactgaaacagtaaaaaatataaaatctatgttctcatgtaggtggatgcccataaatgtatgaatattcatttatgaatactctacggttttccaatagtatgtgggaatatttttttatgtgctggtactaatgttttctaataactgtttgttgatactgtacaggtttatgtaaatctgatcgatccagaaagtttgtgaaaaaagagtgtggcacatacctaaagctggcttaaagtttgcccatagctaatatca

SEQ ID NO: 928 - DNA, 1501 bp, Oryza sativa
actcttagatgaacctttaatgccatcagcttcctatttctagtcagataccttgaatgcttcttttgaaccatgggtcgatgactccaacattacttgatatctctatgctgaccggcctagatacaacctctttcatcaacatcgtaagtttgagaacaaagtgcaactataagttggacaccaaaggtggaggtggttggtcagggtatatcaccagacattccaaccaaggttgtcagtatcccgattcgtattctagtatcttacgatactacgatcctaccaagcagaaacgataccgatcccacctctcgatcctactattcattactacacgatcctatgaaatcttaggtggtatctcgattctacgatccctacgatattacaaaatattatttaaaataagatggtttggaaataatgtaaacgaatatgctcaagtatatatagaaatcagttaaatatatcaaaaccaatgtgatttctcatgataaatgtctatatttgcataatatatattattactatatatttttatatagaatggctatatataattaatataaatattaattaaacttttcaaaaaagaaaatctcatagtatcccgatactatgatacgatcctacgatacaatactactttgagcaaaacgatactacctaatatccgatcctaacaacttgattccaacactagggctgttattgagaaggagcatgtagccttcttgaatctttggctggacagatttgttttctgtggaactaagttgtggaccaacagctaatatgccgttgctttagggcccgtttagttccccaaaatttttttcccaaaaacatcacatcgaatctttgaacacatacataaagcattaaatatagataaaaagaaaaactaattgcacagttatgaaggaaatcgcgagacaatcttttaaacctaattaaccataagtgctacaataacccacatgtgctaatgacggcttaattagtctcaaaagattcgtctcgcggttttaaggccagttcaagaattaattttttcattcgtgtccgaaaaccccttccaacatccggtcaaacgttcgatgtgaaatccaaaaattttcttttccccaactaaacacacccttggtaaactagaggatggggcgccgttgcgcgcgccgcctgtatgaaataccggcacactataccacaccttgctgatccaatgtgtataactgataattgaccgtacgcaacaaggttaccgaatccagtggatttctgagattttattactaaactgtttggtccaactgccctgccaacatcctcgcatgcttccgatatacgtacataaaattcaacgaaatagtttcagcataacaaacacatgtacagtctagcagtgaaatagactaagactgtttagttcagcgcaaagttttgattttggttaaaattggagatgatgtgactgaaaagttatatgtatgatagg

SEQ ID NO: 929 - DNA, 1501 bp, Oryza sativa
aatgtggtgtcatacaggaatttccaaacagggacttaaagctgattagcagaaacatggaagcggaataatagatattcttttagttcaataagtccaggactgcaggaaatacataaaagctagaatgacccaatcctgttaaaatctctaatctaacgtagccaacagtccctctttacttggattttagaacaagttgaaacttatctggagattacagtttaacctcatcagaaaggagcaggcacaattactaagtaatcagctggacagcgttcatgcaacaaagataataaatcctttgtataaaccttatatccgctccatttgtaatgcataaatcagcttaccaaataacatgttctgaaaggtgaaacaacacaaaatctactaatatcattttcagcccgatctaggtatatcagtgcaaagctaggccaatctggctgtgaacatacttacgtaccacagcaatatgcatctgcaaactcattagaattatttctgaagcctcaatcaggctgaatgattattccaaacagggaacaagtctattaacatgctcgagttcatcagtttatttatgaaaacttgataatgcagctaggattctaatgccatccaactatagacttgcagcgttgcacccgttgagcatgctataatcctattgctggaaaaacaaagtatcatttacactatttatgcaggctttctccggcattttctaatgcaatctggttcctcaatgctgcaagagaacatatgtaccaaaacatctactcgcacaaacatttctgtggagaaaaataatatagtacaaggtccatcaaagaaatcacctcccattcctcctggttctggatgccctcatacgcaactatgaatggcttcaccttctgtagcatatcctccaatgacataggtggcttctcttcgatatctggattattgaaattcacatgatactctggctcaaactcgatctgcatacataaacccacaggaaacaaataattcaggaaccttgcatgaacggccagatctaacaactctaacaattttgcggattcaaccgcattgctgcacagaccatgttattggtgtgacaagcctccagatatgcatcctgcttcgggtctggcagcgcgttatctgcggcctcatcaaacgcttcgttaaaaatcttcatcttgtcctcgccgagccgcttctggagtctgtcgccatcggcattgtcccccaagtagatcccatgcttctcctccatatcagcagagcggcggccgcggccgccatcacgtcccctgccgcgcccgcgctccctaccacgggcaccacgacccctgccgccacgcccgccatcgtcgtcgccgccaccgcccaggagctccatggcgcgcttcacggcgtcctcgggcgacagcttcggctgcccgctgggagcgggacgcgccgccgacgcggccttcttcttctcctcgcggcgtcggatgaa

SEQ ID NO: 930 - DNA, 1501 bp, Oryza sativa
tgaaattaagtgtcaatgttctataggtcatggtcatgtgagataacgtatacgatacatcatttatggtcgttgatttttctaccgtaagtacgaaaatgagtgaccaacattgattccatatataatgataaattatcagcaagagagtgatgaacaagtcaaactacaactgtagaagattaattaattaacgactaacggtgttcatcttctagaaaggctagagggtagaggcgcagcacaaaagcaccaatatcttattgccaggtgtcacatgcatgaccaaaaatgttccgtatattgagttcgtcataagggccagattagtctaaggtgaactttgagtacctttcatatttttgttgtgctgactaaaatcacatgtgcagatttgtttgaaatgatacttccgtatcactatttctgccatagtttgtaacacataatcttgctttgtcagagtacagactgtccttctatctcgttttctccataatacagggactatatgtgctattatggtaggtatagtctgttccaaaatataactatttctagcacttaaaatttgttttaaaatacaataacttctccaccaacattctcttctcaaccaataacaactcttccaccattcacttttttcacctaacttaacttcttaatcaatcacaatatctctctatttaattctacctaatttcttaacaatcgtgtcaaactctaaaacctcttttattctaagaggaggtattaacatattatcataaaactttttagcaactacgtaaatatgagtatagtagctacgaaaaatctcaaagattttttttaaaaaaaacccattagtactaaacatgggaagaaaagtgcttgaaaaggaacaaaatagatctaactgatagctgtgaaaaaatctctaaaaaaaagaaaaacaaactatatattagtattaggccttttattttctgattaagttgctctacaatatcaaatcaactcatcttctaaatttataataatcaaaactcaataatcatatgttattattttttttcgtttttgcgtatactttcttaatcctcatatttatcagttgcaaacagggcctaaacctttataagaaaagtccttaaaaaagaaaagaaaaaaatattctagaacaaagacagtgaaaataaaacctgttttgaccatatgaaaaaaaaattaatcccaactcccaattcccaagccaaccaccacagcaaagcctcccttcctttcctctcttcgtcttcctcctccctcccctctctccacaggtcaaatcctccccttccttgcttgcaatcctagcaagctccaagatcgcggcaagctagcctcgagggaggcccgcctgcccgggcctcgggctccgggggcccggttcttgaggtttcttggtcgtggggtcgaggaggtggtgggtggtggtggctgcggcttggcgcgatgaacaaccacgcggcgggcg

SEQ ID NO: 931 - DNA, 1501 bp, Oryza sativa
aatttttcgaatattaacattgggacaaaaaaaattaataaaactttgtctcgaggctataaattaatgagttatatagctttcacataaaacccatgggtattaaactttggataaaaagcatgaaatttttccagtccaaaatttcactagtaatagcatcaacgttacgcatgaatttttttattattaacatcaagaagaaaaatttcatgaaatttagcatccatgctataaattcatgagttataggcttctcgcaaaacccgcgagtattaacctttgaaaaaaaacaagtttttttccctcttgcccaaaattttgctaatattagcaccaggatcgttctatgtaaaatttatgcatattaaaattatgacagaaaatttcattaatttttgccctaaggttataaattcgtgagttatagcctttagccaaaacccatgactccgtgagtgttaatctttagaaaaaaaatacatgatttttttcgctgacccaaaatttcgctagtattatcatatgtatagtcgtgtgtgaaatttgtgattattaacattaggagaaaaaatgatgtaatttagctttcacactataaattcatgagttatagccttgtggcaaaatttgtgagtattaaccttttggaataaacacatgaattttttttcctcggtccaaaatttcactagtactagcacaaggaacatatggatgacaattttgatgaaatttagcccctcgcactataaattcgtgagttgtaggcttctcgagtattaaccttaggaaaaatgcacaatttttttcctccggcccaaaattttgctattattagcatcaagaatgttgcgttgaaatttgtgattattaacattaggacaaaaaattcatgaaatttagcctacatgctataaatttgagagttagccttctagtaaaacctataagtattaacctttaaaaaaaagtataaaatattttctttgatccaaaattttgctagcttagctccaagaccgtggagtgtggaatttgtggatatcaaaatcatgacaaaatttcatgaaatttagctccacgcacttttaacattttgggcctcagtaggccctttcaatcttttgggtcttaatgaacccttttaacaatttcagccttgactggactgctttgtttttttgctttgatagaccatccgtgcttaacctttttagggtttgatgggcctatcgttttattttggggaaaatccaaataccccctacaaatcttttattttcactctcccctctacaactcgattaggtaaaaaaaaaatcgcccacaactcaaattctcttctaacttcccccttctgtctaatttccactaatttctccaatcgttcatcaacatgttggtatgataccatagcggaaggatgcagttaggggtgaaaacggagtggatttggacggatagtgctcataccatatcttaaaccatatttttaagc

SEQ ID NO: 932 - DNA, 744 bp, Oryza sativa
cgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacga

SEQ ID NO: 933 - DNA, 1501 bp, Oryza sativa
cttcttgcccatatgtaactagaaattgctatttatataagtaaataatacatccagattaatccaaaaaaaataaaaacaaaccaaactaaaagttccgctttctttttactgaagttacaatttgcaagtttagttgactaaaaaaatcgaccctgataaatagagctgaatttctttttcttcagcaaaattcctaaaagaaaattcagcaaaatcaagagcagccttggtcggttggccacacaaaccgctttctttcttctgttttttttttcttctccgaggtggactctgcagcgcacgtaggtacacagacacaaggctgccgcatgtatgcgtcatgtggcagccagagggagaggaacaaggcaccaaaccaaccatggaatggaagcaaaacactcctaacaatttggcgccctctctgtctctctctctctctctccccccttctttttgtgagaagcctcctcccacgttttcccgtctccttaactgcttctctccttcctctcctacacaactgtggtggttgcagcaagaaagagagagagggtctgaaggcagcaagaattcagtagcattccagctgccgtgggagagagggcaagagagcaggagaaagaattccagcggcggcggcggcggcggcggtcgtcggagaggtggagagatggatgtggagggtggtggtggtggtggtggtggcgcgccgcccagggggaggaattcttgggtaatcaattaagctttggttcttggtttggttctttggtctttcagttttgtgtttgatttggttggtttggtgcattttgtttgcaagtaattttgcagtgttactgcggattctgggatgagttactttgggtgcgggcgctatctcaagttcctcagggttaaattttgtagattttctgcattttgttctgaaaaaaactgaactttttcgaagtctatggcgctacaatttcgcttgaatctacttctgtctgactaggtgtttctgtgtatgcatgagacagagaatgctctgaagctaaggttgtagcggcgcacttcttttcagttctgaatttaggtggtaaagttggttgttttcagttaattaattttgcatcagtccagctcattagttgcagtcttgcagagtgatatgttatgctttctgaatctgataaggggaatccatgagttcaggaatcaatagattccatagacgagatggtatcacgaaatctttgtaatgcactgtaattttcctctttggtaaacgggtccattttcttacatatacacgatttttaaacgtagccatcaggtcacttttgatggtcagattggacatttcctttcaacttagtactagttactactacttcagagtttgagattttttctgtttactttgaatactatcttgttgcctatttcaagttactctttctagatcatcaattttggccagcagtaaaattcaaagtagtcaagtcgatac

SEQ ID NO: 934 - DNA, 1501 bp, Oryza sativa
ggggagaacattcaagtcccgaccaccggcccgattcatggcgacaaggccgcggtactggcaggagagtggctctctcgctggaggaattcaaggcaagaaccaggggtcgcagctttgtgtgcctcgctcgcgaccaccgtgcctcggtgtgccaagacccgcctcgttgcttcgtgtgcaaccgctctagccatagagcgcgctactgcaattttcgccccccggtctgcccctcccccaaaccaactcgcccaccgcccagcaagaacagagcccggtcgcccttgcctcctctcctccgccatcctcctccaaccacacttcgccgccgatgctctccaccaacaccccgtgattccaccccttcttcgcctccgctgcctctgcttcaccggcgtcaagtaccagagatccttctgccgccgccgccttcgggcatcatggcgcagctgggtgaccccgagacaaggcctttagaagacatcgtcttcatcccgacgtcccacgccatcgacgcggagctgcgggaataggagagcacggcggccatcacctgggcgatgcgcgccccgccgtctgtcaccgccaaggatgtggagcgtgtcctcgctgatgagttcggcctgcgttctggggagattgcgatgtcactgcatttccgggaggccttcctcctcaagttcaaacatcaccggcactgtgaagaagctgtgaagaaaggttttgctaagggccaagggatagaagtccatttcatccaatggcgaagcctgaagaacgccgctggttctgccctcatgtacagagtgaagctctgtctcgatggcgtgccaatgcacctgtgggcgccggacatcgccgagcgcatcatcagcaggacctgcactctggagtcagtggagacggacctcgtccaccctgtggacgctggcgacacgagggtgatctccctatgggcttggatgccaaacccgagccgcatcgacaagcgcgtgtgggtgacaatcacgcgtcaaacccgtgaccccctacttgagtcagtcaccatctcggagacgccaccggagcactggcagcaaggcgtcaagcacccggtgttgttccatattgaagagattcacgactacacggcggcggcggtggacctccgcaatccgaagtcatgcaggctagcgacacgtacgctccctccgtggcatctgggcgttcttgatggacaacgggctccgccgtgcctcttcgagaacttccctcaccaccccccaacgccgacgacctatgctttccgccaggggcgggcggagggcgtagaggacaatgccggtctcgcgagggagccacacgaccaaggaagcaggacggcaagggaagctgccgccagggatggcggatggcgtcagcacgacggggatcgtgataggcgtcgagaggaccatgatggacgccgtgatgaccgggatgtgcggcgcaacgctgacagacgccgggaacgcagggg

SEQ ID NO: 935 - DNA, 1501 bp, Oryza sativa
cccctggttcttgccttgaattcctccagcgagagagccactctcctgccagtaccgcggccttgtcgccatgaatcgggccggtggtcgggacttgaatgttctccccctctccgcctgcgacaggatctcaccactgtccatcccggctcagggggtgtgaatgctctgtgcagtgtcgtatacctaggaggggagctccttctttcttccatctcataggcgcggcggtaggcatcgcgtcgaggcgacggcatagtaaatgtagacttcaattttgcccgcggcggtggttgggcgggaggcgagcttgcgttgactctggcgggggagaggacgacctcagcaaacgagcgtgggcgagttggagttgcaaaggcaagggtgacgctggtcggtgaccaggtggagcgagctggagtcgcggagacgtgggtgacactatccggcgaccatggagggcggcgggggtggtggcgtggcctgccagaacttactaggggagggggagcccatgctgcggctcaggggaggggcggactgcggccaagagacggcggaaatgggcgcccaaacctgcgaccggcggagaagcgtgggcaccgtcggttggagcaccggcggcggcggtggtgaagcgcgctgcggcatttcaaaaaaatatgtgaagtggtggtaattcttcatagggcctaactagattatcctagctactagtgcgtattaggagctagaattaattcgtgcctagctgggttcactgtattttgacacatgggtgtttcttgcaaatttgatgcacccccgctgattcgtccacatttgtacctggagaggcgttgtgtggggcccacatcctagaacgcagacgggtccgtgatgtgtggggtgacacgtatataactcgagtcagtcaagctattgactctttctgattttgttttccttcttctttttcatgttattattgctgtgaactactactagtgagcatgaggtttcaacttcctacttctagtatttactactactaggggtgtattatgtttacatgtataagactagttctagtttgaccgtatgatagtacttccttcgtttctaaatattaaataccgttgactttttagcacatgtttgactgttcgtcttattcaaaaattttttgtgaaatatgtaaaactatatgtatacataaaagtatatttaacaataaatcaaatgataggaaaataattaataattatttattttttaataagacgttaaacatgttcaaaaagtcaacagcgtcagatatatgcaccagcggtccttaaacttgtcaggagatttcacttaggtacacgaacttgcaaaacgcacatcgagctctctaaacttggtttattgtatcatcctggtccaaagccgcatttgaccgtggtcttacctatgtggcacgccacatggacgatgacatggattttttttattttttcttccttcttttttctctttc

SEQ ID NO: 936 - DNA, 1501 bp, Oryza sativa
ggagcaataactccttccaaatattctcgaacacaagggaaaagaaatacgaagttttaaatgtccatggtcatacgaagttcttgaagaacctacaacagaatgcatgagtcgctcacaaaatgtgtagtagatgcttcacaagaaaagcacgtgacttctctttttggtttttttccttccaaaatttactgatatggatcctttgcaaaactacacctgtactgtactaacagtgtctgatagatatacccgatcctaactgtaaatgattatcggagtcaatcctcaataaaaatattttcacacgtttttcaaatgtaaagagagaacaaactaaggactccatagttttgtgaaataacatatttacaaatagaaaatagtttgtaaataaaatttttatatacatgttattaacaatctaaaaatctaaaagattaaaagtttaagctgaaaaataaactaggatggaaattaaaaaaaattctaaaatcaactttaaatttaaatttaagattaaaaattttaattgtagcttatgtttataagtataagtataagttaaaagatgaggcgataaaacaaaagaggcacagaaagaaaaaaaacctacaagtaataataaagccataaacaactccgcccgaggccgagataccgggagacgcatcacggaaccacgccgccgacgacgacccccgccgccgcacaactccgctcgccgtctcctccgcccccgcctccattccgccgccttccttagaggaagccaagtttccagcgccgccgcacctgcatggcgtcgctcgccgtccccctccgcgcttccgccaccccggccatcgccggcaccggcagcggcggcggatcacgcgccgccgaccccgtcaaggtccccattcgccatcccgatctctctccctctctgattttttttggtctcttcggtgagaacctgttcctgtttcgtgtgactgacagctgccaactcatgcgcatgaaactgttgttcgtatggcgatgtttttgtttctatgtgtaggagtaatggagtattgtagtgaacactcagctgtttcccactttaattgcttgtatttcgcttgattttccgagttcagttgagattcgttcgcgtttgtttagccatgatttcgcagattgaaacttgctaaatttccaccaaattgatcgatgttgctgctgtgttgcaggtgtcgtgcgttaggagcaaggttacctgcggttttccttccgttggggcttcgtcttcactgtgagtgcctccatcatccagattattcgaattccttgaataacaaaatttgacaaccgagagcacagctgttggttagagcggaaaatttctgagagcaaaacggacttgacccctcgttttctcaacttgtgtttttgtggtttttgctctgtgcatatcatggatacggttgatcagtattagctgtagcacattgcattttcaataaactgcttttct

SEQ ID NO: 937 - DNA, 1501 bp, Oryza sativa
caaggaaagcgatcccaatttcccaaatccactaccaatcatgaagaacactacccatttgatcgggatgttaatcgaacagtacccccaaacatttatctggaatgctgagtgaaatatcaactgcaacaaataaatgcaatgctaaatttctgaatcatcgcacacaccaccaatcaccacaaagaactgaaaactcagctaaggcatgcagatatatagaaatcaagattagagatcagcacacacacacacactctctctctctttcttgtttcttttaaagcagatttttcattggcatttcgtcataaacaaattaacaagaaacagagatagaagctagggccgggcggcggcggcgcacatgaccggcgggctgcagaagtcgaagagcttgcccttgtcggagaagacgacgacgccgacctgcgcatcgcacagcacggcgagctcgttcgccttcttgagaaacccagccctgcgcttgctgaacgtcacctgccgcctcgtcgcgtcctcgatcctcttcatctcgatcttcccttgccccatcgcgacctcgcctcgccgcctgtccatcgaaaaaaccaaaaaaccccaatcaaatcgcttgaattaaacgggatccagccacactgaaaagatttctgcacttgcctcgatgaacaagggcagtcaaagaagtgctagctccaatccaagacggacaaacagaagaaggagaaggagtgagcagagaggagaatcaaatggtgttcttctcttgatttccttctctgtttttttctctctcttttttttctttaccttggcttgtgagacactggaacggcttccttcgagctgaaggagaggagcaaagcaacgaagcgtatttataggccgcgatctccacggcactagcactgtgaattcaccgatggctgtaactttcgttcactgaacttctcgttcggagcgcctgagttttacagtctaccgttcgttcagcacttcagctttcgttcgttcgttaactttcgttcgggcgcctgagtatttacagtacagttcgtccgttcgttcgttcgttcgcgcgcgtgaaaatgccaggaagtttcaggttcgatcgggaacgaacgtcgctctccgcggatagaagttcgtggcagccgcaggcagcattgcagcaggagagcaaaagcaacgaaacgaggctaatcggcaaaagcagctagcaacgtcatggggcacaagaaaaattcagagagagcacctcaacgcaaacgttggttggagttggatcagtttgtcaccatcgggctggtctctaacccaaaagcagcatatgggactatggtcgtgtttagttatttggccaaaaaaattttaaagtatacggacacacatttaaacatagattaataacaaaacaaattactaatttcgcttgtaaacacacccttagattcaggggtgtaaagttttgcgtatcacatcgaatatacgtacacacatt

SEQ ID NO: 938 - DNA, 1501 bp, Oryza sativa
gatctatccttttggagataaatttttagtgcacgtaaaacgagaaacctcattaccatatgattaattaaatattaataattataaacttaaaaatagattttatctgaattttttaaacaacttctatatagaaaattttgcaaaaaaaaacacatcattgactgtttgaaaaacatgctaacggaaaaaagttgaagtttggagttgaggcaaagaacttagcctaagtgtgcagtgtcttgttcacttggttgtgtgcactatcatgatacagagggcctgtttagatcccctggtaaaattttataccatgtcacatcgaatgtttggacacatgaagtattaaatataaacgaaaaaataactaattacacaaattgcgtgaaaattgcgagacgaatcttttaagcctaattgcgccatgatttgacaatgtggtgctgcagtaaacatttgctaatgacggattaattaggcttaataaattcgtctcgcggtttacaggcggattctgtaatttgttttgttattagactacgtttaatacttcaaatgtgtgtacgtatattcgatgtgatacgcaaaactttacacccctgaatctaagggtgtgtttacaagcgaaattagtaatttgttttgttattaatctatgtttaaatgtgtgtccgtatactttaaaatttttttggccaaataactaaacacgaccatagtcccatatgctgcttttgggttagagaccagcccgatggtgacaaactgatccaactccaaccaacgtttgcgttgaggtgctctctctgaatttttcttgtgccccatgacgttgctagctgcttttgccgattagcctcgtttcgttgcttttgctctcctgctgcaatgctgcctgcggctgccacgaacttctatccgcggagagcgacgttcgttcccgatcgaacctgaaacttcctggcattttcacgcgcgcgaacgaacgaacgaacggacgaactgtactgtaaatactcaggcgcccgaacgaaagttaacgaacgaacgaaagctgaagtgctgaacgaacggtagactgtaaaactcaggcgctccgaacgagaagttcagtgaacgaaagttacagccatcggtgaattcacagtgctagtgccgtggagatcgcggcctataaatacgcttcgttgctttgctcctctccttcagctcgaaggaagccgttccagtgtctcacaagccaaggtaaagaaaaaaaagagagagaaaaaaacagagaaggaaatcaagagaagaacaccatttgattctcctctctgctcactccttctccttcttctgtttgtccgtcttggattggagctagcacttctttgactgcccttgttcatcgaggcaagtgcagaaatcttttcagtgtggctggatcccgtttaattcaagcgatttgattggggttttttggttttttcgatggacaggcggcgaggcgaggtcgcga

SEQ ID NO: 939 - DNA, 1501 bp, Oryza sativa
gccgtcgagctgcgggagcggcatcacggttgtggtgggtttcttcagcggcaaaggagcttgtcggcaacagccttgctgccttgtcataggccatgcagagactgcaggggatggagctggggatgcaacgtgtgcgaatgagcattaatggaatcaccgtggtgctagatggagacttgtcctcaccgccgggcaactgcttcaccaagacgtacgagatgccccataacatggcggccggtgtcgaccgcagagcgcagcaagccgtgtggcgatgtgccggggccatggtggtggtcgagcttcccgtggcatggagcccaaccgcgccggccgccgacgggcgcgcggccgagcttgtcgacggtaggggcagcgggggcgttgtccttgagtgcatccggcggtagagagatggccccgtgctgcagagggccagccgccgctcatctcggcagactcgccgacagctgaaagttgacatggcgctggcgagggcgagcggcacggccgggactcggccggcgagtgcgagcggcgcgggcggcgtgggcgagcggcgcggtctcctccccacccgatgcacgccatgccaagagagaagagagagagaggaggaggaggaggaggaagggagagaagagggaaagagaaagctgacgtggacagtatgacatgtgggggctcacacgggtcccacgctgactcagccgccatgtcggataaaaccagggtcaaaaccaccgaaggacctagagtaaacggtttctgattttgctatatatttgtcgataaatttttccccaaaaatttgacagatgtaattacagtacaatcgtagtgtaattatactgtaacttgcatgtaattacactgtaactatggtgtaacttatatctaactttcaaaaatctgtctgtaacatgttatttcggtaaaatggaggtcgtgggaacaattttttttcacatatgtgtgctatgatttgttttcttcctcaccaaaacaaatcttgtaatagatctaacgattcaaaattatgtgaaacttacatataagttacactgtaattacatgtaagttacagtgtaattacatataagttacagtgtaattacactacgattgtactataattacatctgtcaaatttttggagaaaaacttgtcaacaaatgtataggtagtcccacggttttgtaagttgagggatgtcacatatttggttttgtggttgggggacgattttgtatctcgatgacaagttgagggaccttcggtgtactttttccaatatctcttcaagctgtcagaggcaaactggtaaccaacccagtttagcccaattcaacatgggcctaaactacagcccactaacaaaagcccattaagagaaagcccattattttctctttctctctccaaggtggcggcggggttggtccactcgaagagctcggcggtggaacagctcgctcgatcatggccgccgccgccg

SEQ ID NO: 940 - DNA, 1501 bp, Oryza sativa
ggggctccagtcttcgatcacaggttcgtaattgtcttaaggtaggttgctgatcgatgttatcttgttttgtcatgcaatttgtttctgatccatcgagctgttgatctgtagttcttttttgactgtgatttctcagcaggtcatcactataagctgacaagctatatgatgcaaccttttcccgaacttctatggactatggagaaaggaggtcagtgttctttgttcctgtaacgattaaactattagccatatacttctcattttctcttgaacatggttttcttctttgtgtgcacttgatgatttgatacagtacgatatattgctatctaatctcacaactgttgatacattctcagttggaactctgagcaattttgtcccccatttcctcctcggacacatttactacactgctatatatacattttcacaaaaaaacaatgctccagggacattgttagttcatctgaacttgcttctgcagttctacatctgtactgttaagtgtttcaggcaacatcacgacaggagccataaatcctttcagctacatctagggagcgcaactgctgtcctcgacactgtgacaatattctacagagaatgtgattttcagaaaagaaaaaaaaatgcaaagcattggccattggccgcttgaaatggtttttgttttttagagaaagcattggccatatgcatgtgctcctacacgattttagcgactccataatcacaatgtgtgcttctcatgttcatcttccggaaagcatcctctttccccaaaataatagctaataataaaatgactcatatcacattggattaagcattgctatagttcctgtgaattttaattattgagaggacatatcaaatactgtatgacatatgtaagaggtgtcatatctgaagccctgaaacatgtggtgtgagcagctttgaagtgcaatagtacgtaggagtaccacaatttttgttcctttttatcaaccaaaacttaatagcagtagtacagtctaagcatgaagagatgtcggtgaacacatgggcatgtagcctgggggacacgaccataatatcgtcacaggttagcgtaacacatctacatgtgcaaatgtgatccttgcctccgaaaggccatgcagcgtccatgctgcattaactctgacaacatatgataagattcttctatttgtgattaacagcgacacagatcgtgccaggtttcggtccagtatcttgcacattggaaaagcctactgcagaaaactaatggcagaaaaggtcttgagaaacagctagccatcctcacgttccatgacatctaattgcaacgaattcatcatcaagttctattcacaaagttagctttggatgatacatagaatctgaaagcaacataccaacgcccaaaaccaaactggcagcccagaagcttcacctgagaaggcttaaaacagtatgcacagtggcatttgtctccatacacaac

SEQ ID NO: 941 - DNA, 1501 bp, Oryza sativa
aagattagcagcagatatgtgaaattatcagtatcttcgtcaattttatgatgacagaaaaaaaggggtcgtcctcaaaaaaaataaaataaaaggaggggtataatgctcatcacttcatcagtgcaaacaacagcttaagttcacttcattatcatttttaaccctgctatttttttatattaccaattttggtaggatagcaaaataaacacattcttaccatatctaccttattagaatttggaagttctagaaaatctctcacaaaaacatgaccaaaatttaaaaagtttcaaactaaacgacatatcaaaagacaccaaaatttagtagcgacaaatgtactgaattttgaaagtgccaaatatttggttaattttgataataaagtgaacaagtattaaattacccaaaacaaaatgatgagtaaatttcacaaaactataaatatttttgtcaagttattaaaaaacctatagatttaagatgatatatcataaaactacagatttaacactaaatttatcccagaactacatatttaagttggagtatcccaaaactacaggtttagtaacaaaattatcacgaaactacatgtttagtgtcaatttaatcactaaatttggatattcataactcaaatataacattagtggtaaggaactaaagcttaaaatatgtagttttgtgataattttattattaaatttatagttttgcaatacttagccttaaagttacgatagatttgccgttaaatttatagttttgtgatatatccctagttttgttaaaatttaattaaaatatttatagttttatgaaatttacttaaaaatgatttatattctctcacgagtcgtgacatgaatcgcaggtggcaataacctcctcccttggcaaagcgaaacaacccttcgcagaaagcaccccataacgctgttattctaatcctgcccgactgcacacaaagttgtgagggacaaaaacggtcacgaaaatttccgctcggcctagcattgtttccgtacaaacggcactacaaaattccattttcttattagtactttttaaattagcaaagaatcaatttgcagagaccgatcattttccatgggagcaaggataattcagaaacacccctcaagttggttggatattgtcgagaaggtccccgacacttggaccgtgacgcccaattggtcctttgaccgccgaaccccatggtgtccccttgacgccattgccccacaccacaccaagctcctcctccttctccttcaccttctcccgctctatatataccctgccatggcttcctccattgctatccaccactaatccctcccaattctcctctcctcgcctctccaaactcgcatcgatctttaatttctgttctcacctgtacatacatacatacgcacgcacgtacatacactcaatcagagagagattgttggtagctaggtagctgtggccaagaaagtgagag

SEQ ID NO: 942 - DNA, 1501 bp, Oryza sativa
gcaacgggcagtcccctctcgtgtctaggtgaatccggaagcgacagaggccgtcgcagggcccacccttgcctggatgcgtcagctagaggaaagctacactacaagcccagccgttgcccacgctggcttatggtaagtacgaagaattcttttagggtttcccgcgaaccggtccttaatcgccatgggcactaccatcaaaaccatgcacccacagcccaccatttaatatattttaattaaccaacaccggagcggtggcactaaccaacatcattactaaaatttgatatctatgcattaatgttgtcccccattgtgtgctagttgaactaagcatggctaagcacttcctaatccaacatctaatcatgttacaaccccaagctaacaaaggagtaaggtacaaaaatggcatggctgtaacaatagacaaacatcccatagtaacattataaaacaatgcagtatttaagggaaaaacgatagagcatttgtaatataggttcaatatgttcaagtgacaagcatgacttgccttgctctgctgctggaggaacctcggcgactatctcaaagtacaccggagcgttaggagagtcggaatctaagcgacatacaaaacaaaccatacaaacaggctataagactactgaaacagagaacaaaaccatttttaatggattctttgcatttttcttgatttactgagacttgaatgggcttaaaaggagcacggatgaattagatatgaattttagaagattcactgtgtttttactataaacagaaaaatccttaattgatttattgtgcaattattagccctggtgacatcatcagagagagagggcggcgccgacatgcgggccccacatggcagtggctccgggcgctggtccatggtggatcgggtccatggaccggggagtgggtggcgcaccacgaggtgcacacgtggcgccgacgtggctcacacgtggcggccacgtggacatcatgcagacggggggatatgatggctcctatccactcggggtggatcggacggcggagggggcggcacgcggccggcgtgcacgggcccggctcaagccggcctggcgcccatggcgcgcggcggcgcggctcgacgcagcggcggcgcaaggcggcgaccggggcgaccggccggcggcggagggcagcggcgaagaggcggcgcgggcggcgctagcggcggctgagcggctaggcggcggcgcggcggctaagcggcgcgggagagagagagagaggaaggggaggagggacctcaccgacgaccattgacgatggcgagcgacggagggcgatgacggcagcgggatgagctccgggatcacctaaggaaacaaaagggaggagttagagagggagagagagaccacggatggctagggcgccggccatggcgaagctcaccggcgtgcggtgcgaacgtggttcctgcggcggaaatcggcggcggagaggcgga

SEQ ID NO: 943 - DNA, 1501 bp, Oryza sativa
tttgttttagcttccgcctttatttttaaaaccgcctattcaccccccctctaggcgacatcaaggtcctttcaaaggggttggagcatccgccgctaatgcgtggcggcagacatcgaggtggcagtgatactgctgttgtggcggcgccactgccccgcccttgttggctagtcttactgcgtcttagatccactgcttcctcttccttccactcacccctactagagcaggccaccgaatttgcccgcgtgagcaagaccttaacgagcaccaaggaggcggaagatgagggagttgagccacctttgatttttcccatatccgtgtcgagtacgccgtggatggggacactgttgagctcggtgcctcggtgggtgcccttcctctcttcctcatctcaccgcggtttgagcttcttcccctcgatgcttgagttctcccccctcatcgcctcagcctcccggatccttcctcttcgccccagccttagccggctccacgagctttgcccttcccttcacccgtctggcagtcgagtgtgtatcactggaggagaggagatcgacatctgcaccatcacactactgagtgctgacttgctaatggcggcttcattggtagagaggagaacgggttcgtggagaaccgttgcgtggatgcatggaggctcacaacaatgtctcggattctgccgtggcgtcatccaccgccacctgcctcctttgcattaccgctcgctgacatcttgccctcgctctattgccctttggtaggagatacggagaaaaaaagggaaagagagagagagagagagaggaggaggaggaggaggaggaggaggaggagggaagtagagagaggatgacacgtgggtcctactaatttttttgggttaatgggatctatgccattgcaaatttgcctattcagaaaaataccattataattcgtctattcatagttgtgccattgaaattttagaaaatttgaaccgtgacactgctgtcatgttttccatccaactccttcctttttccatcttcttccttccatagggaggggcaaaggccggagcatgcgccatcattgtagaagagctcaacgctggtggctgcggcgagggagtcgccgttgccggcggcaatggcagcgggggagcagtgcaagacaatgacagagttgaacggcaagcggtcgccggccaccgccaccgtcacgacaacccggcatgtgggtctcaggtcgttggtgatggcaggccgagtgcggcggggttacgtgccagccagtccttgagaaggccaccgccgtcgttggcagcggcgaggagggatgaggtttcttctccttattgctgggtggcagggccaacagtagtgcgtcgttggcgtgtaggggcgatgggggaggaccatcctgcagcggcgtatgtccccccaccaggcacgacgtaggcaagccaagccggcaggctggactgatgatacctcgccaagtc

SEQ ID NO: 944 - DNA, 1501 bp, Oryza sativa
atgggcccgggaatatgcacagtaaaggaaagtatcgatcccatctagtcgcataaccacgcggcctcgtctccccacgccccacggatagcgctaaggtggccagggagcctcggggtgccacatcacacccctcgggctttcgggacgctctaccccgaggccctcgaccagccaccacgtggcggggagagcgggcgaggcagagggcgcctcttagggcctttaatgcgcggcactccaaccgttcctcactgcatttaatgcggtgtgggtggacgtgcggcgccgcccgatagacccatgtcaatcgggcgtgaccggtttatgaccggtcacgggtgattggacgggcggtagcgtccccacgtcccaccctgtgtcaggcggagtgggggcaggtatgccccgtcctatcgatgcactgccaggagcgccctccgcgcgtggtgagccaccaaagtctccatacatttaaaggggaatgacagggatgtcccccgtgtcaggcgggggacggtgctgggccccacccaaggacgcacgaccaccttgcttttggttgaaggcatgaatggcggtctgatccagacagggtgggtccccctcccatgggaggggtaggtatagacggtgcatgtggtatccccttgaactataaaaggagaacctcgcccatcgagaaaagggacgactctcgattgcttgagctctagaggaataacagctaggtttccctaggagctcaagatctcttgtaagacctaaccataatcccacacacaggagtagggtgttacgcttcccagcggcccgaacctgtataatcccttgtcttccacacaaactcgtgaacgatccagtagttagatcccaagcggaagtacgctcttgatcatcgcgccatctcccccggccgaactcacaaagggaggtctcacgaccacccgctagagaggatcactcctcgacatcacaatatttgaaagacaaatattttaaaaatgattcataatcaaagattctaaagtttgacctcactttttgtctaaaacgacaagtattatctgcccagaaggagtatatagcctcgtagcttcgtttatgtttataaaactaaaattcaaatttatctgtttataaagctaaatttcaagtttacaagataaattttgaagttgatttatggaaaaaagttaattacagtttagtgttttataacatgtgtttttcaatagctgagaacacgtatataaaagttttaccgagaaacaaaacaaattattttgtttgttaataaatagtatggataaccatgtgaataagcaaggaaatgaggctaataaacacatgaagaattctcactatcttacatatataagaagatatatatatatatatatatatatatatatatatatatatatatatatatatatagtttttgggaagtgtacacataggtagcgagcaaacctaattaacccccattacagcaagt

SEQ ID NO: 945 - DNA, 1501 bp, Oryza sativa
aaaaggtctaaaaaataaaaaaattcatgttggaacgcatcattcgaagaacgtaattaagaatagaaaaaaaatagagcatttaggcttcttatttgatttatatagaaatttcataggatttaaatcctatatgatttttttctatttggccctttgatacaaagaattaaagcttttcagatcctatgaaattcctatggaatggctcattgcatgtagatttaggagaaaacatagcaagagcttcaacttcttgaaaaatttcctttgagtttatctctctcatctaatataattcctgatttttcttgtggtctaatcaaacaattatttttatgtttttcttgtgttttgcaatccactattttacatttgcattcctgttagaatcatgtgtttttcctattcctccgtttttcttaaccctgcgattcaaaggggccttttatgtatggacaaatcacgcagaatttcaaaatacatgaagttgtactggatatactagggatttagtgttcttttgaaacacaaatgttgaaaaaacttagggatatgcattgagcttctgaaaggaaatcaaaaccatgaggtttgagcttatgtttgaaatccttcaaaaagtggaggaaagaaaggattcctatgaaaattttcttgaaaggaatcctatgaaaattttctaaccaaatcattcaaaccatatgtctccctagctaggaaaattttcaatagtatttcaatcctacaactttcctttaaaaaccctttgtttcaaaagagcctttaatggaggggaggggggggggcagagagaagatgcgttggcctcaccaaacacaggatcataaaaacgcatgaatgatcataaaaacacagaaatagaaaaaaaaatacaggtttggagtacccctaccacttcaaatcctatgcaggaaaactgcatgaatccgtttagatggagcgcaggaaacacacaggaatcagttcataagagtgaaagacacaaatgatatttttccaataggttgtacctcatgtcaaaattcctatactttgaaccaatccaaggaatttggtaggattttcggatggaaatttcctttgattcataggaccatgtataaaaattttccttaggattgagttccttcaaatttcttacaaacctgtcccaaaggagcactaaaataagatttgagctcatatatagtaaaaaaaatttccaatggaagtgatgcatatgataacagtccatagaaaattgtcatgttcatatcctttgttccaaaacacactagatatatataggaaaaaatccttcaaaattcctttgtgggctcctttggaacaatgtccaacactttcaaaggaattttaaagaaaaatccgaagatattttttgaggaaatgatgaacactgtccaacaaattgtttaaaatcaaccactgccgtgtgcaaaaaataaaaataaaaatgcatagaataacagatcagagc

SEQ ID NO: 946 - DNA, 1501 bp, Oryza sativa
caatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttgaaatttttatgaattttttagcctcccaacggttattttcaaatttca

SEQ ID NO: 947 - DNA, 1501 bp, Oryza sativa
ggggtagctaataatgttttaaataacaaacaattgactggctactttcatgattactgtgatcagattgcattagttgcctaccacatgcttactctcatccacctgtgttcttctggatatctagtgtcaagttgaccgcatccatgtcctctcaaacttactttgcaggatttgatcctgattgggctggctacaacagccatagaaactttatacggaacttttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggggacccaattaagtctgaaggcatggaaaatcttggatctccacagagttgccatctcccgttcatgtaatacttcagttactctcgttttctaggtgcttgtaatctgattttatcccatcttgctgaagcaacttttcgtactccagggtaacaagtgagtgagggagaactgcttgtatgcggacgaagcttcagttgtttccacaagacgttcttgtgttctctttgtactggagttgtggacggctgatccggcagtttaccaacgctagcacgtgttgtggccgtggcatctgtatagcttccaataatgctctaaccctaggctagttttgctcatcaatcatgttcatgtagatagccagttttgtgtgctcagcaattctttttccctcggggtggggcatggctcgaaatgtttttgtatgtgtacatctttgtatacatgtatgtaaatatgtgtgatcatgtaatgcttaaagatactgttgactgatttgaggtaataatacaataaaccagtggggcactcgggtgtagtctctagggcgccccactgttgtgaaatgtgagctctgaagttgtggactatcttcaaagctatgacctagtcgagatatgtgttcatctaagttcgtttgagtttgcagctggtattgattgcgctatggttctatagctgctgttgtacaacccatccccaatgtacattttcgaccttcttggcacctgtttgtatccgaatactgaattgatatgcattttcattttatctgaaactgaagtgcatcttcatttctaccctcatcatttgctctttggtttacaggttgcagttaaaaattgaaatttttaaacttcattttaaattattctaggtgtcattttcatcattttctttaagctgataaaagtagaaatgtaaaactctaccctaaaatcatattccatcacatttattttctacggaatattaaccacttccaagattgtttttttttttcccgaattcagcatgttcctattcggaattcatggctgttagcggcgtacccct

SEQ ID NO: 948 - DNA, 1501 bp, Oryza sativa
ctcccgtgtaccattaatttcagctagctagaagcttggacatttttaatccagatgaaagacatgtatcaaattgtatatatagttaagttgcaagaaagtttcctccagaaattaaagtttttcatctagaaattttcgttgtacatatcatatgcataagaaaaaatattaatggaagttctctacacatcaaaatcttgaaattgtcttttcaacatttttttttgaatgtggaatatctaatacgtactatacatctaactccatctctttaattacctgtgtgctggaaattgcgtagaaacttaccaaagaaatgagccagaagaacaatagatataggcatatatagagacgacagtaaaaaatatctattcagaaaattttcaagatcaaacccactcgtacgtgcatcatacatgaatgccagcaaggttgaaaaggggtgaagtttgtgtatatggaagtattaacattaatataatttccatactttaccatctcaaggaaaatatttcagaactatatcagaggtttcataaaaccaaagatacacatgaagaagaggaggtatatatttaactacagatcaattatttatttaggtggtgttcttttctcctgaagatgaagattaagctttttacgcaaaacgaggtggtattaacgtatgattgattgagttttaattattacaaacttgaaaaatagattaatataatattttagagcaactttcatatagaaagttttcgtacgaaatgcacaatttagcagtttgaaaagcatgccatgaaaatcttaatattcatccaactcttgttggagaaaagaatgagaccttatactattaattccttccatttttttgatatatattccccaaaacatggttcataattaagtacgtacaaagtaattaaacttatcaggaagcaaattagctaattaataaatgtggcccctttggtgttcaaggaatgataaaaaaaagaacaggcatagcaaagcactcaccgattaaatcagatggtccaagcatgcagacgaaaggcgacaaatccagctttgatgtttgaatttgcaggagtacttgatttgtaaactactccctacgttacatattatattataagttattttgattcttttttcgacttttataggtttaactaagtttataaaaaaataacaacactgttaatttaatctcgttaaatttagattgaatatatatgtatttgataatatatttgtgttttgcgttgaaaataccaatattttctataaacttgatcaacctaaataaatttattaaataatcaaaatgactaataatatggaacagagggagtatgtatataattttttttaagaaaaatactttcaccagcggattaatttattttctaataaactttcatacacaaataactgcaacgttaaatacttaaattttcccattataaggggcccaaaggttattttcatgccttaa

SEQ ID NO: 949 - DNA, 1501 bp, Oryza sativa
ccacctccacctccaccacctccccccgccgccgcccacgacatccgcagcgcgatctccacccaatttgccacgaactcctcgatcacgtagtaccccttggccttcagccagggcagctcggggaactcctcccccaccattgccaccaggtccacctccccgtcaccgcataggaacctcccacccgagatctcgtccatggccgcgacgaaaccgtcgaggtcgccgaggagttcctccgcgaccgtgatcgcgtcgaggcgcgacgacgacgtgggggaggaagggaagaggaggaggtggtcgaagacgagcccctgcccgcgggatgcctccgcggcgcgggcgaggaggccgcgggagagccgcgagaggacggtgggcgccgccgccccctcctcggccaccgccgcggaagaaggggaaggaggatgcagcacgaagaaggaggagtggccgcgagcgcggaggcggcggagcatggagaggagcgcggcggccgcggcgggggtgaggagggaggtcgcggccgcggcgcggcagggcggggagagggaggcgagccaccggaggatcgcggcgcgcggggaggaggaggagggagggggaggggtcgcggcgtggtagagggagaggtgcgcggtgagggcgtcggcgagctgccgcgcggtgcgcggcgaggcggaggcggaggcggaggccatggtggtcgcgtggtcggaagtggggaggtgtgcggcttcgcctccggtggggttggtcgggacctgggaattgggggaggagggaggagtatggccagtgtgggctgggcctgcgttagaggtggccaaatgggccgggccaaacgggccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccggctactgtagcgggccggcacggcacggcccggggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 950 - DNA, 1501 bp, Oryza sativa
gacaaacatctccacaaactcagatcctgatatcgagaaaaacggcacaccagcttcccctgcaatagccttggcaagcaaagtcttaccagttccaggaggaccaacaagcagaacacccttagggatgcgagcaccaacagcggtgaacctttctggtttcttcaagaactcaaccacttccatgaagtcttgctttgcttcatcgacaccagcaacatcatcaaatgtaacaccagtgttgggttccatctgaaacttggccctagattgaccaaaaccaaggggaaagccaggaccgttaggtccaccaaggccaccttgtgctcttcttgacagcaaaaatagaccaccaataaggataagtgggaaagccaagtttccgatcaggttgaacagaagagaaccagagtcctcctggttgctgtgtgcagcaaaatcgatattcttttccctcaacttctggagaagctcctggcttagaccaggaagctgcacacgaactctctgcacacggttgccgagctcaggagaaatagcctctacaatggcaatcgtgccattctcaaacaaatcaaccttcttcactctgtccttgtctagatactcaaggaacctcgagtaagacattctcgacgacgagacaccttgctcttcagcaagagctctcttagcacccaacaaggtgggaagcccgaccccgaggttcccaagcgcgagctttaggaacttccttctggcatcattagtcttgtgctcgagggaggcagtcacagaaactggcctctgtgcaacgccactcgaaggaagtgtcgagaagggaagcggcgtctttgcagcaaggctcatggatgttggagccatcttcgctcactgttaaaagtaatgaaagggagatcttgtcaatcatacaagtgttgtatggcagaaattgcttcatccgatacttcaactaagctaatcacttcatatcaatccaacttagctgtaactaacaagctgtcctaccgtaagtattcaagaacaaaggtaaagcatctcttcacaatcacccctacaagtagaagctattgtaatcccttctcgaactacaaacagctacaaccatcatccccaaaccagtatgaaatccgaattcagtagctcaccgtagcttctacttgctgattaacctatcgattggaacgaacacgctaacgatctcagtcccaccatctttaccagtaaaaagctagaccagtactccaaattccgaaaagcatactggctaacaaacagaacatccgcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggag

SEQ ID NO: 951 - DNA, 1501 bp, Oryza sativa
tgatatgtacaacgaaaatttctagatgaaaaactttaatttctggaggaaactttcttgcaacttaactatatatacaatttgatacatgtctttcatctggattaaaaatgtccaagcttctagctagctgaaattaatggtacacgggagagaatttcaaaagaccgtgtctacgtccctatccatgaccaagttaaagtgaactactgaggatgcatccatgaaattggattggttgggataggatcgatatgttgatagagagatgcatctttttgtcacctttttttatatttttccctttaatttgcacatccgatccctggacacaagaatgtgatccaaaagtccacaattcatttcccatacgtaccgaatgcttggcttttgctcgtcctttcattttccccgtgatgtcactgttgtaatcttgataggtaattgcaaactactaccttgacttagaaagcattttatcacgcaaggtacctatgccagtgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcaaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacaaaatttggtatcagagctcaagcgatcctaacctcttggttcgaccgtagaattaccgatcaaggattgagactggttcttcggagctacgtctcgcgaaaaggcaactcgccttgccttgattgggttggttgaattcggagcgattgcgagttctgagccggattcatggcgcccgatgagaagttggacctactgttgaggaaaatggaagagaatgaaaagaagagagtagcagcagaggagagatcacgagcggatctggcacaattgaagtcggcgatggaggcaaggttacctcaagtggagaagagggtggatgacatagcttcggtggtgagtacattgagccaaaaggtcgaacagcttgagggcgcgctgcagaaatttggggatgatgaccagaagccggaggaggtgaaggaagagcatctagcaactcctaaagggaaatcatcgtttcagattcaaggtatgagagatccagcccttaactctgcaactactttccaatttgattctgttcaagccactgctgctggtagtttgggaagcagtttacccccaatgacatgtc

SEQ ID NO: 952 - DNA, 1501 bp, Oryza sativa
atagtctcgatcgatacggtaatttttttccgtatttataaatttaactatttagtgatgacgacttcaatatgatgctgataaaaatataaaaaagaaaattttatatatagttagaaatgaaagtgatcggaaacaatattatttttaccgttcgatcgggaatttctataccattttcagcccaaactcccactgcgtacatcatatcatagtactactatgtttgtcatgggacatatagaactaaacactttgtctcttaattatatatatcatattacttcctctatttttttaatatatgacgctgttaatatttttatatatgtttgattattcgtattatttgaaaattttatgtaaatttaaaaacatgttagtcttttttaacatgttgaatgataaaacaatgcataaaaaaactaaaaacaaatgataattacatacttttgtaattaaataacagaaagttgaataaatggttttaaacagtttataggaaatgtttatgaaggacatttttttaaaataaatatagtatttggatgcttgggaagtgtactcgtgataatgggtcatctattagctaaaaaatatgtccttaaaaaaaatcttcgaggtggcttataataataataaaggccttttctactacggaatttgagaatttgccactcctaatttcaatcttgattttgcccttttcgatcagttgggagatttgaggatttaccacttctattgcaatctagagttttctatctatatgtgtctatgttatatagcatcaggaccatgcttaaggtgataagttgtgaagcgagtgtagctcttaacgcaagtacaaatctcaaattaacttcgtacgggtgctcatatttataacttttttttcaataataaataataaatccatcaacaacgagatgtatatgatggcttcatcaatctgaagatgtactgacccgatacggaagatgattatatagtactatgatatagtacgtgtatatgttgatagaaatgagtatgcacctaacatgcggatctgatcaacgcttgtgtctaaagtgtgtttggaaaaaaaaagaaagtattaaattttccattttttctgttgtgtcgacaaaatgcttatgcctccctattcgctggcaccatccatatgcttgacaattgacgcacgtcagcatacatcaatgggcagatgaaacggactgtaccagggtcagcccagaaaggccccccaaagcactatcaaacgggcctgatcgacactactgggctggcccgctacacggcccatttagccacctccagattccagttcgttcccgatccgtccacgcaacgcaaattcccacaaaagaaagcccagaagcagaaacaaatcgaacgctcatcttttttcgaagaaaaaagagaaaaaaaggaaaaaaaacctcgtcggcgatccgccgtgcgcctgccgccggcgggaggggaactccgccggaga

SEQ ID NO: 953 - DNA, 1501 bp, Oryza sativa
cgaaataaaacgaaagtaaaaagggtggcgatgtgccgagattgtattgaacgtgtgtgttttattacatagggctcggggtctatttatacccgaggattacaagatatgcccataccggacacaaccattatctctaacaaactctaagataccacaagtctttgtggcagacttttgcccacacttatctataaggaattcacataaaatatcctagttaatagatacaattgccttcccaggactctgtcacgcccggaaattcactagtaatttccgaacttatttgtgcataaaatcctcgtccaggaatcagtcgaggtacacaaactgacaatttaatatacaaattcattataataataacgttacatacttacaaaagaaaagtaaacagcagcggaattaacggtctagtgatggcttcaggggtataagccaaacgtcttctccttctggatccttttttttcaactgaggttgattgattattgcaaggatgagcatatgacatactcaacaagccacacagcaaatatgcaagtgcacatggataccaaaggatggcataatataggctcatttgcaaaagcagcatttagcaaagatttaagagtagtaaaacagtagagtaattaatcatcaattttaatcaacactgaacagcaccccaatactgcacaggcccaaccaaacctgaacaaccaaccctggtcgtacagatcaaacctccaaaccaggagctacacaaattattaccagttatagcatcaataattattgtgagaggtgtgagactaatcacgaaaaacattgctcaactcgcccataaccacaggcacggctattcgaatagttttactctggccagaggtgtaccactgtacccacaagacacagcctcaacatcatgtctaccatgcgtcgcgatactggaaagtacccgaatagaggctatgacaataccctcagcacaacacaactcaccacagtgcaccatacctggatcataatcaccccctcaaaaaccagaggcatggactccccagcgacccccacggacttctcgccgcttctcagtctggcaccccgcaatgaatcatgctatacaaaaggtaaaaccgttgcccacgctggcttgtggttggtacggttaatgtctcacaacagtagctcgcgaaccggtccttaattgtcatgagcacgaccttcaaaaccatgtgctcacaacccaccattgacaagttttaattatcaattaattatcataacacgattaaccatcgtgagctaccattaaatataatcataaataataatgtagtatgattcatcccattaatgagctaatgtttctaagcatggctaagcaattatatatatatatatatagcttttagctgaaccaaaccaatatataaggttcaagctaatcaatttgttacccaaggtatcaaggaataaagtaatcaatgcaaattggccataacaaagaaat

SEQ ID NO: 954 - DNA, 1501 bp, Oryza sativa
gcctcccatccgcggtggctcagcattcagcgccagttgacgtggcgctgaggtgtctaagttcaacgccaaatgatttggcgttgaaaaaaaggatcattttgaaataagttttggcgacagtttatttgtaaaattaattttttcaaagggtcaaattgtcaaaatttgtgggtgatcgatgctgcctagctagctattcttagccatgtgtgagtgtgtgactgaccctcaaacgctgcatgatgtgcaacgtacttcgcatgccttcgacggcggccaatctcttgtgaccgattcttgtatgattatttcttcagttaattcgtctgatctcaccgaagattctgcgcattgatcagttctgtgctttttttttgtccagttcttggttggtttctgcactaacacacgctgctccagttttgcaggatcagtactagggttcttggggaaccaatttgatcggagaaaacatctatcgatcgatcgacctccccatcctcggcctcctcttcggcaccatggtcgtctccatcttcctggagcgcgccgacatgttcaagtacctcggcaacatgctctcctggaagagccgcggcagcaaggacctcttcttccgcgtctgcgtcgtctccgccgtcgccagcgcgctcttcaccaacgacaccagctgcgtcgtcctcaccgagttcatcctcaaggtggcgcgccagaacaacctcccgtcgcagcctttcctcctcgcgctcgcctccagctccaacatcggctcggctgccacgcccatcggcaacccgtagaacctcatcatcgccgtcgagagcggcatcacgttcggcgagttcctcctcggcgtcttcccggtgatgatcgtcggcatcctcgccaacacgtgcatcctctacttctggaggtacctctccgccgagcgtgaccagctcgagggcggcgtcgcgcatgagttgaaattataattacataatgatttaatttattctataaataaatcatgacattgcagatgtaaactagcatcaacgcatcattagatctacacatgtaaattacatagtataacatgaacagattaaatatgcgcaatatattgaacatgtaccgagattgcggaaagaccggttgctcggcaggaactactcgcggttgcgggcgtcgacgaaggtgcgtagcacgcgaacggagaggaagacgagccgtcgcaggcgaacagggtgcagtcgtgcaaagcgcttcccaaaaactttattgccgcctttcccttgtgcaggacgtcgaaggcagaggttccggagacctactctcatgatcgccggtgcacgccagcgaacgggatggagtagtctacgagcgatagcgcagcacagagtaggaggcaaaccctagattgattttgcgtgtgttgcgtgaaggaggcggctcgatttatatagagataggttgcttgatcagggcgcccgtacgatctccactccacgtaacc

SEQ ID NO: 955 - DNA, 1501 bp, Oryza sativa
tactataactaataactaatagaggggggagttaagggagtaataactaacagaggagggactcaaggggagtgcgcgctagctagccgcccccgaggaaaagagcggaaaagctacctcgcgcgtacgtgctggtaacgcgcacgcgaagggtttcacttttttttatttcttttttccggcgcgtaggtggaggaggtttgaccttttttttgattttttcgaaatcatgtattaacgtaatgatgataactaatctgttagttttagatactaataacgataattaagataagatttttttaaaaataatagattaaaaagaaatctatatgtggtgtcaaattttgaaaacttttaacccagatttgtaaagttttaacttaaaatttgtatttttgaagttgaattttgaaaacttttaatttttcatctcaaattttaaaaacttttaactcaaatttgaaactttcaacccatatttgaaaactttcaactcaaatttaaaaacttttaacccaaaaattgaaaactttcaacccaaaaattgaaaactttcaacccatatttgaatacttttaactcacaatagaaaacttttaactcaaaaattgaaaactttcaactgaaaatttgaaactttcaaccctcaattgaaaactttcaactcaaaatttaaaactttcaagtcaagatttgaaaactttcaattcaaagattttaagaaacacgtgtgctagcaactaaaaaaaaggaaaagaaaacacaaaaaaggaaatagcgtgagaggtgcgctaaaataggaaacagatggcaacaaaatacagatcgattagctaactcgcgtgaaataaatgctagaaaaaaaaagagaaagtcggaaaaagggaaagaaacggtggcagatgacagctggcgcgctgtcacaccctgaagttctttcccaagcctaaattgaagttataaatggtctcaagaaaataccggtgtaaaagcaagagtaaaccctaataaatcaatacaaataataatcggaattggcatgtggaattttttttcttgagttctacatgtcgaaatacgctaacaagatttttagtggaatttccagagctctagaaataattttaaccaattaaaattgagcacaagcaatatttaatcccaagaaaattcatttccttccttttctttttctttttccatttttctctttcgaatgggccgccggcccattctgtcttctctccccctccccgctgtgctggccgaaggccacggcccagccagccgcccgagcccccgctcttctctccccgggtcgccaatagatggggcccacctgtcaggcccgtctcccacctccagccggcgccgccacgccccgtaaccgcaaccgccgccgcgccctgcgtcttccgggccacgtcacccacgtcgccctcgcgcccgcgtcccccgcgcccactcccctatctctcgcccgcgcccgcgctcgaga

SEQ ID NO: 956 - DNA, 1501 bp, Oryza sativa
ccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgccactcgccgctctctatccccgccggaatcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatctttgaacatattgaatcccagtttataaaattatgctgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaatt

SEQ ID NO: 957 - DNA, 1501 bp, Oryza sativa
gagaggatttttcgagggtgattcggggttttcgccgggcggaatcgacgcgagggcacgggcggccaagaaacgctgctcacagcgcgggtgcctcacgatttcggcgccgcgcgtggatttgcctcgacgaagttttgcgcccctcttgtgggcacgagacacctagtttggtcgcgggcgcatgcgacacgtcgaccaaaatccgatgtggcgcaacgaggttccggtctagctcagcacagtgtgaaagactttatagtatccccaaaggaacacaaagataagttttctttttctactcctatatataacaattaattgacaaaagaaagaaaattaagaaggtcccagccgtagccatatttaagttagacctaaaaaataatatctgattagcactctatagtcaacatatgagttgaactgagccataatgccctttaattaagaatgattcagtttagaattattataatataaactattaggagtaagcttaaacaaacatatagcttattatgatagattattacaatctataaaccagattactataatataataatccactctaaagatgtttttttaattattgggtggctaacaactaacaaacgactaataatatagagatacaaacagctaacagcttattttatgtccgcttattataattcagcttatagtaatctggcttaacaatctagattacaataatcttaaaccttaaaatcatgatcacactggctcagtaagcttagagaggggagagagagagatgcatatatgacaaagaaagattataatctgatgatttattagttagctaatgaacgaatcaaccactttattgatggttaaacaaaacattcaacgaattagaagagctaattaattaattagtgcctgttcagattgtagccaaaataaatcttaccaaattttggcaatatcaaaattttggcaagatgataatgttgtccaaattttggcaggatttcttatatatttatcaaatttagtagcaaactaaacgtagacatttttttgacaactttaaaaaaaatggtatggttgaaaatgacgtcaaattgaacgggcccttaattaacctaatcaaaatacctgaacacgatcgatcaaaaatggagatgagaagtcacatgagcgattagtacattatgaattgatcataactggacatccggtattagttcgtccgagtgttcatcagctgacggctccggcgccggctcgccggccgttccgatgaccatctcgatgagcgcgccggtgacccgcatgaacttctcgaacgcctcgttcttgtcgagcagggtggccttgacggtggagtccggcgcgtcccggcagctctcctcgcacgaccacgtgtccctctcggcgacgtccatgaacagccgcacgtccttgaacttggcgtcgaggtcgacgacgccgccctcggtgtcgtcgaggtgggagacggcctcctcga

SEQ ID NO: 958 - DNA, 1501 bp, Oryza sativa
gtactattcatattttatcatctaataacaataaaaatactaatcataaaaaaattaaataaaatgaattgttaaacgctagatatagaaacctacaaataaacttattttgggatggagagtgcatgaagtgaagctttttctaacggcccatgtgctgcacggccggtgccgcggcggcggcggcggcggcagcggcgccgcgctcgacgttgaggtgccatccgagcttggggtcgtagccgcgggcgacgagctcgcggtactcctggcacagcgcgcaggactcgcagcagcagtggacgcagcagtcgccgcaggcggcgtcgccgaggccgtgctgggcgcgcatcttgccgcggtaggtgcaggtacatccactggaacccggtgaacgcgcacagcagcgcgtagagcgcgccgccggtgccgaacgacgtcgaccccctgtccacgatctccgccaccctcccgaacgtgatgcacgggcaccagcacgtcgtgcagcctatcaatattgcacagattgttattacagattgaatgaatcagttcatgttgatcgatcgatcgatcaccatggatgcaagctactagtagctagccatggccggtggcgaggacgtagatgtacgtacataggccacagtcgtcgaagcagtcgcagaggccggtggaccaggcggcggagccgatggggacgccggtcaccgcaccggcgcttggcttggccatctcctccaatcctctccttcgccggtatacagttttttttaaaggaaattcgccggtatacagttacctgctgctgctgctgctcactacttaaaaaatgttcctcagtgccgtcttatccatgccgggttttttaataaatcggataataggaaatgtctcattcattcaaatatttttatattttaaaacagatggtgtagtaaatagtagaattttaaaacagatggtgtagtaaatagtagaaccagccaaagggatgatttttttttctcgaccatatgtctcccagccactacacccccctccctcccttctctcgaccttatctcctacacacccactcactctctcccttatttgagttgaaacttgaaacaattgagcaggataggatcacacctgataacttgaaaagtgtccgtaatgtaaccaaaaagtcatgtaagagaagatttgccacgctaaagtctttcgtgatgctataccaatagatccatttattgacatgtaagctttttacgcgttcgcgaaagaaaaatccacaatccagtcaaaaataaaatccatgacctatgacttacttgattaattagttataagcacaataaaattagtcgttgaggtgaacaggataaaatgagaggaaatgaactagagaggtaaagctgaatttaggttaccccacaactttactacagacccaatttctgaaactaaatttaggagttagagcactaccaaacgaaccgttaggctgagttct

SEQ ID NO: 959 - DNA, 1501 bp, Oryza sativa
atccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaacc

SEQ ID NO: 960 - DNA, 1501 bp, Oryza sativa
agcacaatcggagaggcaaagtagtttgcaggcttcaatactagttgtggctggtagaacagcatacgggttctctaaccaagtagtgttcttcacttcgaccatcgtggttgtcactctcgtctcatcgttagagctgttcctcacgcagccaccggttggcaatgctctccaacaaccaagtgtgctctggttagtgctcaagaattcaaaaccaggaaggcaagagcagcttgtctctccagtcacggtgagatggcagaagctattcggaccacaaacacctttcacaaggcagcgatcactgccaggctcaagccactcaacctctgttgtaggtgccctgccaagcttaaagaaaacatgtgagtagagtcgtaggatgccgtcgggatcaaatgtcagacgatagtaaatttccatatcaggggaggcattggaaggctggttggcatggaacagtatctttgtataggagtttttcctgtcgaacatccatatggtaccattaggatctaaggaaagcgtgaggaggaggcccatgttgaaagtccaggtagaccagtacgcactaccagagtcaatggtgcctgttgggtacatcacaagattgccatcttgttggttctcaagcctatacttgccactggcatgattactctgagagacacctgaaagaagaaatctgcctggacgcaagttctgacctgccaacaatgtgtctgtcggaaaactgaaagtagaccatatgacctgtctgttcatatcatacagtacaaagttgccggtgttcaacatggcagcagaggcagcaggtgtagaactgtcagatatggggttcagttggctacctggagttgatggagttcgtgaccattggagcgcaccaccatgcccaaatatgatagaaccaccagcaattgggggctcatcacggttggcagtccacacaattgtccttgacacaccaatcacaagccacaccccaatagaaaagccttcgccgttgggatagaagccgaacgcaaagcggcctgaagaggaggaccagtactgggtgctgcttgtgttgatagaggatcccaaagtaatgaatgactcattggctgaagctccagcggcaaaattggggtcttcaggaaccaagagcagcagggataggaagagaatatgtgggaacattgtccaggtggaagagtctactgcagttccttgagatgagatagtaattgtatgctgaagaaacctactggcaattctaagcagggaatggcttttgttagaccctgtgaagtgtaaactactgaatactactcccaccgtccttaaatatttgacaccgttaactcctttaaacatgtttgaccgttcgtcttattaaaaaacttttgtgaatattattaaaaaacttgagtagtagtagtatatttaacaatgaatcaaatgataggaaaagaattaataattacttaaattttttgaataagacgaacggtccaac

SEQ ID NO: 961 - DNA, 1501 bp, Oryza sativa
cgcgcgaagcgcttcccaaaaatcttattgccgccttctcccggtgcaagacgtcgaaggcagaggttccggagacctgctctcccgatcgccggtgcacgccggcgagcgggatgtagtagtctacgagcgacggcgcagtacagaggaggcaaaccctagattgatttcgtgtgtgttgcgtgaaggcagcgactcggtttatatagagataggtcgcttgatcagggcgcccgcatgatcttcactccgcgtaaccgaaccggataagtcgcgcgtaacttattcggactccacgccgttttcacacaccggatttttcgtaatgtttccaaaacaaaacaaatccgaatttcccgcagcaaaccggataagtcgcgcataacttattcggactccatgccgttttcacgcaacggatttttcagaatgtttccaaaacaaaacaaatccgaattttccgcagcggaatgtttccaaaacaaaacaaatccgaatttcccgcagcaaaccggataagtcgcgcaactccatgccgttttcacgcaccagattttttggaatgtttccaaaacaaaacaaatccgaatttcccgcagcaaaacaaccctgccctgcgagacagggcgagcgcgtgtatttcccccctcttctctccaccacacatgcttcaagtggctaggagggcatcctcccttttaaggaggttccctctcctataataagcaaagtggtattaaactcacatacataccatcttatgagatgggcttttgtgattttctaaagaattaatctttgaattggccttagcccatctattaattccaacatgtctgaatgtctcgtgaatttgattctatcgatcgatttcttcaccatgtgtggccatacatgcatgataaggacaagagagccatgggcggctgaattgaaggagacattttgcatccatgttggggccggaaaaaagaggtcaaaataggggtcggagctttaatctccgaacctggcggcgtcacgacttgagctactctccagctccggctgcagaaaatgaatgtttgcctcatgcaacgcatggtatgtacgcttcatcagaagaaaaatggtaacatttcagagaagggaccaaagttgtactgcatgatcaatcagtagcagacgctgaatggccagagcatgcatgaacatggttttggcaagatcgataataaacgcgtgttagaagattagtagttcaatggtggtgcatgataacttgattgagcttcattagcagagaaattcagagaaggaaccagagaaacaaaggcattcatgtggtggagagaaaaagaggtcaaaggggttcggaggatggaaactccgaaccccctttgaacctgatgatgtcacgaccccggccacgctgtccaaatttgggcctagccgcatcacgacgtttcagtgatgggcctcacccgtcacggaattgggtcccaggcctagcccatcagaa

SEQ ID NO: 962 - DNA, 1501 bp, Oryza sativa
aacaatttgcaaagaattctagataaggaagaaaggagaaattttcacaaatcatgttttcggaaaattagtccttaaggtttgaccatttggcttatcctacagtcgagatggctctgataccaacttgtcacgcccggaaattcactagtgaatttccgggcgtgacagggagagagcgagagcacaggctgaacagccataaaagtgcgacgccccaactgtccctcaccgcatttaatgcggtaagggcagacgtgcggcgcgcctagctaacctctgtccaacggatgtgaccggcctgacaccgtcacatccgatggatagggcaaccatgtcctcacgtcgcccttgtacccggcggagtgggggtgggtatgacccgtcacgtccaagcgtcactcgaggaagggctgtcacaggtcatcgttcatttatgagggaatgacagggctgtcccccgtgtcaggcgggggcggcgcctggttccactcgagaaccggttgttgcttagcttccgggagaaggcacggtttaaagcccaggaaaagtggagtgggatccccctccgatagagggtaggtagaggcggcgcatatggtatccccttgagctataaaaggaggaccctgcccactgagacagaggaggacgcctagaaaacctgaactccagaagagaggaagcgagtgcgctttctagagtgaagaaatctttgtaaaactcatccataatcccaaacacaggagtagggtgttacgctccatagcggcccgaacctgtataatccgactgcgtgcaagcttgccggtaatcctagggacgagcgagtgattttcaagagatgagcctccgcccccggccgaaatcacaaatggggggtctcacaattccccgctattgaggatctctcctcaacaatatgatttatagcacttatataaatgtattattgaacatgttgatggggtatcgcttttttcaagcacatcgtggatgcacctactctactgctactgaaattgatgcaggccatgaccaagtcaatataaccttcctatttcatccaaaagtaaaggactaaatttcaaaaactataatatattaaacgaattatcacaaaattatagatttatcatgttatacacttacaaatttaactatttttttataacaaaactatagatttataataaagtattacaaaactacatatttaaaattgaagttatcgctctcaaaataaatttggagttatcatagaactataaattctaaagcttaaattccctagaattaccattacgttggagttataaacgtggtaattttatgattaaattgacactaacaaacttatagttatgagattttgctacttgatatttatttatcttacaccttattttaaatctacagtttaataagaaattcaccttaaatctgtatagttacatgatatgccaccttaaagaaatagcttgatcgaagtatattaaat

SEQ ID NO: 963 - DNA, 1501 bp, Oryza sativa
gcgccttaagtagagtttttgttagatcgatcatggtaacgtactctgtaaatgctaatgaggaataaaattaaaacgtatagtagggcattgtacgtatcgaaaaggagcggtggcacacactatgttgtcggtatggatggttagtccgtcagtttcataattattgtctaacacatacattttcttgttactagatgcaatctcataataataacataatgaaatcgcggtacacgccgtgttccctcgtgttcatctccacatctagttgagaaaattccaacgtgcaggtactcacaatatggcttttaaacttcatttcgtggagtgatggtatcattatactctagattattattaaactagtactatagtggagagaaatgggtgcatcaagggacatcccctcaagatttctgatgatatgtgtcggagatatggacccgggggtatgtgaagtagaggggaattactttccctctggccacgtgactttgcaagttagccccattcgcgcgtcacgcgagtcgtggaagcggcgggggggcgggggggaggggggggggctcggggcatggcgtcaccccctcgggctatcccgcggattcgccccgaggccctcacccggctgccacgcagcggagggagagagcgagagcacaggctgaacagccataaaagtgcgacgccccaactgtccctcaccgcatttaatgcggtaagggcagacgtgcggcgcgcctagctaacctctgtccaacggatgtgaccggcctgacaccgtcacatccgatggatagggcaaccatgtcctcacgtcgcccttgtacccggcggagtgggggtgggtatgacccgtcatgtccgagcgtcactcgaggaagggctgtcacaggtcatcgttcatttatgagggaatgatagggctgtcccccgtgtcaggcggggggcagcgcctggttccactcgagaaccggttgttgcttagcttccgggagaaggcacggtttaaagcccaggaaaagtggagtgggatccccctccgatagagggtaggtagaggcggcgcatgtggtatccccttgagctataaaaggaggaccctgcccactgagatagaggaggacgcccagaaaacctgaactccagaagagaggaagcgagtgcgctttctagagtgaagaaatctttgtaaaactcatccataatcccaaatacaggagtagggtgttacgctccatagcggcccgaacctgtataatccgactgcgtgcaagcttgccggtaatcctagggacgagcgagtgatttccaagagatgagcctccgcccccggccgaactcacaaatggggggtctcacgattccccgctattgaggatctctcctcgacagctggcgcgccaagtaggggcggttgcgcattccgagaggaagtcgctttctttcgtcccaattttctccaggccttagccgaccatggtcgaggtcctgaaag

SEQ ID NO: 964 - DNA, 1501 bp, Oryza sativa
gagagactgttgaaggtactcttagggaaagtgatgggctaactaagttagtggttaattagtacaaaatgcagtgcagctgtaattttgtaagaaaaaagtgttgtaaacttgtaccccaccagttagcgtcaaagcaaaagttaaaatttgaatttttaacttgattcgatattttctgagtaatttcttcttatttttggcttgtaaatcgctacaaataaatatataaaatactgtaaattaacataaatggcgaaaatattgtacatcacacaagcgtattctcacacgaatttgtaatcgttccagcggcacgcgctgccgcctccatttcccacgctaccggcaccgcccaccgccggacttcctcacccgcggctccggcggcgccaccgcccaccgccggacttccaccgcccgcccaagtactccctctatgcccagcatcggcgaacttctcgacccctcctcgccctcaccaatcccgctcctccccccaccccctacctcctctctcctcgtttagttgagattgcttaccctgtttgattcttcagtggtatgatgtgtagatgtagtccggatacgtgcagcgggagcgcgggcggagctggagtatggccaatctagagggcaaagggaggtaaattaaggtatagaatttcagttttatccattacgcctatgctttgttttccaattcatactcactctcatgtgcaaactaaccaggatctggtaattggaacgatccccattcctgcagactcatagtgtgattcattgaatcaagctaacaaactgactgaaaattacctcatcagtgctgagtctagatcataactaactttatacagaaaacattgagttgtacaacatgtatgatgtatctgtatcaacttgttcaatctcggttaactggaaccaatttatgaaaaggtggttatcacttcccttaatctctgctcaggttgttgttttcaccattttccttactgtagatcacttggtgttgtgcattcccgttctttctgtatgatgatcaattttttagactaaactcaggtccaagtctcccaagtccactaaagacttgactaataagtccatccacaatttctttctgtcagtttccttgactgtcaaaatactactccctctgtccctaaatatttgacgccgttgacttttttaaacatgttggaccgttcgtcttattcaaaaaatttaagtaattattaattcttttcctatcatttgattcattgttaaatatactactactactcaagttttttaataatattcacaaaagttttttaataagacgaacggtcaaacatgtttaaaggagttaacggtgtcaaatatttaaggacggtgggagtagtattcagtagtttacacttcacagggtctaacaaaagccattccctgcttagaattgccagtaggtttcttcagcatacaattactatctcatctcaaggaactgcag

SEQ ID NO: 965 - DNA, 1501 bp, Oryza sativa
aaacagttgtgaagcactgacttcatgaggacaaaacttgttcagaaatgaaattattccacatagttgtgcaaaattgttgttgtttttctaagcattatttagtatttactcattagcccatgccaatccatttagcaaactatgtatgattgatatttcatttcaatgtgtacgcaaactacaattggagctgctcacaaagaggaaaaagggcttgcggcacgactatattacattccccaaagatcaattgacaggaaaatttaacaccccagcctagcacatgcacaaaaatgaaatttcctgagtatgtctatgttatgtgttcatctatatgactagtgtgttaagatgaagagcagatgtgagcaccataccactggtaagatactaaaagacttctttttgaaaataagtattcatagacacaactcacttatccattgcaatgaagtgaactattcactaataaacaaaataagcacaatcattctcaaattagttgataattagtggatgatagacatttgggacggggatttagctttaattcttcgattattaaacagatagcagtcgattggccatttctgtggcctacgggaacaaattgcgcacctggaatcggcagacatagtaatcatcgccatacgcgccgcggaagtagtcgaggggcttctcggcggggcgcctcggcatgaacgcgacgctgaggttgacaagcgcgcgcacccggtcaggccgcagcaggcacaggttccacgacacgatggcgccccagtcatgccccaccacgaacaccttcaccgcaacaacgcgcgacgcgtcatctcagcgatttgggggcggaaaggggagagggggcgcgtgctttttttttacctgggggagctcgagggcgtcgaggagggcgacgaggtccccgacgaggtggaagatggtgtaggaggtgtgctccggcggcgcggtggtgccgccgtagccgcggaggtcgggcgcgacgcagcggtatccgcgcgcggccaggtgccccatctggtggcgccacgagtaccacagctccgggaacccgtgcacgaacagcaccgcgggagcagtgccgctgcccggccccgcctccgcgacgtgcatcgagatcccgttcgcctccaccgtccggtgccttaccgccgccgccgccgccatggtctcctctccactccgtcgcgcgacgcggcgacgacgtgcggtgctctgctactggctgtgaacctgctgattacccgaggtagttggagatagttgactgacatgtgggtccagtttcctggatgggccgatgtgatactgggcctagttcctttagtttccaaatgcaaagtggcccaggacggatagagcatttgcatcgcaaagcatggtcaattataccaaatcaatgcatcatccaaacattgggaagaaaattacacaggaattcagtcttttacttatcagtaggactttgcttctttgcgtg

SEQ ID NO: 966 - DNA, 1501 bp, Oryza sativa
ttgaaatttagtcctttacttttggatgaaataggaaggttatattgacttggtcatggcctgcatcaatttcagtagcagtagagtaggtgcatccacgatgtgcttgaaaaaagcgataccccatcaacatgttcaataatacatttatataagtgctataaatcatattgttgaggagagatcctcaatagcggggaattgtgagaccccccatttgtgatttcggccgggggcggaggctcatctcttgaaaatcactcgctcgtccctaggattaccggcaagcttgcacgcagtcggattatacaggttcgggccgctatggagcgtaacaccctactcctgtgtttgggattatggatgagttttacaaagatttcttcactctagaaagcgcactcgcttcctctcttctggagttcaggttttctaggcgtcctcctctgtctcagtgggcagggtcctccttttatagctcaaggggataccatatgcgccgcctctacctaccctctatcggagggggatcccactccacttttcctgggctttaaaccgtgccttctcccggaagctaagcaacaaccggttctcgagtggaaccaggcgccgcccccgcctgacacgggggacagccctgtcattccctcataaatgaacgatgacctgtgacagcccttcctcgagtgacgcttggacgtgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctgtcacgcccggaaattcactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctaagacattgaaacttgaagacatttatgtggtcaacttatggaggtcagtcaagtggatcgaggaaggaccgaagtgccaagtggtcaagatggaatgaagtttggatcctaccttagaacctatgccgccaaagtgtccttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaacaga

SEQ ID NO: 967 - DNA, 1501 bp, Oryza sativa
aaggctttgcatgtagaaactagtagatcctattaaagtgaagaacctggtttaaatagttgaggttcttctatagccagatttgcggttaaagaacacaaattaaactcagcatatagttgatggaggccaaatggacctttttttatccatttgagaaaactagaggggggccatggcccattacaaagtcctgcccataatggaatgctatcacacatgccgatatttagaatcaatcaatgtcacttcacaattcaccattgattgagcttaccaatgaaagctgacctcctcgagcttgatgtggagagcggcaccgacgaatattggataggagtgtcatagcgaagctcggggccggctcgctgtggtagcaaagcttgggtaggagacgatgacaaaggcctcgtggaggagagcattgaagcattgcaacttggcttgtggcatttggaaggaaagactcctagatcacaagcagccatcgacaaatctagatggcatggagggctgatccgcaccatgtccatgtccacaaagctctgatccatgtccagttcctcatctgcttgcggccactcaaaaatcctatccgaccttagccaagaggtcaggctccaatcaagcttgttgttgccccacttctctcgagctcagtcaaacggatgggcccctagtcaagctcgtcattgatcctgtcttcccctcgtttgtggcaagagagcaaagggagggaggaggaagaaaaagaaggtaggagagaggtggcatgtcgatgtaggctaggtggcgtagcaggaaatatgattggatcgagaagctcgttggctcctttatccatcttgcttgtcgtataatgtaacttctatatagtaacttatatgaataccttaaaaacacgtactagcgcacggattagcgttaagcgcttgtgttcccttgttatgagtttcacgcatctaacaaattttgtccctccctaccactaatcttaaaacacatccggttgttgaaaaaataatcttaaaacacatccggcagctaaaaaaatcgaagcccccaccaccaaccctcccccctccaaaaaaaaaataataataataaactcgacattgctcagtgggccaagtcaactggtgcacggtggcagcacgcagctgcgtcaaacgctaccacacgccactggttaggtacaaacaaaatcccgttgactcccatccccccaacattctcaccggcgaccccctcacgaccccgcttctaaatcccactgacaactcggccccacacatggtaggcccgcgctgtaacctgtaagtgtgtgcatcgtgtctcactcgttaaaatccacgcgtattaattactaattaggaggagtattaatgtattattacacgtaatacccatttttcttctcctgttaattattcgcttccctcgttagggaggaggagacgcgccgcccctcgaatccaaacccccaaaattcccagagaga

SEQ ID NO: 968 - DNA, 1501 bp, Oryza sativa
ttgatcatgagttataatgttcagtaaagatatcaataaaatttggttgtgcaccggtggctccacgtacctaagccatggttgatcatgagttataacgttcagtaaaaatataaataaaatgatatcaataaaatttggttgtacaccggtggctccacgtacctaagccatgattatggaggagaataatgtggtcctctcagttagtaattcaattttagatgagaatcagttgtggaggagaataatgtggtccgattagatgagaatcagttggggaacctaagccatgattatggaggagaataatgtggtcctctcagttagtaatataattttagatgagaatcagttggggaagaagatattagtttgatgagaatcagttgatattagtttgctaagtgatgagaatcagttgatattagatagtaatttatatatatatatatatatatatatatatatatatatatatatatatatatatatgtcgcagaattcacaaagttagcgacaaccatagttattaggaccgccggtcctaccggaaaaaatcggaaccaggggctcagccggtccggtccagtttaaaggtccgaccggaaaaaaaccggaactaggggctcagccggtctggtccagtttaaagatcggccatgcaatcaacctgggaaaaaccgattgaaccgctagtccggtctagtttaaagatcagccatgcaatcaacccgggaaaaaccgattgaaccgccggtttttagccagaaccggtgaaaaaccgagcagataaaccgctaaagaccggccacacgtgggtgagaaagtgccagtgcaggctgaaaccatgggggagcgtggggggatggaagaaaataggagaaaaatatgggcagaggggttcgaaacctcccctttagactcaagaaaccccaccactgagctatgcatgcttgtgtgattggactatatatctcagtttatttaaaccgtcttgggccggcggttgaaccaatcaaaccgtgaaccgaggtttcgaccggttcgatgtccggtccggtcctaataactacggcgacaactagcgacagatggctatgtaaagattatgtggagagaaaaaaaacagttaggagagaagtttctccagttgataattgataaaaaaatttaacaattactaaactaccatgtaatgttaatttctatctctataaactaccctttaacagatcaatggtggatgtttaatagcaggggaggtacttaggatacctccaagcactgtaaaagctctcatctctataatcactaagagttacgaaaaaaaatccctttcagaaaaagaaaaaaaaaagagaagaagaagagatacgaaaaagaaaataaaaatcttgtgcagttcgagatattagcgtcgtgtcgccgtctcaccgcgcctcgtaactcgccgccgccctcaccgcgcggctgctctccgaccgatccaccggagcca

SEQ ID NO: 969 - DNA, 1501 bp, Oryza sativa
ctgaaccacgatccccgtgaactgagggattatgccgcccttctctaccactgtgggtactatgaagactgcctgcaatacttggcatcataccaaaccgcagtggtataatacatcttcaaatgcggtacgttcgatcgatcattgttgaaatcacagcacctctaaatgtcgctctatttgtttcactccaaggctgggcagcattggaacaatccgctggagatcatggaggacgaagcggtgaacaccctgagagcgcgggtaagcttgattttagcagaggatggctggagcagccgcagatcacctgccacgagttactggacgaagaactccgagccgtggtagaattagataggacgatgcgttacatgtgtatacggttttactgaaacaacacgagcttgtacatataatttcgatggcattttcgcaatcatttgtactggatgaagtgagctcatgaatcatgatgatgctaccatctcttccctctaatggttataatgctttctaaattcgctccgcaattgtaaatgaattacagaaggtggtaataatcaaactggagtaccaactatgatcaacagatgcaaactggctgccgcatttcgtgcaccaggcccaccgacgtgtttccacgagcccgtacctggttgcaatccatgaaaatttatgcaaacaggaggatttaggttgaatcacacgaatggaaaaacatggacgaaaaaaatagagaaatagaaaaaagatatgattctaatagaaatgtaaatgtaaaatagatgattgcaaaatacaaatgttattttatagaaataaccgtttaattgaataacaggaaaaacacagaaatcgaataaaagagatggactcaaaagaaatttttcaagagattgaagctctagctaagtttcctctaaaatatacagataacgagccattcgatatgaatttatatgatttgaaaaacttcaatctttatatcaaatgaccaaaaaagaaaatttcttataggatttaaatcctacgaaactcagggccctagcatggattgcagcattcagattttgcctgaaaactgtaaaagttcctgagtactttttttttacgcgtgtccgcgtgtgtgcctggagatgaaccgctcctagtattacgggcttgcatttcatgggccatccaacgtaacggcagtcaaagtgtcaaaaccacgtcgtcaccccacttcctccaatcaaactccgccacgtggccacgtctccccgactttccccaccctcccccaacccccgaagcgcgcccccgcggtcaaacaaatttaattaaccgcggcaaacaaattattactactactaattaccccacgacccgcatcttatatatataaaccccaccccctcacccgcacacacacacacacatcgctctgcagtttcaacctcacctcaccacccaagcgtcgctcgatcgatcgtgccatccatggcgccgccgatga

SEQ ID NO: 970 - DNA, 1501 bp, Oryza sativa
acaagcacatgtgttcttctgaacacctgctggaccacaatgccactgcccccacattgcgcaacagacaaaactgatgaaacgagagagagagagagaatttggtttgatcgcttgcgtacatggtccttgccggcggggagggggtcgacgacgaaggtggggatctcgcccatgagggcgtcgggcttcccggagtggagcacgcgggtgaagcctcccatgtcggcgccctccggccgcgcctgcatccgcttgtaccagtagtacatcacccggcactgccaccggctgtacgcggcgtcggtcgccgtgagcgccacgtggaacggccgccgccgccccccgcccgccgacccagccgcccgcatccaccccggcatcgccaccaccgggtccctctccctccccgccccggtggccgcgccgccgccaccccggagcacgatggccaggaggttgtaggagatcaggaacgcccccaccgctaccaccaccagcaccgccgccggcagccgcgccgcggcggcggccttccgcgccgccgcgttcatctctctgggaattttgggggtttggattcgaggggcggcgcgtctcctcctccctaacgagggaagcgaataattaacaggagaagaaaaatgggtattacgtgtaataatacattaatactcctcctaattagtaattaatacgcgtggattttaacgagtgagacacgatgcacacacttacaggttacagcgcgggcctaccatgtgtggggccgagttgtcagtgggatttagaagcggggtcgtgagggggtcgccggtgagaatgttggggggatgggagtcaacgggattttgtttgtacctaaccagtggcgtgtggtagcgtttgacgcagctgcgtgctgccaccgtgcaccagttgacttggcccactgagcaatgtcgagtttattattattattttttttttggaggggggagggttggtggtgggggcttcgatttttttagctgccggatgtgttttaagattattttttcaacaaccggatgtgttttaagattagtggtagggagggacaaaatttgttagatgcgtgaaactcataacaagggaacacaagcgcttaacgctaatccgtgcgctagtacgtgtttttaaggtattcatataagttactatatagaagttacattatacgacaagcaagatggataaaggagccaacgagcttctcgatccaatcatatttcctgctacgccacctagcctacatcgacatgccacctctctcctaccttctttttcttcctcctccctccctttgctctcttgccacaaacgaggggaagacaggatcaatgacgagcttgactaggggcccatccgtttgactgagctcgagagaagtggggcaacaacaagcttgattggagcctgacctcttggctaaggtcggataggatttttgagtggccgcaagcagatgaggaactggaca

SEQ ID NO: 971 - DNA, 1501 bp, Oryza sativa
agtggacgttcacccatcttttgcatgtcaattaaatgattatgtaaaaatttcaaaaaaattgacaagatgtattaatatgtaatatatcacttcacaaatatacaattccaaattcaacttctataagttgtaacaaaaataataaatttaatcgtgaatatttttttagataatggtttttcattaatccagcctctatatccacgagggatatacacagccaaaaggatagaagagtacttagactcacacctcaataaagaggagaaaacacaaccaaaaaaatgaaaaacctacaacctcgacacatccctacatcctgacatcgtcctctcctgaaacggccacaaccgacaagagggagtcgtctagtgccactgcccctagtgtgttatcgttgcgaatctccactaagtgccatcttcatcagcttcaagtgaagtaatgccactcgctgccgggtagcccaccttcatccatcatcatctggtcagaactagatgaccagacactagctgaaagcatttgcttatgcttcgccagattcctaagccccgccgcccatagggccgccgtcgacgtcggaatcctcctccgctcttggactaccagcccaccgccatctctgctggagttagaggactagcctccgtctctgcccaactccgttgtcgcccaccaagtccgtcggtgacaaaggaggggatagaggactcgctccatctccacccagcaacgctgaccaccaagtccgcagcaccgtcgtgataaaggaagggatagggggctagcccccatcatcgcagcccatcgagtcatccagtgatggaggaagggacggaggactagcccctgtcttcacccaacgccgccgctgctaaccacgtccggcattcgctgatcggagcgcccggctgatcggcaacctcctccgctatcacggtgtcaccaccctcggccaaccggcaccataaccaccgttgcaccatcctgccttgccgccgctaccaccttcaacatcaccaccgctatgctgcttaccggagccaggcgagacccaccatgccgcccatctctaggaaggggactgaggaggaagcctcgtcgccaacccagcggacctgcaccctccggtgacctactccggcggtggcaaggttgaaaagcggtgacgatggtgaggatttaccagattggcaacaagccaactgcttgggactggatctgagaagaaaaggtggaaaagggagaagagagaaagggaaaaggtgaaagggggaggaggaaacagggaggaggtgggtggggacagcgccagcaccaccgccgatggtgccgatggtggcgaggggagaagcgccggggtcaggtcatcctcctcccgggtggccccagagagtgacacgggagtcaaggaggcgtgtcaatttttagagtttaatttatcttgtcattttttttgaaatttttgcataatcatttagttgacatgcaaaaa

SEQ ID NO: 972 - DNA, 1501 bp, Oryza sativa
tcgaagggcgacgctatgttcagggtgtaatcgcgatgcacataagaagaatcgcgtacctggctaacgtgattgccgattccgaacgaatcggcccaaatcctcatgccagcgccgccgtcctcctgaagttgacgacgacgaaaccgagtcgatgacgccagcatgcgccgtcgtgccctcgccgccgccagcacgcgtcgccggccacccgcttcaccgatggccgcagaatcgtgccatcggctttccgtcgtcggttcgcccttgaaaagccagtcgacgggtcttcaatcgaccgcccgcactcgccgtcaacggccgccgcccgcagagacgctgaggagaccgcgcccgcatcccccccccccccgccggcacgcacggcacgcctcccgcgctaccgcacgcaactgggatgggggtcgaagccgccgcggcctcccgccgccgatagccgtccgcctcgccgacccgcatgccgagccaaattccaccggcgcacagcaaggagctgcgtttgccggacgccggatacggcccgtagccaaccacgccggcgtcggtgctgcttgtagcctcaccgccgctccgcctctatcatcgaccccgccgcgccgacgagctccgtcgaccccgccgtgatgacgagccccgtcaacctcgccgcctcgcccgcatgagccaccgggatacccgccgccgccatcgaatcggtggaattaggggctagggtttcaaccctagccacccgattggataaggtgcggcgcccttgttgggccgcatatgggccaaggccattagcaggacgacggtcccgacgggccggttaacctttgaatagccggtacatagaggtgggccgagtataaattaggcctataaaaggagtcgggctcgaatcgaaatttggcccgaaaaaggcaaacttctgaatatgtccttgaattttcaggatacacgcggatttggaattttagcggaatagtccctcgggatcatagaaattacagagaatatcacttttttttttgttattccgtactttcaattttctgtatattaactgtttattagttaatttttgaatcaaccatagaatcctagagacatggtttttaggaaatgagctctcataatttgaaatttagtacacacgagagagcatcatatttatggtttattttcctagctgttttatttttttttcaggatactatttaatgggttagtaattcagtaattactttggtacctaaataaatagtacaacaattctgagaaatgttgggagaattatgggaatatattgacacagtactaaatttggataaccagacaatttactatttgcacacttgtcatgctcttacttgcagtacttattgaattttgcatgactagtgtaggaaaatgactgatattgctaagagagattttgctgaactagcagtcagcagctagaattacctgatatgggcactagatgccaaaatca

SEQ ID NO: 973 - DNA, 1501 bp, Oryza sativa
tttcaaaacatgactggggctattcttattctattacaatcagtaattgaatatttgaatgcaattcaggcttcacagtatcacaaacatatttcataagctcacttcaaattatttgaggtgaccaaaatttccaccatctaaacaaaagtataaactggacatgaagagatacatacatataagtccaaatgcagctgcagtagccgagccagctccagctatattaaatacatcatgcaccccacgtttctcaataagaaggttctgtatgccaaagaaagttgcagtaaacatcccaaggcgaacaccaccaactagcgatcctttggcaacccggatgaatcttttctccattgcatctctcatcaatctatactgctcacgcttgtctgtggtgctccccatcttcaacatcacttcagcgtctttgctctgtaaaatacagcacaataatgttgtaactgaagacatttcattttatttggtgtaaggagttcaggaaaaaaggatataaatgttcacctcaaaatagggacatggttaattatcttaatcaaaattctagaatcccagttctaaaggagaccttaatggttagtacccacttggttatatagattggtagcttgtttcgataaaaaggaaatttctcaattctgctctagctctacaatttcaggtctaaatgatctgtgagctgtgatcaaaagaccaataaaatagttatcagtcgatgcaaccacatatcttccatctggtggccattcatttgttcaaattgtttttaatttcacgcaatttatcatacagagccaatgatagaaagcaggaggcggatagagtagagtagcaacttacgacagaggcgctggcctccttgctcccgccgtagagcagcccggcgaagacgccgacgagggtggcggtaccccagttcgccgtccccaacgcagaagttctcggtggcgtggcaccctcctccacctccccgtcctcctgcatcatcgcccacacccaaccacgtcagaactcgggcgccagacgaatacgcacgagggatcgatacagaccgtgggcgcggtcgaagccggtggattcgtcgccgccgccgccgccgccgccggcggcggcggcggctcggccggaggaggcgccgaggcggccatcgcgatctgctaccgctgccgcagggggaggattcgctcctaggatggtacaaaacagggtacttgtaggtcgctactagtaggcctcaggggcggcggggcggcgccggcggcgagatcacggccggtggaggcgaggcggagatgaggaaggggaatgggggagaaggaagcgaagtgtgcgtgttggggtttagccgagtgggctgggctttcgccattggtgatgggccctgatggtagagcccacggcccacatgttcgctcgatcgttccaccacccaaattcaaacgcgatgatttccccgaaattctaaatatgtttgaatttg

SEQ ID NO: 974 - DNA, 1501 bp, Oryza sativa
acgatatcgtagtcgagttgattcgactagatcacccggcgacttggctcctgtagtcttcagcttcgtaggctgtggtcgttgtgtaggttatgagattcgatcccttaggtccctcgggtgtcccttttatatcgcaggtcaggcggtctccaagtaggacttggagacatcggaccctacacgatataataacgacacagtcttatacgggtaggaatctttccattggcggacttcgtgatggatttccttagcgtgttcagagaacgtccgtatatgcaccgctataccgtatttccatatagcatacatcaaagggtagagggtataccttatccgtaaccctaacaattttgtccacatagctcctctaaatactccctccttccctaaatgtttgacgccgttgacttttttaaacatgtttgaccgttcgtcttattcaaaaacttttgtgaaatgtgtaaaactatatgtagacgtaaaagtatacttaataataaatcaaatgataggaaaagaattaataattacttcaattttttgaataagatgaacggtcaaatattttttaaaaaatcaacggcgtcaaatattttgggatggagggagtatttgttttgtcttgaaattatccttggaccctcttaatatgccatatggctatttctagtcaatatttctattaaaaaaatatcttttttgcccttaatttgtatacaactatatactagaaaagagaaagtcaacatgaataaacaacattacaacattacatatgtacttcccattgtttcaacatgtgcacatgaaacttaagcaattgctatcgtatacacttgctggtacataatttattttggttttacataatatactatgtattatctataaaaaattcaagcatgcaatttttctcttatatatgtgaatgataaggggtataagtgtcatttatgaagagagttgttggttcaaggataagtttgaaataaaataaaaacttgaaggactaatatggatagattgaaacatcaaggactaaactgagccttaggtgaaacttggaggatcactttagctattcaccctttaaaaaacttaaatcaacatggagaagaacaatggcacaacacaggaaatctgaagtagtaccattttccttcaaattcaaacatatttagaatttcggggaaatcatcgcgtttgaatttgggtggtggaacgatcgagcgaacatgtgggccgtgggctctaccatcagggcccatcaccaatggcgaaagcccagcccactcggctaaaccccaacacgcacacttcgcttccttctcccccattccccttcctcatctccgcctcgcctccaccggccgtgatctcgccgccggcgccgccccgccgcccctgaggcctactagtagcgacctacaagtaccctgttttgtaccatcctaggagcgaatcctccccctgcggcagcggtagcagatcgcga

SEQ ID NO: 975 - DNA, 1501 bp, Oryza sativa
aacttgcatgtatagcttaaaaacgaaatgggctctctgtaaaaaaaaaatcaacaccgactgtaaacctactaaatatacatgtgtccaagtttataattaggattaaactttttatggaacaggatgtaatcccttgccatgccaaatttatattcttacggtaaaacttttctcataatctccgtctaaattcacatcaagactataagactaagtagctatataatctagaaaatgagctaatagactattttatattctcaaccactagatacttattagttgttgtcttagaatattgagctcccttaaacatgatcgcaatagaaagtgcgattggaaatattatggtgtcttaggttttttttacttctagaaaatcaagaatttttgtttaaatttctccaaaatcttgtgctaaaattatacgaacttgtatatctcaattagtactttactactaatttattttcctgaaatccgaaatcaataattaacaagttgtacttaactgcttagactcttcttttaattaatctaaccattataactaaaaaaagccatatatttacaatatgattaaaattataatatttataatagtttatacaacatagggattggtgactagtactccttctgagtccaactttaattgtccgtcttgtttgattttttttatgattagcatttatgttattagatgataattgataaaacatgaataatattttatacatgtcttatatttttttattttttttaaaaaaataaataatacggatgatcaaagataggcatagaaatttataaccccgcttacaaagggaccgagggagtaattagttcatgcaatacagggattgatgactagtaataatttattatcaaccgcgccagaacacatgtgaaatggcgattaattagtctagtaatgtagtatatatatatatatactccctccgtcccaaaataacttaacctatatattaacctatatagtgagatgtgacacatataagaacaataaatctggacaacacatcctagaacaacgattgtccatatttgttgtcctaggctaagtcctaggttgagttattttgggacggagggactagaccaatacaagtgactagctctctttgatgatatatacttcctccatcacataaaaaatcaacttaatagtattaagggcttgttcactttgctaccatttttaaccttatcttttttttggtaaagttaaaaaaaaaggaaaaagtatgaattacacccccgaactatcgtggttgtccgaattaccccctgaaccacaaaaccggacattcttcacccccaactatgcaaactggacgaattaccccccttggttcaatccacggtggttttggtctacgtggcgtacgcgtagcagtccagtcagcattgtatttataaaaaaaattgtgggacccacgtgtcatactcttcctccctctcttctctctctgta

SEQ ID NO: 976 - DNA, 1501 bp, Oryza sativa
gtgatattttggagcgagtgtagtgaaaatcacggtgaccgcacccggttttaagcacggagaagggggcagccactatacggtacgcctacgtgctgtgcgcctgtgccgcgctctttttgattggcgtgtgggggcaggaacaggaggaggccggcaatcatacgatgattggccgggttcggtagcgaaaggtggccaggattggtggcgccaccagggagagagcgagaggacagagggagaggtgtgtgtccctgcgattgcgagggggctcaccacttcgagttgcttggcgtgtaacctggtgctttcttgatttggggtattaattagcacatttgattgctgagtcctgtgaccgtaaaaaaatagctggagtgttctgtttcctgacattcaggccatgtttggattagagactaaattttagcccctattacatcgaatatttagtactaactagaaaggtagcccgcgcagttacgcgggcaatttatttattgtttacaaatttaattggtaaattttgagataaatctaatagtttagaaaatttgaagattttttttcctaagagagtaggaaaggaaagaggagatgaggagagtacgtccgtaccaggaaagggtgtggagaaggtgggagcacatactttttttattcgatctaatagttaaaaatattagacccaccaatttaaaaaaaaatcaatggatagattttagagtgtcacttggcttaattcaaacaaattaaaattaaatcagatctacttgaaaaaacacaactaaattgttttatttttttcgcaattacgtagtacatttatcaagtgatatttgacatcctaaaatatgatatgaaattatttaaaattatcataacattaattattatatatttttcccaagaggtggtgatgtatctagaaccgcaatataaaatttataagacacaaatattttatttaattaaagaaatacgacaggatcacaaattgattatataatttaaaataatttaaaagatgaacatttagagataattgatttgatattttttatttatattatagatctagtttatatttgcacatatttgtggagtaatatatttttatatggtaaaaagttatattttaaagaccattgattttgttctgacgttaatatgtattatcgattttaatttattttgaatcttaaattgttggtttaattatgtatagagcaacagttagattagatataatatgtgtagcttaaaataactgtggttgtttctctttatcatagctactaaaaattatagagagaagtggagggggcacaaagtgttgtgcgtatctaatggtgagggtgaggtggaggggactttgtttttctatttttttctaaatcattcaggtcaaaaaccaattatcatgtattttgttttttagaaaatcttttttaattttaaagtcatcataatgagttaaaaaggtaatcttagatac

SEQ ID NO: 977 - DNA, 1501 bp, Oryza sativa
tcacagacgcgcagggacgacgacgacgacgacgattcgacggcgagggcacgggccggcatggcagtgaacgaacgaacgagtcgtacgtgcgtgcgtcctcgatccgccaatgcagggggaggcagaccaccggaggaggggagggtgagctctacgcgaggttcgccggcgaccaccctgccggcgtgccggccggccgcgccgccttggtatatatgttgagccgctaaatcaatcagctatagctagccatcagccgtcgtcttccccgcggttctagatcttcccctcccctcccctccgcgggcgcgagcggcgtcaggctcgttgccgggggaaggagaagaaagagagaactcgtcggagaaggtcgatcgctacggctgcctatttttttgcacccgcccagtggggacgacggcattgaggcatatatagatcttggctgtcccgttcgtcgccctaattttgggcttggcttggcgcgtgtgtacgcattcctagctctccagccagtccatgcatggttgacataacgccttcgcgtatcggagattcagaggggtggagcggtccatgataagacagtatcgcatgcatgcatgcatataggaaggaacctggactggaatgtgggagaaatggcctcaaggagctagtaaacggttagcatatggcagcaggtcacggttataaattacttcttccgtatcatattaagttcattttcaacttatttcatttgtcccaaaataaactcattttagtgtagctattgtattggggtttgtggaagttgagaataattgtattggcagactgagagtagataaagtgatgaataatgagattgaatgtatgcttaaacgcttttgagggagggagtacgaatttatgtccaataaaacatgccatcgtagatagacaaagacgttttagttttctaaaattaataattgcaattaaataacgagtgggttgtgattgagtgagcctccatatctattcttcggttaagagatgcgaattatagtgtagtgttgagagatgcaatatggacttttttttataactcaatatggactttttcctagtaagattatgttatgcctaacaaggtgataacaaggtccctcaacttaacagcgagattttttaacgtcccttaacccttaaccacaaaatcagaaatgtatacccctaaactcactcaaaacgtacactcaagatcctatggtagtatgggtggtttcactgatgtggcatcctagtcagcaaaatatttaaaaaaggatgcggggggccacatgtcagctgcacatctttttttcttcccttttcttctccttctcttctcttttctctcttctctcttctcttcttcagtgagagaggccagcggcgggcggagtggcgatgcgcggatgcagacggtgggcggcaagcgagcgcggtaacggttggcgggtagtggggcaaagcggtttggaaggggagg

SEQ ID NO: 978 - DNA, 1501 bp, Oryza sativa
cgtctccactgaactatccacccccccgccgggaaacaaacaaacgcccctgcgcgaacacgggcgcgatacgctacggagaaaccaccttttccgccccccgcgtgcttgatcccccccccccccccgtgatttcctgcggttttgcggccgccgcgccgcgacgcgtcgcgtcgcgaaagccggtgaaagcaaacgccgcgagacagtggcacacaggcgcatcgatcggggggagaaggggtttagcacgcggcggccgcgcgagggcatgtcggtcgcggcgcgagcgcggagcggaaaacggtaaaagaaaactgccactccaccacgcgccgtccacccgtcgggtcggggaaaaaagtttaaaacgccgagaagaaggctgtgtctagttcaacgcaaagtttagattttggttgaaattagagatgatgtgagtaaaaagttatgtgtatatgacaggttgatgtgatggaaaaggactgaagtttactccctccgtcccaaaaaagacaaaccctggtttccgtgtccaacgtttaaccgtccgtcttatttgaaaaaattatgaaaaaaattaaaaagataagccacgcataaagtattaatcatgttttatcatctaacaacaatgaaaatactaattataaaaaaatttaaaaacccacagtttatcttttttttagaactgagggagtaaatccaaactttaaatctaaatacagccgaaggacgatagcgtaggcgggaggcagaggtcaaacgcacaaacggcgcctcgtggacggtcggtcgtctcgcctgcgggtcagggtctcggggacatgcaatgcaaccgggagttgtgtgcagggaacaacacagtgaccgggagcttaaacaaaagggccacctaactcgcccccctttggagcacatgcccccctgccccacatgtatcaatccatccatccatccatgtgtacttccaatcccaatcccaacgagatcagcaccgtcagctacaccgatcggacggccgacaccactgcgcatgcatgcacaggcgcgagcattcccagcgctgctctccctgtacccgatatggacaaaacgtatggcgcgtacaggcgctcccctagtccggcctacagcttccagccgaacccataaacaaagcacgcaacttgggagcgagcgaggggccgcacagctagccatcgatcgagtagccaggccaccacatcgccgtcctcgctagctggctgtgtcaactgcagcgacgacgaaacgaacgatcgatctcgccggctggctggctagctgctcctcctataaatccccggctcccagccgtccccctccgataccgtcatctcaccacacaaacgcaggcacacaaacacagagagcagcccaaaccgaccaaaatcactgcagagttcaggcacttcttcagatagttctccccctctgtttctttctctctttatttctttctcgagttcagtttgagaga

SEQ ID NO: 979 - DNA, 1501 bp, Oryza sativa
ataggatcttgagtgtacgttttgagtgagtttaggggtatacatttctgattttgtggttaagggttaagggacgttaaaaaatctcgctgttaagttgagggaccttgttatcaccttgttaggcataacataatcttactaggaaaaagtccatattgagttataaaaaaaagtccatattgcatctctcaacactacactataattcgcatctcttaaccgaagaatagatatggaggctcactcaatcacaacccactcgttatttaattgcaattattaattttagaaaactaaaacgtctttgtctatctacgatggcatgttttattggacataaattcgtactccctccctcaaaagcgtttaagcatacattcaatctcattattcatcactttatctactctcagtctgccaatacaattattctcaacttccacaaaccccaatacaatagctacactaaaatgagtttattttgggacaaatgaaataagttgaaaatgaacttaatatgatacggaagaagtaatttataaccgtgacctgctgccatatgctaaccgtttactagctccttgaggccatttctcccacattccagtccaggttccttcctatatgcatgcatgcatgcgatactgtcttatcatggaccgctccacccctctgaatctccgatacgcgaaggcgttatgtcaaccatgcatggactggctggagagctaggaatgcgtacacacgcgccaagccaagcccaaaattagggcgacgaacgggacagccaagatctatatatgcctcaatgccgtcgtccccactgggcgggtgcaaaaaaataggcagccgtagcgatcgaccttctccgacgagttctctctttcttctccttcccccggcaacgagcctgacgccgctcgcgcccgcggaggggaggggaggggaagatctagaaccgcggggaagacgacggctgatggctagctatagctgattgatttagcggctcaacatatataccaaggcggcgcggccggccggcacgccggcagggtggtcgccggcgaacctcgcgtagagctcaccctcccctcctccggtggtctgcctccccctgcattggcggatcgaggacgcacgcacgtacgactcgttcgttcgttcactgccatgccggcccgtgccctcgccgtcgaatcgtcgtcgtcgtcgtcgtccctgcgcgtctgtgacgtctgctgctgactcgtggatgtagcttgattgctcgccgtacgtcgtcgacatgttgctgtaacgagccgaaaacaccagcgaaggtatggatgtgttgcatgtgcgagtcgatcatcgccattggtgtgttgcagtttgcacagtatgatttgagtaattttggttgcatgcatgcatggcagtccgttgcgtagccggccggcctcacctccggtcgccgacgccggaggtagcgtgaattcgttttcatcggtcagga

SEQ ID NO: 980 - DNA, 1501 bp, Oryza sativa
cttcattaataatacttgacaaaagaaaagatgacatacatccatttgcatctcttaaaaaaaatactcgttcgggtatttcttgatgcaaaatcattaatacggtatcgatatcaatattgtccaagacattcttctcaatgcatgcacatagccaagccatttaatctttcttgtaacattgcaaacctaaacgtacagaggaaactgatctttagtatttactaatgactaattagttacttcagtagttcaattcaatggacaatatggttgcagcacggcagcacgatagtacatataaattgaaacccgcagacactctggaagttgaggcagatattcatgttgtgtcggccggtcgatggcgaacagacaaagctgtgaagggctgaatgctgcagggatcggcggcggcccggcgtgcggcggacttgcggaggcgccgtagagggcgctggaggcggattggcggagactgccaccggtagaggagaggagacgagaaaacagaagtttggaactcggacggtcgcgtataagtggcgcttatgcgggcagcgattcaatcagaaacttgtatacgtccatatggtataactaatacataccaaggtctgggcctctacttttcctgggccctaggccatcgcacttcttgccggagcccagagccggctctgaaatcaaataagctatcatcatgttcatccctaccggacacattttgttagattgagtcttttctttcttcttcatctatcaccagaggatggtctctaagtcaatgtgacgtgcaatccttctcaggttggtgtgcgtcaagcaagtcgtgccgctagacgccgtggcgttgcctggtctccaacttaaaaaggatacaaggaggatgttgaaggaagatgtggatatttatatccaatacaagtaaaaatacataggtttatgatatgtttcaaatcatacgcgaattataatagtgttgatccaaataaacaaattataatagcaaattttaaaaagttaaattaactctatcatatgctatactttgactattaattgtaaaaaaaataaaaaaaagattaataatgtaaaattgatgttactagatttattattaaacaaactatcataatatataattttttttatttaaaacattttacttttataaatatcgttgatcaaaatagtatctcagactccgtgttaaaaatctaaaaatgcgctctattgccccaaaggcgcaactgagtcccttgtacgcgtgataagatgccaactcgatcagcctggaaagtggaaacctcggttgctgccgtccgatcggacgcaccacgcatcctagccgtccacgccaaagcccctgggttttcttttctcccttcctctcctccccctcctcttctcctccgccgcatcagcaatctctctttctactagggtctcttctaccagcgattcttcccctcccaccgtccaagcagggccggcgaga

SEQ ID NO: 981 - DNA, 1501 bp, Oryza sativa
ttatctttagtcctggttgggaacaccaaccgggactaaagatcatttctagtcccggttcaaagaacaacagactatgtcacaccttctctattatctttagtcccggttagtctatttcttgtcctggttggtaacatcaaccgggaaaaaagatcggcatacgcggcggagaggacgagacatgtgcaagatcgaggaggaggaggcgggatcagttaataagttctatctcctccctcaccttatctcttcctcctcttcaccccatctcttcctcttcctcctcgtctcctcattctcttcctcccctctcctcccattcacaggcggcggtggctgcgccctcgcgcggcggcggccgcgcggaggcggaggcggcctcgtgcagcggcgaccgggcggcggcaagcagtggaggccggtgctactgcgtggattttttttcttttttccttaatgtgtgattcgatctgtattgaatgtgtgattcgatctgtgttgttattgtgaatgatttggggatgactattgagtgaatgatttggagatgaactattgtgtgaatgatttgggatgaaactattgcttgtgaatgatttgggatgaactattgctgtgaatgatttgggatgaactatattgctgtgaatgtttgatctaaaatgatttccgcaaataacaaaaaaacaatgaaaaagaaagagagaaaaaaaacctccagccgagaccacattgggactaaagatcgatctttagtccccgagtatttgaaccgggactaaaaatagcgatatttagtctcgaattcttactcccggttggaaaaccaggactataaaggggttaccaaccgggagtaaaaaagatttctccaccagtggtatatatataacacatttgatctactatggtagtggcgtgcaaaagattgtccaagatagaaattgcactgtagtatggtctatattaactgaaggaaaagaaatttcctgctttgtcaattgtcattgtcatcgatgatggaagtgcagcacggttaaagcatagcagcaaatagtaaagcagcttctctcttttgacatgggaaagtgttattatttctggtggcgatatcctcttatagtcttatttattgcatgtcatctaaatttatatatctatatacctaacaaaaaaaatacataaggtttccggttatttgttttcgttagtcatcccacttgcgtgcactaaaatctgttttaatccgcttagccacgtcaggcctttttcaatctactccaaaaccagagtttagatagtattttccatgtctgcctacttggctaaggaaggatgttttcacgttgcccaccacccgtattattacttggaataaatctactttgtcctcatctcttgctgctaattgtatcgcaccctcaaccgtaaaacgggtataacacctccctcatcttcaaaaaccggtacaaatcaagttttttcatggtttggagaa

SEQ ID NO: 982 - DNA, 1501 bp, Oryza sativa
aagtatactttaaaaatccaaagtgcatatgtgtatatatagagagagcgtatgcctaagggcccatgtcatggagttgatctagggccctaaaaaatgtagagccggccctgtttgatttatgcaagcttcgaatgggggggagacgccacgcgtatgctcagcgattctgacttaggaccatctaggcattaaaataactccataacaatgtcaaaagacgccatcattgttattgccatcggctgctatggtggttgttgcatgatgttgagttgttcgcggatgggaatctatccttgctctgaccccatccgatggtgatggaaacggagtagaaagaaagcaggttgccttcatcacttccttccctctaggatcgattagatgtagcaaagcatgtacgatggacaactaatgaaaaatattcattttcactccgtcttgcatgtcttggtcttgtggcgtttattgttgccgtctgagcgaacatatcatttctctcaacgatgtgttcttctcccgtttctgactgcttatccttaatattacattgtgtacaaagcaaaaaaaatataataagaaaatagatcatgcgtagagcaaaaggagttgatcaaatacaataaccagagtatacatcacctttcgtgtggattaactcccaattaagatggtttgtctattgtattcttccatggaagaatgcagtatcagtagtaggtctgaaagcttattgggataaattagctaaagagagggtgtagtgtgtatggcgacgtccttttatagaaaatgagggtgcacacaacatagcattaggtgacaagtgccccaatagagctcatcaacggaattgctgctacgcctcaccgaggcaatgctcggtaagtcccaagctccctagagcccatccatttcgtcgtgctaaagtcaacctaaatagagccccacctctaccggtgctccacctcgctagcccccaacctccattggcacttcccttagctgcgccgctccaaagtgttagcccatcgtgccgagctatccttccacatacagtgctggagaatatgaacaggaaaaatcgagaaatagaagggaaagaagaaagaaaataaatgcaattatatataaaaaaagcaaacaaaatggctaagcaataacatatatctcataaccgtgaaattataacggatgtgttcaaatttattttaagatcggaaaaaaattagtggcatatggatcggattatttttttttcttacagaactgacatgtgacgattgaccaacactggcacagggacggtccagatgaacccacgtcctagccgtcaacggcgtaggcctcttcgttccgcctccgcttatccgctctcggaggccgcatccactcacccagcttcgctcgctcgctcactctgccccccggactgcctcagccatggaggcggccgccgccttctcccctccccgcgtctcccccgacgcccgcgcca

SEQ ID NO: 983 - DNA, 862 bp, Oryza sativa
ggtcaaaaggggtcaattctggcaatgagtgaaaaatgatgagataataagcaaagttcacacttaaacaaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataatcgttgataaccactcatcatatagctctgaacaatattaggttagccatacggacttatgtaaacttgtacaaactggccttggatgtgtcaaggaagctgtgatgcaattatatctctttagtttgcttcttcgcacatactattgattttactacttcgaatcattacgacctgataacttcttatatgattggtcgagtgacatgttggctactttgatatacacagatattattttatacttcccattaataatattaggttgttattgttattagggtggccagtctatatgtatcagt

SEQ ID NO: 984 - DNA, 1501 bp, Oryza sativa
agaacctgtgctttctctaaaaatgatttggttgcaatctatacgtatatatatatgcatgtattgcctagatattaatattgtcgatttatggtgtatgggtagaacctatttatgcatttagttcttgtgatattgctgtccttataccccattaccattggttgggattgcttgggatgtcttattcattaatgcttagccatgcttagtgctaatagaactatagtgatagacagtgctattaattgtggtatatagacaacttgcattattgggcataaaacttgagcacttacactactaaataatggttgatgaaatatgttggacttggacgggtgatagggcaatgatgggaggttggtttcccctgatgcaagtagccccgtctaggttgttaaggactgaacattttgacatctaatcaagcaccctacgtacttatcacatgccttattttgggaccggcttgttcttactagttctattgtgatcatttataccacgttggagagttgtgaggcaggtagcctttggagggcctcgggtgcctaggtttggccgggggtgcctcccgcgtggcgcgcccgccttggtcacatcacgcacgcacgtgactgagtcgtcgggaaggctagcgtggtataggtggttggggtggggctaagaaagggcatgtaatgagcttgaatcacttgtgtaccgcagttgacggggtgtgtagcatttgatctttgttcatttcgtgtgggaccagttgtacacctctgatcagagtataatctattcgaatagtcgcgtcctcggtgatggacaatgcttgatgtgttagtcagttatgttagcatcaaatgtggattattatggatgggattatgttcgatggtggtgttggcatgttgtgccatgttggtatagactttggtagtccatggttgatgatgagagcgccgtttgggctcatttgcttatacatttcagaattatatacttgctgtccataaattaaaatgatgctagatttacttatccttgcttattttactcattaattgctcaataaaattagctttatgcaaatgttgaacctagagacccactatagcctagaaagcttgcatacttctctctcccttatgtatatataattttgggtaagacttgcgagtacaatcttgtacttaacccggtgtctgcaatttcaagagaggattccggttatgagttatgcttcttgtgtggtaattgcttagacgagggcggcgagggcaatgagtgatctcttgcagcttggctcttgcccggttggtttgcattagtggggttgtggcaccaccggttttatcttttgcttatgaactctatttgagacttccgctgctatatttatgtgttgtatgttgggacctcggaccctattatgtgccatgtacctcgctgcactttaaccctattatggtacttgctatgtttttaattgcttccgatgaaagtgtga

SEQ ID NO: 985 - DNA, 1501 bp, Oryza sativa
tagtctagaattaatatgtatgagaaaagtgaatgcttctgcttagtgtcaccctacccttttggattatattaactcttgtttagactttgattattacaagtaacatataaatattagcttggttctctccataataatctttccaaaggattaaacaaatacgatacccttggaatactctcgggtgaaatgctacaatggtatatccgtgcgcttgcggatgaaatctgtaaccgtaatatactaagagtgtttctgcgtcattgctggaaattatatttttgataatgtcgttaagaataccaacacgcggtatcctacaattaaaaccgcgaagtcatgatgtcacgtaacaaaatttaccttttttagctacggagtacgtgtgtaacgacttgtctttaagagctgctatagataaaatttgccttttttagctacggagtacgtgtgtaacgacttgctttaagagctgctatagatacataattaactgacaggtgttggctgccggaattgttataaaaatctgtcgatagatttttaacaaaataatctgtcaatttttagactacggtttaagttaagattagtgctagggtgctagaaaaatgcaaccgcgcgagagagctggagcctggagggaggaatcgagcgcgtggacatcatgcgctgctgttccaagctacttaccaactgagctagcaggtattgatggttttgttgcaaagatatatttatattaaaattaccgccgttacactatatttacaatgtaaatacactataattaaaaataaaacatttatttattatgatgtaatttttttatctggattgtaacttttctactacttggtgtaatttctgttgttgttaagcccagtagttaactagtgtgtttttttcttcctttttgctagcgtcagataaagttccatggtattagagcaggtacaatagtaggctattagccagctataaacatattttaataagataaaaaataagagataagagaagcggactacagatttatagtcagctgcagcacggactctaagatgcagtgtgtgtatgataggtgtgaccatatattaatagtatagtaagcagctgttatattgtgtgaattgactattagatttagctatatataaattaaagctagtagtgagctatcctattaaacttactcttaacacccgtacttgaatttgatagttttaatctgaggcgtacgtagctatttggtggcttgaaaatctgagtgatttagcagccagccagtcacccgtgctttggatcagcgaacggcagccactctttccacatccccggatcaaccaagcgctgccttccaatgccacctgcgatttggttatttatagacgtaatggattaccacacaggtcctcaagccactgctgcagcgtgactctgctctagcacctcaccaagcagaaagctagagagctagcaatggcgcccaccgtga

SEQ ID NO: 986 - DNA, 1501 bp, Oryza sativa
catgtatgcttggtaacaactgacactatccaataatccttccatttccccttatacgcgtgcactcttcagggacaaccatctttttccttaacacaccgaacttcatattgcgaccggttcgacttggcaacccaaaactctctatgaagtgacactgcaaaatgttttaccgcctccttcatatcttctgctttactataaatcgctccctgaataacctcattttctttgtactcccatctcacactatcctcttcagagacgatcagcccagaaaaatcctcactagcccattcttctggattaatatccgtctcatcatctgacgaatcaccttcctctacacgctcgttgtcagaatcctccctctccattttatccacaatggcaccgacagtctccccctcgtcggccactccacctggttgaatgcccactagagctactacgcccccgtcctctcgtgcgttgacctcctccacagaagtctcgtttacttcagcacttggtccctcaccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaacaatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtaaaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttcactggaattgaggagagaagaatgagggctgggggctgggcagcaggccttttataggcagcgaggcctgccacccggctagagggcggcaaggggctgcctgcaaaatagccggccccgactggcttttttgcattcgggccccttgccgccccaccagagagcggcaagggttttcctgcaaaaaaccctccctccgtcaccgcccgttcctcccccgtttgccacgtcagcttgccgccccagaggtgggcggcaggggctatttctgcaatttttttg

SEQ ID NO: 987 - DNA, 1501 bp, Oryza sativa
cacacaaaatatgtagttgatctgcaaacaatggagtcaacagttgcagagatcaaccgtctcagagatcaacaattatacccaaaacttcttgaacttgtgaaggggtaagcctttttcaatgatttctccttctactatgaataacaacattgctaacgaaacaaaaaagaacaatagatatagactcaagagaacttaattgttttgttttcttacattggcagaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataatataagttcttttgttgttgtaatctttctttctttttgtttatgttcataggttgattagttgttgtatattgatttttggcttgtggtgccgagattaaaaaaaaaagaatgatcctttttgagctactgttgttaaaattcgtagtatagatataggagttttacttttacattacatggtatttgaaagagggaactgtattttttgtttcatatttgataaatattgtaggctttatcatgatgagttgcaacaatagaaggaaggtgattgctttaatcttatatgtgtttggtgtgaatgatgagttttgtgaaacagatggtgtgtgagttgatgttttgatgatgtgacaaatcagcacaagcacaagaacctgtcgatggaaagttgaatttgttattgccacttcaatcactgaagtttgatctgaatattctagtgtttcctgtctctttatttatcaagtttgatctgaat

SEQ ID NO: 988 - DNA, 1501 bp, Oryza sativa
tgaagagcatacatgggcacttcatgcatattgtgcagactgtaaaaagtaagataaaccatatagtacttccccactatgagcccacgcttcatggcgacagagccgaccttagcggcatcaagggcccatatggatgatgtccataaatcaagggacatccataacgacacttcagggtcgtgtagaaggttcgtttgcctccgatatttggcggcaacggcggcagagccgtccattaagttgccatgccggtgcttcaggcacctatatcacctctagcatttggacgataacggcggcagagccgccattgtgttatcaaatagtgctaaggggatgtaccatctcaagcctttggacggtaacgacggcagagccgccatcatgttaccgggcgttgctaagaggatgtatcaactctagcaattgaatgataacggcggcagagccgccatcatgttatcgtgtattgctgagaggatatcgggggatggtacttcaggtaccatgttcttctgcttatttcaactataacagaagaatgatttgcacataaagagcaagatgatcagtagaaactgatttctcacatgtttacctttttagcttggtagagtctcgtgctgataacgtgttgagaaaccagtcgattctactgatcagcacacaagcaaaccaaacacagagttgtggaacacaaaaagtatgagcgagtggaagctttatttcttctggatttgagtacaagctacaagaggagaagcaggagaccgaagatcggttgtcctcgccttggaccttatgggccctatttataggcggagggtggaggcttacatcgtaagccttggaccttctggcttgtgccgtaagccggcttacgctgtaaactggcttcctctgtaagctggcttctggcgtaagttttcttctgtagtaaacttcccacttataatttaattcgtcgataataagataggtttcataacactatagacctattgctacgaatttcacaactttaatgaaaatctgtattactcggaggttctgaaaccaggtgcaattgttataaactccccaaacacccccaaacaggaccattatcacgctggttctttcaccccttagcaagaaaaagaatgactaactttcgagcatgacacaaagtgttggttttgaaatatggatgattataaaatcatgataaagtaagatccataaattggatttgaaaggcttgaacaagcgactggatccatactagaaaagctttagagaggagctaatgaaaatgttaaattacgatcaagtccctttgaaagacataatcaaaggtgcaattcattggttggagccaggaaatgggttcgctatatcctcgaagtttttatatcaccgaaaccacatccaattttttatgttactttacttttaaattaatttaaggttttctccatcagattcgtttattaagcattggctttacaacagctta

SEQ ID NO: 989 - DNA, 1501 bp, Oryza sativa
agttagtcattctttttcttgctaaggggtgaaagaaccagcgtgataatggtcctgtttgggggtgtttggggagtttataacaattgcacctggtttcagaacctccgagtaatacagattttcattaaagttgtgaaattcgtagcaataggtctatagtgttatgaaacctatcttattatcgacgaattaaattataagtgggaagtttactacagaagaaaacttacgccagaagccagcttacagaggaagccagtttacagcgtaagccggcttacggcacaagccagaaggtccaaggcttacgatgtaagcctccaccctccgcctataaatagggcccataaggtccaaggcgaggacaaccgatcttcggtctcctgcttctcctcttgtagcttgtactcaaatccagaagaaataaagcttccactcgctcatactttttgtgttccacaactctgtgtttggtttgcttgtgtgctgatcagtagaatcgactggtttctcaacacgttatcagcacgagactctaccaagctaaaaaggtaaacatgtgagaaatcagtttctactgatcatcttgctctttatgtgcaaatcattcttctgttatagttgaaataagcagaagaacatggtacctgaagtaccatcccccgatatcctctcagcaatacacgataacatgatggcggctctgccgccgttatcattcaattgctagagttgatacatcctcttagcaacgcccggtaacatgatggcggctctgccgtcgttaccgtccaaaggcttgagatggtacatccccttagcactatttgataacacaatggcggctctgccgccgttatcgtccaaatgctagaggtgatataggtgcctgaagcaccggcatggcaacttaatggacggctctgccgccgttgccgccaaatatcggaggcaaacgaaccttctacacgaccctgaagtgtcgttatggatgtcccttgatttatggacatcatccatatgggcccttgatgccgctaaggtcggctctgtcgccatgaagcgtgggctcatagtggggaagtactatatggtttatcttactttttacagtctgcacaatatgcatgaagtgcccatgtatgctcttcattttgttttacatgcttactttgctgtttgcatgactttcataacatttattttattgttatgaaattgatttccgagcatgattaataatagttaatcaagcaatctgtaatcctgaagattacttaagttaatttgctaggaaagattctatgggaaactgtgtgataatcctaaagattacacacactagtaatcctgaagattacgcatgaccaatttatgtcgaccctgcacatcgtatttacctgtcgtaaatactaaatgatgttgcagaacatgtcggacatagtaaagaaggaattcaccgagcttgccttggatggtagtaactacctcacttggg

SEQ ID NO: 990 - DNA, 1501 bp, Oryza sativa
cacttgaacttacagtggctatcaagctggaaaagtggataggttaggagacacgaggtttatataggttcaggccttcttgatgagaattaataccctactcctatccagggattgatccgccgagtgtattattgatcatatgatcaacgagaaaagttatgcccctagaggcatccggacccctccttatatagggggaggagccggaattacaagatacagcccatgttcctaacgtactaggcatgtaaagataaattacaatcataaccgactaggactatcggatgtttccttgatacacaagttaacataacaaccgggtcctttactaaatttattctatatgtacatggtacccctatacccagtcggatatacatgccgtgtgggtatggggtatccataatctccacagtagcccctgagaccttcgcagtcgacgagataatcttctcccgagccattaaacaaaaatcctgagtgcttcaattattgccgccttggcctcccgagtgcttgaatcaaaggctgtgaagagctaaaaaataaaaaattaggtgcattgattagatgcaccccgactaaacatatagtgaacatatagtgaaggttgaaacaaataaccatccgagtggttttataaataatattaccgaagtaattaaatattaaacatatgtgactccattcgaagagtttgccaactgatttaattaaatcattaagctcactatgaaacatagaagatatataaagatccgagtgataaaagcattctaaagatctatcgtctatttcagagctaaatacatcatttgtgataaaaaatccgagtaaaaactcataaggatttatcaactgctgaataaatactgaccgacaagtttaaccaacctaagttgtaacttgagcctatatcagaaaaatgaagcatataagtgctcagaaggaacaacagctttaaaaaccactcgtcctgattaaaccctaatagctttgtgaccttatagaaaaagtcaacaaaaataacatggcgtttttaactgttgggcacctttttgtatgcatcgtagtaattccaagaaatttactaactgcggaaaaaggattttaatggtatcgggctttatttattatgggcaattttgcctgagcaaaaatacgcctaagtcccaagagaccacaatcagccacaccgagagtgtatttgagctgaaaacactgtttgggcctaggcccattagcattttccgatacccatcgataaaaatcgcaccgaaggaaaccccatcgtcttcctcgccacaacagccgcgcgttccccattttttgctacagtaacaggcttgcgccgccaaaagctagggttcgcaactgtaccgcaatccacctccttcaaatcagcttccttcggcaaaattcctccgcacaacccctgcccccaatttccctgtcaatcttcgtgctctaaatctctccaccccattttcatcca

SEQ ID NO: 991 - DNA, 1501 bp, Oryza sativa
ctgtaagtattttacgctttatttacgtttgtacttgtatattaatttgtcgttttgtgtaccctggctaattcctgaacaaggatttaatacacaaaatagtatgaaattttgggctaaatttctgggcgtgacagacatcaaagtaatttgaacctcaatcttaactttgctaaacaatatagaatctcttatgtttgtgaacggatggagtatgacatgaatcattgttataaatgactcattcgagcctaagcacgccaagttcatggagagagagagaagaaaatgtaagctattgtggtttcaacatctctttggtgtgaaactcgaaagatattattatctgtgtaaaccaaggtacctaggcttcgaatttttttatcacaattttacgttcataaatcgagttcaaacaattatatatggtcattaatttttttcagttctgattattttttttccaaaacaaaattggaatccctgatgtgaagtgcatcaggcccataactgaacaggagaactatagtatgctataggaaaattccttatatatatgtcactagaaatttaccaaacctcaatatgcctccagattttttgttgaaatgtagtaattgatttgtcagttttattccaagtgacagctctactcatcatctgaacacacatagcctctgctgcgccgtagtggcatggaaaaaacacatcacaatagtacatgcatgatatttatgtgattttctttcaagaaggatgaatacatattatatatatacactagttttatttagctggttttggctggtaccctagaggtggaagaatacaaattatccatgatagaagaaaataattgggatattgaagggaagcaaaatagatttcttgttcacctgatttgcacttgtttgaagagatgaagagaccatgctgccaactactttggtagatgaacatgcaagaaaaatatagggtcatgtccattgcaaatgagctgagcttagctaggatagcctccaaaagaaccgaagccacaatggtattagcaagtgtttggatatagaacattctatcagctagcacttcagtatcaataaccttcaagagataagaagttgaggtagcaaaccttgagagtctctttattatcagatgtggacctgttggaaacttaacttcctcgtagttcttgtcgaaacattatctcggcttcctcgtagttcttgttgaaacaatatttcggcaaaactaaaaggggtggctgtaggatcaaggaggccgactagagggggggggggtgaataggcggttttaaaacttttggctaaaaccgaattttgtatgcggaagcgtaaatcaaaatggttttgcacaattcaaaacctaaatcaactagtctcaagtaagtgcacaaaaaagctagcctatgttaaggtttgcaagcttagggtgataatagcacaaataagcttagtatgtaaacttgctcaaatgtaaa

SEQ ID NO: 992 - DNA, 1501 bp, Oryza sativa
gagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccg

SEQ ID NO: 993 - DNA, 1501 bp, Oryza sativa
tcactgggatagctctcaccgtctggtgcggcagctttggtggaattgggcagcccgaaggcgttgtcccctttccccttcccggcttcatcgtcggaatccgagctcagggagtcgtcggaggagacttccagcggctcctcccacggcgccgccctcttcatacctagccgcacccggccaccgccacatctaggggggttagcgtcacgccgttggcgaacggtggagtcgaggccgtggatgatgatgagcgagggggggcaatggacgggtcctcacctggatcacggagacgtcaccggcggcacggcgcgccgagggagaagcggcgcggcgcgcgagggagaaggtcgctggctcgctcgccgtcgcttgtcgccggcggcggggacgacgaggccgaaaccctcgattgctgtgttgggctttggatcgctggatgagggtggagacagaaggaaaaagtacacctaaggtacctcaacttgtccgcgaaaccatatatgggcaccatggtatcaaatgcataaaatcactcaactttttcaaaattttcaaattattagtatataccaagttataagaatttgatttatacctacacctatcaacaaaacaactcaaatttaactttatctcacaatccataattacatacctaactaattatatgtttggatgctatatacatagaatcaaaatctaatataacaaaaacaagtttaaattcagttcaaacttgctttgaactagttagtaaagttgttaatgttaatacctaaatatttgaaaaagtttcatactcatttgaattgggtatatactcaatttcaacaatggtgcccgggcaccatggagcaccaaacaaatttaatatatatatatatatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattcttttttttttgaaaattcggatcactgcgctgtgttctgcatggtgagtcattttgaatgttctgcatgcatggtttgttacccgcacgcatgcacgaccgagcgaccaggagagtagttagtgtggaggctgctgtattgatactctatttaagttgacggtgatggaggacagaaaatgaggaccacaattatctttcggatttgtgaggaagaagattttgttctacaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgcgtcgtcgccggtgagtagtagcaagcaccatcatatggcgaaggca

SEQ ID NO: 994 - DNA, 1501 bp, Oryza sativa
attgcccaactcacaataccatgttaaatttggtccctcggtagtatagtcatcggtttttgctgacgtggcgagtgggaccactactatgaaatatcaaataggtatcagcactataggtgccggaagtgctaaaaccgatatctataaaccttttcccactaccgcgggttgaaatcgcaaaaaacatgcacctttaaacaattataggtgccggttctaaataagaaccaacacatattctataggtgccgaaaaaccgacacccatagaaatcgagccgagccggcaggccccaccacaacgagtagataaggtgggtctcgcatctctctctcgtctcctcccttctctctcgctctcttctcctcctctccaactcccagtctcccacctctctctctctgaggaagcggcgggctagccgcggggaggcatctaccggcagcgggctcgcggaggggatgcgacggaggactcgctggcgggaggcggtgttctagccatggggaggagccctcctctccgccatatctggtgggaggggaggcggcggcaggggcagcgggctcactgggggtaggtggcgtcaggcgcgcgggctcgatgaggggaggcagcggagggctcaccggcgagagacggtgatcttccgcggggaggagccctcccctccgccagatctggcgggaggggaggcagcggcaggggcggcgggctcgccgggggtaggtggcggcaggcagtgggcttgcggaggagacgcggcgatgggctcgccggaaggaggcggcgggcccgcggaggagacacggcggtgggctcgccggtgggaggtggcaggctcaccggtgggagtcagcgggctcgtcgacgggaggtggcgcgacggctcgaagacgaccgaccgtgcgacggcaacgatggcggatcttaagaggtgtgattcttttttttattgcataaatttgagtgccaaaatttgtgttgtggatgaatgttggatgaatgttgtgtctctagatggacgaccgtacatttccatgaattcatcttctagctatcatttgccatgcttgtattagtgcatctttaagggtacgtacgtattaatctttatcaagtacgtcccctgtcttcttcttctggatattttattttctttgcacgttgggtaatctcgtcatttggaataaaatatcacctcttttgatccggaaattataaaatattgtcttcggtgtcctacagttaattacataatttttagagtgtccatcagccgtgtcatgtttttgcgttgtctctcagccaattacacattttttttagtgtcttgtagtaaattttgcatttcggtttagggatgaatttcaaactcagcgataaatagaaggatctaaagtgaacttttccttaaaacggaccttgtagaaccggaagttttgtatcctgcttgctcggcccatctacagatggaatacggccgtagcccgttaga

SEQ ID NO: 995 - DNA, 1501 bp, Oryza sativa
tccctcggattcgtttggaaacccctcccctaacctcgccggcgccatcaatggcgggcggatcttccgcgcccgtttccccctcgtccggccgctctcttcccctcccaaccctatataaaccttccccgtgcctcccttcaccggttgcgccactcgccgacctgtctccccgtcggaatcgagctcgcgccgtcgctctctctctccgccgtcaccgccgagctccggtccgccgccggcgtcgccccggaccacctcccgcatcggcgtcgccaccttcggcttcaccgcatccccggcgacctcgtccacccctccgtttcgctcgccgaccgccggagcaccgtcgaccccgtccacccgagccgcgccgccgctttgctccgctccggtcgccgttcccgtcgtcgccgtcgacccggggtgagccgtggaccgccgattcgtttcccccttccctcccctttctcggccgccgctccgccgtacctatggccgccgccggcgaccataggggcgcgggcgcgccgcctcccgtcggctgtgccggcgtggccgccttcgggcgcgccccgcggctgccgtgtggggcccggctgtcagccgcccgcgcccttaggtgcggctgacgcgtgggacccacggcgccggcaggtgcgagcccgggtgcgcccggtccaccgtgggccgtggggctgccgcgtgggccccaccccagtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttcttagtgtaaaagccttttcttttccgttggtcgtgtagacgctgcagcttcggaagatccgctcttcgtggaagttgaagccggcgtttgggaaagtgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttatggttattattaccttgttcaccctaggataaacaaaaccccaactagtgggtactctattcatggtcccactagtatgaatttaggtagatgcttcgctgattaattaggcaacattaggtggttttataactctagactttgggatattcatatcacctggacactttggaattgttggagtattgtggaattggattcacaccgccccctctattcaaaatccccaaaaatggttttaggctgggctcggggtgcatggttttgatagtagcacctcggccatataaggaccggt

SEQ ID NO: 996 - DNA, 528 bp, Oryza sativa
ccgacccctcggggagacagagggaggggtggccacgtcaccctcgggcccgacccccccgagggggtcaggccatgtgggtgaccgcggctgcccaagcctctagtcacgatacccccggtcccatgtcaccgacaatgtggacccctttttttgctgatttggatgccacgtcaatgaaaaccacccatatatactgccatgggacctcctttgaacggtttgagtgagtttaggggtacacatttctggttttgttgttaagggacactggtggagaaagcgtttgtagtcccggttcgtaacccccctttaatcccggttttcaaaccgggactaccaatccaggactaaagatcgagctgaccttttttttttgcatggccctgttgctgcatggtttatatatatatatatatatatatatatatatataaaaaccatgcatatatatgtttcaatacatatacatgcataatatatatgtatttatacatatatatatatatatgttatgcaaatgcatat

SEQ ID NO: 997 - DNA, 1501 bp, Oryza sativa
tcttcttttttttatctatctatctatttatctatctatctatctatctattatattattaaaacagctttgaaaggacacaccacattcgttgtgggggttagacattcccacattaatcggataaaaagaaaaaaaagaaaatgagagtccaagtagaaatacaatctaaaaatagctgaaatttagaattaaaaataagctatattagaagaagtttccatataagaacccaatacaagattaatcaaaattcaaaacaaaaataaaaaaatctaaaattagaaaaaaaaaggagagtccaagtagaaatacaatttaaaaatagctgaaattcggaattgaaaataagcaatattgaaagaagttttcatataagaacccaatacaagattaatcaaaattcaaaataaaatccaaaattaaaaaagaaaatgatagtctaagtaggaatacaattttaaaatagctgaaattcggaattaaaataaggaatattaaaagaagagtccatataagaacctaatacgagattaattaaaattgggaataataataaaaataatatccgaaactataaaaaaaaagaagagttcaagtaggaatacaatttaaatttagctaaaattcgtatttaaaaataagcaatattgaaagaagaatacatataagaacccaatacgagattaattaaaatttagaataaaaataaaataatatccaaaattagaaaaactaaaagagagttcaagtaggaatacaattttgaaacaactgaaattgaaaataaaaaaatatattaaaagaacacaatacgatattaattaaattttgaaaaaaaaataaattttgaaattagaaaaagaaaaataagatttcaattaggaatacaatttataaataactaaaatttatgataaaaataaagactattgaaataaaagatcatctaaaacatatgacgggataaattaagtaacaggcctataaaagagtagagtggtggcggttgatacgacatataaaaactattaataaagcactaaatagaatcctaatgacgattaaaaggaggatgacagatagttcgtgaagtaaacgagcaaggcgattaccggaacttctagaaagtaaaaaaaaataaaccccattgataatcatattcgatttttaaaatctcaatgacaataaaaaggagaagcagcaggcggtgtgtattggagtatagttatagagccgccgacgattgacgggacttctagaaaataaaaaatgaattccaacgatagttatgtccggttttagaatcgcaatgacaataaagagtaggcggcagacgggccgtagagaagcaaagtggcatcgtttgacgagacttctaaaaattataaaaaatgaaacccaacaagacaaataaactctaaaagctacaaggttcaatttttaaaggttcagaacttgtaaaaagtaaaaaaaaacaatgataataatgttcgatttt

SEQ ID NO: 998 - DNA, 1501 bp, Oryza sativa
acctttaaaaattgaaccttgtagcttttagagtttatttgtcttgttgggtttcattttttataatttttagaagtctcgtcaaacgatgccactttgcttctctacggcccgtctgccgcctactctttattgtcattgcgattctaaaaccggacataactatcgttggaattcattttttattttctagaagtcccgtcaatcgtcggcggctctataactatactccaatacacaccgcctgctgcttctcctttttattgtcattgagattttaaaaatcgaatatgattatcaatggggtttatttttttttactttctagaagttccggtaatcgccttgctcgtttacttcacgaactatctgtcatcctccttttaatcgtcattaggattctatttagtgctttattaatagtttttatatgtcgtatcaaccgccaccactctactcttttataggcctgttacttaatttatcccgtcatatgttttagatgatcttttatttcaatagtctttatttttatcataaattttagttatttataaattgtattcctaattgaaatcttatttttctttttctaatttcaaaatttatttttttttcaaaatttaattaatatcgtattgtgttcttttaatatatttttttattttcaatttcagttgtttcaaaattgtattcctacttgaactctcttttagtttttctaattttggatattattttatttttattctaaattttaattaatctcgtattgggttcttatatgtattcttctttcaatattgcttatttttaaatacgaattttagctaaatttaaattgtattcctacttgaactcttctttttttttatagtttcggatattatttttattattattcccaattttaattaatctcgtattaggttcttatatggactcttcttttaatattccttattttaattccgaatttcagctattttaaaattgtattcctacttagactatcattttcttttttaattttggattttattttgaattttgattaatcttgtattgggttcttatatgaaaacttctttcaatattgcttattttcaattccgaatttcagctatttttaaattgtatttctacttggactctcctttttttttctaattttagatttttttatttttgttttgaattttgattaatcttgtattgggttcttatatggaaacttcttctaatatagcttatttttaattctaaatttcagctatttttagattgtatttctacttggactctcattttcttttttttctttttatccgattaatgtgggaatgtctaacccccacaacgaatgtggtgtgtcctttcaaagctgttttaataatataatagatagatagatagatagataaatagatagatagataaaaaaaagaagaacaagaagggaatagggcctcatctatgtcgctccctctccagggcgaca

SEQ ID NO: 999 - DNA, 1501 bp, Oryza sativa
acttgtttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggtgttggggcgctcggcgtgcacgcggcacattggggcgctcctctccggcagcctgcagcctgacactgctataccgtaccaatgtcaggttggtgctgttcatcgtcgccatggccggcaccacattcactgcaaaataacagatgaatatggcaacaaaccttggaactggagttctccatgctagacctttcaatgttatctgcaacgcagccgccggcgaggctactaatctgagtttagatgggttaagaactctcaaaacgcaaagaacagttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagtgatatatatatatatatatatatatatatatatatatatatatatatatatatatatatataaaacgacgcttaacacggtaaccagacccacccccactccacccattttgattatgatatttgactactacacgtcctcagtcccacgtgctgcgcaaccctcctccctctccccccacaccaccaatgcgtatccccatagtaccacacatattgattcgcgagttaaatctttactactacatagctcaccatacatactcatatttagtcagttaaattttatctaagtgttattcagcaactataataaacatcacgtttagtcatgtatatttttttttcaaattttttaggaatcattttgactcacattgaaacaaatcagttattttttaactgccatcgaaggtagtctcttttttttttcactccaactcatccgacactaagttattttttaactatgaacacaattaattgttaactacgagccattttttttaattttttccaggcacaatgtatacagcagcgatttttcagtcatttcaaactattgtagttatcgtctccccacttttttcggttagttttttttttctcgccggcgacagtg

SEQ ID NO: 1000 - DNA, 1501 bp, Oryza sativa
tcatactaaagcttttacacattcccacctaaatttacattctagattcatcactaggtggccgatgtccgggtagcttctgacgcagtggtcagcgcgcatgcagcggttgtttaggttgccggtgtagaagcagatggcgccaaatataggggagatcgaccgccaggctaagccacatgctctacgacagcacgtactgcacggagagcatccccatgccggctgccatcacgttgctcagattgaagcagctcttcctaaaggaagcgccagtgatccaccagtagggtggaggggcggcggctgctccacgtcgtaaaccacctcatcgtgtcgtagatatatttgctaatattatttagtaccattttttttcttattactatttataatcttgctcgcaccgtttagatgttagtattaaattcagtgttattatttgctccttctaattatggctacctggtttactccactatctcatacaaacaaatcacgtaaaatggaacagaagttgagatatcgaaagaacttgtaaactaataactatataaaccatattatacctcttaaatgttaacccattacgtatttataggaggcagtaacctacccagtcatataacggcgctagcggatcatacagttttcaccctctttctatgcacacattccacactgccagtaacatatttttctttcaagagagaagttgtttgagttcttgcccaccaactttgcgtgaggttctctgatgggctctcctgtaactgtttctcggctagcaggatgggcctcggggccacggcccaccgtcggtcctgacgcaaaggcgctgagatggtattagtactaggattttcttttgttttcatatttctttaataaaatgtttacaaaatataatggctttaaaattagacgtgactacacagctagtggtagctggtttgtctaaaccagctaccactccatataagagagatactatccacttatactttaaatacaattttctcttaaactactaatccgatctacgatccgattgcaccgttatattcgtaacaattaaatgtttataacaagatcttacatgattatattttaatgaaaaattataaattacttttatcatatatctaaattacttttagatttcactaaattacttcttagacatataaaagtaaattcaataaagcctaaaagtaatttacatatattatagaagtaacttatgacaaaaagaaaataactttaatgaatgccttttttcattggacatgtagtcatatttttattcctataacgaatttacttttaacgtcgtgacaaagttacttccaagttgttttaagttacttttataatatatgtaaattacttttagattttattgaatttacttttatatgtctaagaagtaatttagttaaatctaaaagtaacttatatatatatatgataaaagtaacttacgtatataataaaagta

SEQ ID NO: 1001 - DNA, 1501 bp, Oryza sativa
tagcatcgtattgaaattaccactaaatagctaaactcataatatatgaagatttttttgaatgtttctataaaattaataagaaaatgatatcatttttgaccgttttcatctctagctaacgggcaacattcccctcacctcataattatgccattacgtttacgcaccatacaaccatctacctaatagctagttgggctgaaccagcccattaatagctgaccacttgcctaatctaaacagaagtgaacaacccaattaagtagctaaacaatcacgacacaaaattttccgaactgttgagagaatcggaagtccagatcacctagcgcaactccgatgggaaacctgcagcgttttgctcctatctggacatcgtgtacgtgtggtcgatggtttggcccgctgtgtgtctccgatgactacatcatgaggtgggacgacaattcaccggaaaaaactggaactagaggactccacagttcggttgagcggattgaaccgactaagggtgtgtttggttaggcttttcaacctgcttttacttttgcaaaagccaaaagccaaccaaagggcctaaaagctgcagctgcttttgcccaaagctaacttttggtatagtataaatcaaaagcacctctaccccctactttcacctgcttttgggaaaaaaaattatccacctcaaccattacgaagaaaacggttcgataatctcgtctcatgtcatcccgcatccgcaccacgcgcagcaggtgggaggagaggcgcatctccggccggcgccgcccctgccctccggccggccggccacctcattccccgcccgacggcggcgccgcccctgctcctccccgcccgacgccgccctttctcctccccgtccgacgccaaccccaccccttctcgccccttctcctcccggcgaggcgacctcccggcaacgcggcgaaacggcaaggcggcgacctcccggcgagacggcgagcttctcccccaccgcgccccctgactcccgtcgccggcctcctcccagcgcggcggaggtagaggagaggacaacgtccatctcgtcgtcctacgacctcgctgcttgctcgacgctggcaacacccgacgccgccctactcgtccccgctcggcgctgacgctgctcgtccccggccgatcgccgcctgtccttgttcggcgccgccctgctcgtccccgctcggcgccagcttgccttgggttgggacgcgcgaggagaggatggcgacgactccgccacctgttctctcatcccgtgctgcgatcaaccaaacggtcgtaagtgagagatgtttcccaaaaaccacaggtgatcaaccaaacgggttttttgactttctcgtagctgcttttccaaaagctgctgcgatcaaccaaacggtcgtaagtgagagatgtttccaaaagctaaagccgcaacacacactgtacctgaaatcagagaaatgcttgtggcgtgaggactcga

SEQ ID NO: 1002 - DNA, 1501 bp, Oryza sativa
tgggtaaataaaatgttattgtaagagaaattaatggtcaaagtttgatttgattcgatatttcacggtgaaacaaaaccgtgctatataaaatagtaggagggcatagatacattgtaatcatttgcatatattgcttatgaaatggggtcctgtaagcacatgagtcaatcaatggcctttctagcctaccaccactactaccaccatcaccatcacttcacaagattaagaaatcttggtccagtttcccccaaaacaaaagcaagctcacctagcttcaatgtagcaatactagtaccacatatattcacaagggcaaggagatctctcaattacagcttcctactcctagtggcaccaagtgtccacccaagatggaaagctcatgataaaaggagaagaaaaaaaaataatatttcttcttgccatatcttgcattgtcacatatgaggtaataattagcacagcataataaagatataataacaactttatgcagatgtccatgccccatcacaaggggaaaaaagacattttattcgaaatgaaaaaggagaggaatcgaatgtatagtactagttcggcgacgtctaaataaagaacattatatccaactaaatacgatcaccttactctactaatattcaggaatggaaggatttacttttgtagagaaaggtactagtttatagtactaattagtagctaatagtaattattaagtttttgaaactaatactagtagcaattaagtagccttggtgatttttttttcttactttcatggcaatgagggggcccaaaccccactgtgatgaccgttttggaggaaagattcgggtcaagtcatcagtcaaattttcagattcggattagtctcacctgtaatctttgctcacatcggatcttctgcagttagctagtcacccctacacaagtggaggatctgatcgcatcacaaatcagaccctaataagtgcattagaacacaaatttgaggaccaaagtatatctctatagagaactaaaaaaaaggtagctactgcaaacattaacggtgaatcctaggggataaaaaggttactatgggaacaaggtttgcacatggagtattttggttaaatgttattggccatgaaaatgtattgaatcatgactacctctgtattggatattatgatagagagagcaagaaggcataaatcgtgattgtgtatagtcgacaattatgctccaccattgcccaagcccaccaataaaaacaaaactaacttccaaagtatatatatttcttgtattctccactctaatttgacaccttcaacccttatggtgctcgtcggttttcctcatcaatcgctagctcgtttcccctccatccttttcacttctctctagtgattccatccgatatccataccacaccactcatcctccgactctcatcgccatcctttagttggttgcatcctcgctttctagggtggggttgtcatgg

SEQ ID NO: 1003 - DNA, 1501 bp, Oryza sativa
aatgtagtatacataatatgatagaactgagttatgattcaagcaatccaaacaagtgttacgcctgattcaaaatgttatttccccaaagctgaaacctcaccacacaaatgtgaagttgagattctctacatattcatcgtataaacagtaatggtaggatcatcgttttatcgtctacgagctctgctattatcagcacattgatatagcacgcgaatttagtcacccattatgtctgaattataattaacacaagatctagatcctaccaatgccaaatgggttaattggaaaatacaaagtaagcatcaaaatgaacctatagatgcttcaaccaatactactccaacataagtaacaatgactatagatgaaaatcctttgtgaactgacctgtacccgaacccggcatcccggagctcttgctccgacacgcgcgcgagccgctcgatcgtggggaattggtggaattggtatcctccaacctcgccgagccgctccccgtagccggccagcgcccacaccatcttctcgatccgcgcgatgttgttgttggaggagcagaggaactggaacacgcactcgacggggtcctgcctgagcacccgggcgccgccgcccccgagccgcgcggagacctccgcgaaccgcgcgtccgcggcggcgaaccggcgccagaggtcggcgagcggcacggcggcgttgaggtagtcggagagcgcggcgcgggccgccgcggggacggaggaggaggaggagccgccgttgttgtggaggaggaaggcgaggcggccgtcggaggacgggaggtgggagagggagacgaggtgaggccccacggcgccggtgaagcggagcggggagagagacgtgcggcgccacaggaaggtctgccccgtggggagggtgagcgggagggacaggtcggcggcggagagcggcagggggtgccactctccgtcctcctcctcgacggcggcggcggagacgagggggaggcggcggcgggcgggaggagggcggcggtcggcggcctcggatttgggggtgcccacgggcggggttggcggtggtgttgcggtggtggaagagaggaggggaggggagggtgggagcggcggccggactcggcggcggcggcgaggtggcatcccggcggcggcggcggcggcaacggtcggaaggggaggatgacaccccatgaacagctcaaagacgagcactccaaagctgtaaacatcgcacttctccgtcacccttgttgtatatgctagctctgccacatcaatattaagaccttgtttcaataaatttgtatagaaggaattctattctattttgtacaatctaagatgcatctttgcgaggttgactataataactattatcagaaaatactaatgagatgaatgcctaagctgttagctcaaatacttgtcaaaatgttaacaaaaaatacaagaggataaagtaactgatacattataaaattttacct

SEQ ID NO: 1004 - DNA, 1501 bp, Oryza sativa
agccagagtttaatccctatatttcctctcaaatcgagtgggatgcatatccaaatcaaaccccaaatcaaaataacatcccaaaatattcacatcacaaatcttaagttacttgtacacacaaatcaaatacatcacaaatcttaaaaaaaaaattacacacaaatcaaatacatcacatattatacatctcagatccatacaacaaatcacaaaattatacatctcagtgaatcacaaattgtaaaaaaatagaaaagaaataatggatgccggtagcgccacctgccgccgctcgctactcggccttgcgcggcgcctgctgcgtgcggccccgccggctgcctgccgcgtgcggtcctgctgggcacgggaagggaggaggcggcccttgccgggatgggaggaagaaggggaggagggggaggagagggccgggatgggaggaggaaggggaggaggaggagagggagatggatctgaggagagatcggatgggaagggaggagtcggatgggaggggaggagggggaggagaaggccgggatgggaggaggaagaggaaagggtgatgcatctgaggagagaagaggccggttgttggtgagtggatagggaatatggattatatactacgcatgatttggagtaaagatctagaagatcccaaccgggactaaagtgatgatctttagtcccggtttgtgacaccaaccgggactaaagatccccgcccctctgacaagggactgacaggggatgaaccgggactatctttagtcccggttggtgttaccgggactaaagatcgtagaatggctgtgggattttaaaccgggactaaagaggatctttagtcccggttctttttgtaaccgggactattgtggttttggggcgaccgagtaaagatcagttttctagtagtgtagataatgtcacattctatattaggtagctatattttgagacagggtaagtaatgaatattgataagttatataagaagttttgtgcaagtgtggtaggtatttaagtagaacattagacgtgtagtatttatgtaaatggattaacaaaatatagaatagtataatttctattggtaattaaatagctgcctatgtgatatagtgtgacaaaggttacatgtagtaaacttatactacaaataaatagcatttttccttttttttccttttactttatcctttgaatatttcttgaattgtggatattttgtgttttcatcaaactcgttgttatagtactagagtatttttcaacttttttcattgtacagttgattgttcgtatctacttgtatagttttctttttccagtgtccctacatggtatttcactttttgttaaaaatgtcacttttagatttttaagatttgttcttcattattatattaatagaatacttgtcgatacctcgtgccatttcatcacgcaagacaatatataaaaggtccttttccattctggccatttt

SEQ ID NO: 1005 - DNA, 1501 bp, Oryza sativa
taattctaccactacaaattatagtagcctaggactatgttgcagttgccaccacttcacttggtcacagtcatttttttaagataatgtgtgcccacagtcaaaactggtttgaatttttgaatatgaagcctttttatggtgtttggattcggtaggtttttgcttttgtcatgatagattttggtgtagcatcgttcgcacgtaagaaaaggttccaaatgggatggtgtgaaaacaaacaatggcaataggatcttccttgcaatctgccttgtaggaagggaaagaaaggcaagtgtgggtggaacggtgcagggtgtgatgacacaaagaaaatgtgggtggaacggcgcaaggtgtgagatgacatggagatataacgtgtaatattgaatataagtataaggtttccttcattagtacgtcttcaattttgttatgtggccagcatctacgtgtgtttatattagctatttgtttttattcattcatcactcttttctcacaccatagttgaaccgcttgtcacttccttttaatattttattttacttttagaggttgtcatatcatgtatatttatgttagatttagatctactacatcttttttttcactcctccgtcacactaagattggatcacttgcatctttttccctatatattatttatttataggagtcgtcaaatcttcaggcacttatatgtcctcatatcatatgttttttcattcatttattgttctttcatcacatcatggtaaaagaacctacctcttctttcttatatatcttaaattcttaatcttataggttgtcggaccataacacatcaatgtcaatcaaaacaatgacatccctgtccgtttttgaaccaacagtggataattgatgatgatgatagttcgaggtaccacaaccggggtttgaaacgactaccataagtagtatcattgcctattcctcacattaatcgctggtgatactgattttcaaaaaaaaggatgtaatcaatgcaaaaaaaagtgatacaatttgcattgattcatagtaaattgtgttcatataatcattcatacacactgataaacaatccaactagaatcacacacttacattcgtacagatttatccaacaataacaaataaattcattgtgatattaaatacatgttttcctacaaaggcaaaaaaaaatagagggagaaagagatgtgtaggcagaacggtgtgggatgagatgacgcgaagatagaatgtgtgatattaaatatgagtgtaagattttctttatgaaagtgcatctaggcccctaatgattttgatgattgattacaatgcgattagagaggactaacatttttattcaagcaaatatgaaggttgttatgtcctcaacgtgttgtaatacaatgcatatcccatgaatgcgacatagcgatgcaatgcggcaatgatcaaatggtatattgtatctttttcctcgcattgtgtcgta

SEQ ID NO: 1006 - DNA, 895 bp, Oryza sativa
tgcgcgtgtggggacatgctgcttgtcgcgagcgagagagagagagagagagtcaagagcgacgggggcttttgcttggcctcgagggcagttgagccgagacggaatgcggagcagagggaagtactgaaaatctgacgttctgatcctctcacaaaatttattttataattaacccgtgtttaaaactatagtcaaaactgaacctcgagcttagcaccgagttatatgcttgaatataaaaaaaacaagcatatcagagaatagtgaacggtaggaacattaaaaaaaccaaaacttttagcagaaataaaagtttgcgcgcaggcggctgggctggcacggtgacggcgcaaggcaccggcgcgtgcacgtcggcctgggcagggcgcctggcggccggcggctggggtggggagggttggccggttgggatgggaaggggaggtgaggagaagaaatagggttagaaatgtgggcttttatttgctattgggtcaatggacctaaaatggtgggtggtgggagggttcagtttgggcttcttttaagttttgaatgggtataggtatttttcttttttcctatatatacatatatggaatatatacttcatatatgtattttttgttcaaaaatcttgggtattcatttgaatacccacgaattatagtgggcccgcccctggataagttgggccgatgaggacatcgggtcctttgaagggggtatatgtgatatcctggcctaattaggatttggcctatgtggcggggggtgggggtatgtgacatcctggtccaattaggatttggcctgtgttgcccatgagagatatgtgcttgtttagttagcaaagttggaaccaacttataaatcctcttccctccaacca

SEQ ID NO: 1007 - DNA, 1501 bp, Oryza sativa
aaaatcacgaggtgtgagagtcttgtagtccggacgctcacgaatgatgatcaccaaggtagagttccttggagtgattgctcgaaccatcatcttgaccacaacatcattggtcatgtccttggagccaagtcccttgatctcattgacgatcttgctcaactggtcgtacatgtcgcttgggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcgctaagtattgcattagcggcttgagcgttcttgtgctcgttctcgtcgtcctccttggtgggatcttcgggattctgcaaaacatagcttttttcgactattctccaaatagatgggttaatagacttcaaatgcatcttcatcttatgcttccaagcggcatagtccgtaccactgaaatatggagctttgccgctataggtactcacataagatgtagatgtagggggatagtcataagggatcttagctcccttatcaccatcgatcccatcccctgcttggcccgacatgatctctccaagcggttaagcctaattaggatattaggctctgataccaattgaaaaggtcaattaggcctagagggggggtgaataggctaatttaaaaacttaagtaaagcggaagcagtaattttcggaactaggctgggaattttcggaacttccgaaaggattttcagaacttccaaaaatgcacagagcagcgcacataaaaagaagtatctagatctagaagtctaccacatgtaatcaaaggcacatacagcaactagaccaatagcggcacaagcaagcaaagttagaggagagggatgaagagatatcaccaaggtgaagcttgcaaacttgttcccggagttcaaatccttgaggggattctactctccattgaggagctcactaagagccgggttttagctaaccctttcctcaagaggttgcactaagcactcctccttccactaagaggtatctctacccttgcggaggcgagatccgacctttacaaacttctcccggccaaccacaagtagatcggtggctcgggagtgacacctagccgtctaggagtcctcaacctccaagagtaaaagatgatgcaaagaactcccggagatgatgcaagtgctcacaaatcttcacaaagaccacaagaagcacccacacaaactcgaatccacactctcacacacacacacaccaaatccaaatcaaacacgggtggagagatgaatcgaggaagcaaggctcaaatgaactagagagagagcaagccaatggcacaaataattggaatggaaccagcagccctcacaagtgaggggaggtgggtatttatacccacatcacaaatctgcccgttgga

SEQ ID NO: 1008 - DNA, 917 bp, Oryza sativa
aatatatgccgttatcagcaacataccacctttgtttctgcatccatctgaaaacctagcaaaatagaagagcagtaaggaaccagtagatatgtccaacttacaggaacttcaaaattcatctcttgttgatccacatcaacaccctaaaatggcacttatgatagcaatcaggggattagtacacaaaagcaggcatactgctagtcaattgtgatttgagttgggctcataggcaaagattatatgtgacacgaaatgtaaaccatggtaaaagtctctcactttcagtagaaaggcgttgttactgtagaaacctaaagggcgtaaggagaaacagggtttttcactactcgggcattggggcacttcgccatgctcacctcgagacactggagccagccgtcgcggcggccgagctcctcgaagaggaggaagcagtgctcggtgcggaccaccttcacgtggcggtcaagcacggccacgagccgctccttgccgccgctcgtcctccggaggaagaaccgcaccaggtccgccgcctcggcggcctcgtccgccccttccgccgccgcggcacccgcgccccgcctctttcccctggctgccgcagccgccatgtgccgccgcgcggcgggggcagcggcggcgccgtggtggcgcggcggccacgggctcgatgtggtagggtaggcgagcatcgggttaggtcaaaaggagaggccccttaggtttgcattggatagggttggccgccggcgagtggcggcaactgccgtcgggagggaggggcgcggcgcgggtggggggagaggaggccgaggggatagggggggaggagatggatggattagtgcgattttggacggctcagattatcggcttcgtacgattagtgtgagttggacggtgaggat

SEQ ID NO: 1009 - DNA, 1501 bp, Oryza sativa
cttcaacccgggactcctgcgacctcctcacaccggagctcgactggcagcgcttgccttctcttccccttccagcggcgctccggctgtgtcgagagtggagacgggcggacggcagtcaagcctcttcgtgggccgatttttcttacgtgggccgcgacagcttagcttgttcgttcctgtgttccatcgctcccgtccgatgccgatcgaacgaatcagcatggtcggacgtccctcagaggatccggtttccaaccggaaccacctccaaatccattgcgtctgctaagcatttcatgcgcttgagaagcacaatctaattattttagagaaaatctaataaatgtcatcgataaacttaactttctaagtacaagcgtttttgccttagaaatgccatcattattgagttttcgttagcattcctatgtaaagtgttgtaataaaatcattttacccctacaaattattaaaagttcactaaaacttttactctttccattagtttacactaatttgtagtttgctctttacgctaaattatttacgttgattaaaagagtaaaaatttttattcatctttcaacaattcatatcggtaaaatagtctatttatagcacttaacagagggttactaacaaaagcataacatcatcatccactaacaattattacatcttaaacatcatgtaagcatgctatattatctataattttataatttattaattttaatacaagcatgtttaatcatcatcccacataattcacataatatttcaatatatctccaatcataccgtggagacaaattatagtgggcttgccatagcacgagactattgctaatagataactcatatttaattgtgctagagaaaaataaataaattacaatttgtacatgtatccttaaaagttttgatgtgatatcatcctttaaacattctttttatctacacaaaaacgaactttacatttttgttacaatttggaccacctcattctatccatcaaactccaagtccggtgactccaccatcgctccacctccaaatcagtgactctgcaatcactctgcacactaactctctctctcatttttcttttttccttcgacaattggggaatcgtcggatatagtaaggaggagtccaaatctagcatcttcgctttctgttgggttggctcctgcctccccgagccctgtaagcccaacaatcccatccttaacgacgaccatgacaataacatgtataacaatgagggaagagaaaatacatgtcgagatttaaagtgtatggctgcgcatacgaaggcagagtggagtaacgatggtgtggtgctggtgtatagagcgacagttagttgccagggatccaagaagtttatcgtcgtgagtactgctggcaagtggtttaccagttatcgtaaagaattttaaagtgaaaattttgagataaaaggtggagcactccgttatctcccccttccctt

SEQ ID NO: 1010 - DNA, 1501 bp, Oryza sativa
tgaggtgggcgatgctcttggacgccttgtgggcctgtggctgggtgagattgcagttggagatgaggtattcctcgacagagaagtggttgtcgggcgcggtggtggtggtggtggtggcggaggcggcttcgggcgcggcgcgggagaggagctgcaggcggaggcggcagcgggtggggaggtggacggcggcgaggggagtggaggcgaggaggaggagaggcatgggagcgaggagcatggccgctcccatggccggggaggggagacgtggcggggagagagtgggtgatttttttgaccgaggttgtgtaatccgcagcttgggaggcgcagctccgcaggcgctcgcggtcgcggaggggatgagacgatgagcctagtactccctccacgcccacaaaacaagtcgttctgggctcttagtccgttttcacaaaacaagtcgtcgttcctcagtggggtatagtttggacgcgtatgcccctgatgcgagagccgagtgacgagcggcgaggcaagaaacgaggcgacgtgattaatgccgccttaagctgaatggacgtgattaatggcacacgcacgtcgctcgcacacgctcgccgctcgcacacgcgcgtctctcttccttgccgcccggctgccgagcgccatgatggagtacgtcgagtcgctagagtacgtcaaggcgccggactccgtcgacgcgctggacactgttgacgagggcccaaacgagcaccatgcaaaatcagcaaaaaaaacaagcccaccaggaatcgaacctaggcactaagccttcaaacctcactgcactagctatttgagttctgtttgtttctcaaatgaatgcacccgcaccctcatttaataagggaaaacatgaaagaatagccctgattaatcactccttggtaaccacaattttgttttaaacgacttgttttgtcggtatggagggagtacgctgtacgcccaaacctgtcctgttctttgggccgtaggctccgccctttgcttgtagcggtcgcccatcaacggcctaattggagtccagccaatttgtccggctgttacgctggcttgcggcccgtgcggtcacgatcatttttgcaaaattcagctgtagaatttggtttgcatttggatgttagaaacgtagcagcagtgataattatgttggtttccgcatgtttgattcagcatagaattattgtaatttaaattattagaagtaaactgaaataaacaagtaaattattactccctccgtctcaaaatatatcaacttttacttggataagatgtaccttatatcttatatccagattcatagtactagaatacgtctcatccaaccaaaaattgctatattttaagacggagggaatatgatagattattataatccataagtcagattagtataaacttattatattatagattattggagacatataggacattttttagccacccaacaaaaaatcactac

SEQ ID NO: 1011 - DNA, 1501 bp, Oryza sativa
agattttattatacataagaaacacaacggggtgtcagacggtccaagaacatatgcgatattccgtgcagatacgaggagctttttttaaaaagaaaatcccaacaggcgtaaaactctccgaggagccgaaaaaaatcaaaaaaggaggaaatccgtaacattacaactgttaatggctagttatatccacggtaaatctaaagtttgtatgttaaattatagtggtttaaaattttaaaaaacacctaaaataaaaacgaaataacttatccaaatattatatatcgacgtgattatagctttatcgatgatttatcaagtatttgtgatgttaagaatactcaatttaaaaaatcttggatcgggagatgcgtcaaaagagagcctcaatgtttgatatcaatttcaaaatcttcctggcggcccttctttccttatttattttttttagaaaaaaagaaaacaagcttcctggccgccgaacgcatgcagacgtgccctttgaggctggcgtgttcggaaccccttctcccaaccctctcgctagttctctgcgcttatgtttttcaaactgctaaacggtatgtttttttgcaaaaagtttatatgaaaattgtttaaaaaaattaaattaatctattttttttaaaaaaatagctaatacttaattaatcacgcgctaatagactgctccgttttttgtgcggagagaacgagttcccatcctggagatgcaaacacaacctgagacttaatcgagtgcgtgcttatttacttcgctaggctacgacgaaatcacgaaaacccacctactcaatgtatgataatcgaattaacaatcttcatggccaccgaacacatgcaaacgtgcccaatgagacttttgatcaagtgcttacgtgccccaccagggtacaacgaaatacggatgtgtgtctgctcaaggtcaatttccgcgttgattagtcagttcgttaacaacatcgactactctataattaagttaatgattgggtaaagacgcaggaaacggatgcgcatgtctgggaaggactagttcaagatgtcgtcgtcagtcagtcaatttcaaaatcttcctggctatacatttttttagtggctggtccaaaggctggacaacgtcgccacagcagcatgcatacatacatacaactacagcacaaacaaaacacgcagcgagaggcccgacaatcaactcacgccatttttaacatttttcacgccgcggctgctggagaacgattcgctagttccgtgggacaataggtgggctgcagggcggtatatagaatagtcatcagtcgtcagattcatgcatgggtgcgttgcgtttcctataaatacatttggccagatggccatctgcaaatcagcagcttacggcactagttagctactgtgcaagaaccaaacagttaatcgcatacagaatctcaattagctctgtgtttcttacccttggattggcgattgaatt

SEQ ID NO: 1012 - DNA, 1501 bp, Oryza sativa
gcgcggtggtggtggtggtggtggcggaggcggcttcgggcgcggcgcgggagaggagctgcaggcggaggcggcagcgggtggggaggtggacggcggcgaggggagtggaggcgaggaggaggagaggcatgggagcgaggagcatggccgctcccatggccggggaggggagacgtggcggggagagagtgggtgatttttttgaccgaggttgtgtaatccgcagcttgggaggcgcagctccgcaggcgctcgcggtcgcggaggggatgagacgatgagcctagtactccctccacgcccacaaaacaagtcgttctgggctcttagtccgttttcacaaaacaagtcgtcgttcctcagtggggtatagtttggacgcgtatgcccctgatgcgagagccgagtgacgagcggcgaggcaagaaacgaggcgacgtgattaatgccgccttaagctgaatggacgtgattaatggcacacgcacgtcgctcgcacacgctcgccgctcgcacacgcgcgtctctcttccttgccgcccggctgccgagcgccatgatggagtacgtcgagtcgctagagtacgtcaaggcgccggactccgtcgacgcgctggacactgttgacgagggcccaaacgagcaccatgcaaaatcagcaaaaaaaacaagcccaccaggaatcgaacctaggcactaagccttcaaacctcactgcactagctatttgagttctgtttgtttctcaaatgaatgcacccgcaccctcatttaataagggaaaacatgaaagaatagccctgattaatcactccttggtaaccacaattttgttttaaacgacttgttttgtcggtatggagggagtacgctgtacgcccaaacctgtcctgttctttgggccgtaggctccgccctttgcttgtagcggtcgcccatcaacggcctaattggagtccagccaatttgtccggctgttacgctggcttgcggcccgtgcggtcacgatcatttttgcaaaattcagctgtagaatttggtttgcatttggatgttagaaacgtagcagcagtgataattatgttggtttccgcatgtttgattcagcatagaattattgtaatttaaattattagaagtaaactgaaataaacaagtaaattattactccctccgtctcaaaatatatcaacttttacttggataagatgtaccttatatcttatatccagattcatagtactagaatacgtctcatccaaccaaaaattgctatattttaagacggagggaatatgatagattattataatccataagtcagattagtataaacttattatattatagattattggagacatataggacattttttagccacccaacaaaaaatcactacccctatatatctctaataataaaacaaacaaacaactcacaacttattttatatcaacttattataatctagcttacagtaatatgatttaatatt

SEQ ID NO: 1013 - DNA, 1470 bp, Oryza sativa
agccgcccgcggcgagccgagtcttccctctccgctccctcgctgccgctccccgagctcgttcgcgcgcgcgccggcgtggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcaagccacgtgcgcgtgccgtggtggccgaccgcccggtcgccgccgctgtcagcctctgcacgcgcctgtcgccagtgtcgccgctccgctccaaaccgccccgccgtcatcgccgtcgtcatcgcctggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggtgtcatcctccctgtcgccgctttggccgcgaccgccgagcaccagctcgcgcctttgaccgcgcaagtcggttcccaaaccgacattgccgcccatttaaaccccagcctcccctttcccttcctcttccattcgcctccgtgccattgccgccgcccccgagctctgtctcgcctctgccgtccttcgccgagcaccgggagaaccggtgcattcgaggacgcggaaggggacttcgaccacgccctcttcttcctcttccccggcccgaggccggagagattactcccgcgccgtcggcctctcgtcacagcgccccgtcccgcacggtagtgtctccctccgttcttcctcctcgctccatctcccccccccttagttttcggtggtagcacgagtagacttcccgtagctagccggcgccgccccaaccgttgccgtcgctcgccgtatgctcgccgccatcgccgctcgagctccgtagcacccgcacgtcgccagcctcgctcggcgtagctccgtccaatccgacgctagcatcgagttcccgaaaccgcgtagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcatcacgaacaaccgcccggtgtgctcgcttttgcccgtatcgccgtggttcgttccgccgttcgccgccgccgcccgccgtccattcggggccgggtcgtcgtctacctcccgccagcccacgtggcagccacgtaggcgccacgtcggcgccagctcagccgaggtcgggacgggccgaccccggtcagtccctccccgtgcgcgcgttccaccgcgagccgtgaggctgcgcgtgggcccgccgcacctgtgtcctccgcgaactgcg

SEQ ID NO: 1014 - DNA, 1501 bp, Oryza sativa
  unsure (1)..(1501): unsure at all n locations
tgtagagttcaagtacagcagtcatcaacaattatacgagctctgccaaagaataattaacactgctaagagttcatgattaagatacttgtggacaaacctgttggatccagggttgacatttgatatggaaagcttatcaatatcactaaagacaatttcttttcgtaaattaagtaacgtgccaccagagacattaactggaataagaaccagcaaggcgacagtcatgatgggcaaaaatatcttgaggctgccaaagaaacaaaacaaaagggttagtgtgcaaaacatagaaactggttaaataaaatttgatcatttgtctcatggcacaaactcaaaacttttgctcacaggaaagtggggaaagggaaaaagaaaaggtccaaggcgctgcctgaggaactatggctgaaaaatcctcaaacttctagcacaagttagttagttagtttccccccacgtgatggtggagttatatatactttgttctgtacagtactataaataagagaatgacaagagtacaagtatcaaaatatgactagtacatcctgtataggtaaaactttttgagtaaatttcatgcaagttccaaagtggcaagaaaagcatctccagttgtaaaagagcagtccccaccatcacacggattgaggaatcgttggagacaaacaaaagttggacggcaattttccaaaggtagtgggcgagcatgattcaagaacatgagcaacacgccaaacattagaaatatatgtgtatattttaatttagaactgcattatgaattcataggagtaccagtcgtgtaggctaggccccaaacaaaatatacaggctatggctcttcctccatgaaacaaggccaggaattgcggtgcacatcaagttaagattatcctatccgccgacaccgttttcaacgaaggagtattaactagtccagtaactaattaccgcgggatccatcacggccacaatgtcgtcatcaccaaacacatacaagcaatatagtaatattcttggcaagcagcactcctcctcaatttgtgaggtccaatcaatcaattgtggatggaatcggaaatgagcgaaagtattcaggaaagagctccttaattagcggcagagaaaataaaaaggactacagtagtgtagcaagcaaggattttctttacacaaaaaaaagaagcaagaagagtaattcctatcgcatactccatgcagctggaaacaaccataattgaagtccatagtagtactgtatgagcaggacgactttggtaggagacacaggcaagcaagagcacatactagacacaaatcaacaagagttgcactaggaagggagggatgcccataataatgtgcagtgcagggaaagcaaatgcaactacgtatacggtggtgcttaattaatctggaataccagtagaagtagtgtagtaaaaaagaaaaggaagggaggtgtangagggagcgaaccaacccgagc

SEQ ID NO: 1015 - DNA, 1501 bp, Oryza sativa
attcttccttacctctccacctctctctttcctctacctcttctctcaccttacagcagcacgtgggggcggagtggccaaccgacgcgcctaggaggggtcgcaggtcgtgacgcgtgcgggggaaagggtcaccggccggccgcgcactcttttctcccatcagtcttagtcgcgcactcttctatcggtgtagagcgacccgcggatgccaaggtcgaagctcgccgatgcgtagccgcgctccagcccacgtagctcccacttcgtctacgtgcccaaatagacaaacaaacaaacacatgcagcgacagcatctagactctccactcctcctgcacgcatacacaggatcagctaagctttagcgtcgttgccggagcagagcgaacaggacttcgggagtggttttggtttttggtttgcttacgtcgctggggcgctggctcctgctctcgtcggggaacatggcgtggaacatgcgcgcgcagtcgaggaggtactcgtcgaacgacacctgcacacacacgcgcacgagcgacgcgcatgaattccggtcatctcgtcgcatcaacccatggcagtgcagagatcgagaaggatgtggtttacctcggggggctcatagagcggcatgtccgtggagatgctggaggagtaggagatggcgtccgacgacaacgacaaccgcacatacgccacggcccactcctccttctcgccgctggcgactctgttgggcctctcgtgcagacctgcacataggcaactgaaaaagggcaagcactaacaccatggctcgctgccgtccatggctgcacccttcacatatgggatgtccgcgccggcctcagcacagctgccgtgcgcagccgattcattcttggcgtgtgtgcagcatttgcggcggcggctgagaaagagagagagagatagaagagaggaagaagaataggaaaagtgggactaacaagtgggcccatatttttttattttatcctttgccacttagattagggacccacttctatttttaacccttttgatgactgggctgtcacatcagtatgtttggaccaagtcaacctgtcatatcagtataaaccgctttccaatccattaaagaaggcgatttgcaccggtttttaaagatggaggagatgttatatacatggttgcaacgataaagttggactcacagtgcccactacgtggtgatgaaggccggatatgggaggatatataagagtctgatgataaaattaaaattcaattcaaagacggatggcatattaaaattttgacaaaaatatttctaatttttataatattaaagatagagatagacacgagatatatagataaggataaaggttaagattccctgtcttaatgggccgccagcctgggcagcaattgaggcagagcagcagcccatcatttgttcgatccaattcccatccttcttcctctctgatccggagcggctgcagcgtagaga

SEQ ID NO: 1016 - DNA, 1501 bp, Oryza sativa
atccaaagaaagagaaaaggaacatgaaaaataataaaaagcgcacaaatcttatctcaaccccgtgggaagccgccgacgccgctgaatccgtccgtgggaagtcaccatcgccgccgaatccacccgggggaagctgacgctgtcactcgcggtaggggagggcagcgccgccgccacttgcagccaccaacgccatcggatcctcctaggggaaaccgacgccgtcgctcgcgatgggggaagggcaccgccgccgctgctgtcgcacgcggaatgagagagtgccgccgccaccgccgctcgctcattgctgggagaaaggatcaggatcgagaacgggggaacgtgagggttagggtttccaatgcacatgcatcttcaatggtgcgcaggcgatccaagccatctatcaaatcgaatggctcagatcacctccgcttcgggccgcctccatcgccgggctgcacacacttgatggccctgccatcaagtgtctacaacgcaatcagaggaggagttgggggaggcaaattagacttgatttgcgggctgagatagtaaatcgactgaaaatggcccatagagaaattgggatttttatttaaataaatgctgaaatgatgtttgtattgtcaaaattagcaattaagttccgaaaattccaacaacaaatttcaaagagtgttattaatcatggttaatttaataaaaattaaatcgaactatatcatattatttcgctgcacaggtggggaaatgtgccgccgccatcgctctcggtgggagagaagaggaatgaatttagggttaggtatagatttaattcattgtttatgtttagaactatctcatataactcccatggaattataaaataactataatcattatcataacattagtttttttcccattgcaacgcacgagcactttttctataaataataatacagatatccggtgcacaataatatttggatattcgctgaaggcataaaaacataccccatttcgttctagctctagttctagtcttttaacattagtccacactaataattttatttaaacttttaaatatttttttataaaatatactatatgtattatgtgttgtaataccagttagacatgtatttataccaataatattgtacatgtttagtttatgatcaaactttgtgtataaaatgagcttaaaatatattatggtatttgtctgtggtttcgtgttctgataaatatttgtttctgtatttgtgttcgatcttatttgtattcaaggtaatttgtattcgtttccgtatctaataaaagaactacgaaaacaaatcgtatgatacagttcgtttttgatatcgtagggggacaataggcaatgatacaacggaagtgaaaatatatacaagagaaaatagaaaaagaaataattgggctggagatggagatggagatggagatggagggtgggtttggcacaaatcccgaagcgctccgg

SEQ ID NO: 1017 - DNA, 1158 bp, Oryza sativa
caaaccgccccgccgtcatcgccgtcgtcatcgcctggccccgccactccgcgcgcaagccgccaagggacggaggcagcatccctcctccctctgccgcgtcgcccccgctcacctcccccttttccccgaatcggcaaaggggcaagccccctttctccccctccttttcccctttttcctcctcgtcggcgtcatcctccctgtcgccgctttggccgcgaccgccgagcgccagctcgcgcccttgaccgcgcaagtcggttcccaaaccgacattgccgcccatttaaaccccagcctcccatttcccttcctcttccattcgcctccgtgccattgttgccgctcccgtgctctgtcccgcctccgccgtccatcgccaagcgccgggagagccggtgcgttcgtggacgcggaaggggactccgggcgcgccctctttttcctcttcctcggcccgaggccggagagatcactcccgcgccgtcggcctctcgtcaccgcgcccgtcccgcacggtagtgcctccctccgttcttcctcctcgctccatctccccccccttagctttcggtagtagctcgagtagtctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgtttcccccttctcccgccgccggttgcctccgccgcaatccgccgccgtcgagcaacccccagcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccacacctgcgtccaccgcgaaccacg

SEQ ID NO: 1018 - DNA, 1501 bp, Oryza sativa
gcaatcacaagacaagtattctgacaagtgtggaaaggcgttatattcatttttcataggagtatatggttaattaattatgtatgtgtagatagatccatgcgactggtggatcgaggaggaagataaattaattaagaagggggtgggggctggggttaccctacccaagataagagcaggagccttccagttgaaggggggcttggtatagtgctgattggatgcggaagcctgcaagcagagggagggaggaagacagtgagtactgatcgatacagggcggtgagaaattgagaatgctcaatttaatccaatccaatccaatccaatgggaaattaatcccttccctcccctccctttctaccgtggagttggagtatatactagtactgccgatcatatggaagcaaagaaaagcttaattaggaaggatttagaattggggatatatattagtagtagaaagagagaacctggtggtggagcagcggcagttgggcatctccgctctccatgcccatcttcttcttcttcttcttcttcttcttcttgctcctctcctcacctcctcctcgatctcggatcttctaccactggaatggaatggtgtaatggtggcgaacaagaccccaactcctagtagttgtatttgtcggcttgcatcgtcacggtctctgtcacctcattaacttgctccctacaccctataatataagcatttctagactctaatacgatctatattattttgaccaatagtatatactataaaaacgagatgttttaagtaaaaaaactgtagtttgtttaataataaatttagtaacatcaattttacatgattgaactttttttattttttctattaatagtcaaagttaaaaatgtttgatttattagtgtgataaaaatacttatattttgggacggatagagtagtaaattaatactactccctccgtcccaaaataagtgcagttttgtactattcatgttcaacgtttgactgtccgtcttatttgaaaattttttatgattagtatttttattgctattagataataaaacatgaatagtactttatgtgtgactaaatgtttttaattttttcataaatttttcaaataagacggacggtcaaacgttgaacataaatagtgcaaaactatggaggtagtagcatacaaatacaatactccacggaaaattgatgactactccactgccacttgcaacctgtgagctgctgttttgacctcgtggggatttttattttctttttcaattatttatacatatatttataagggaaaaggattggtgacccacgacagccacgagaaagcgacacagactgatgggcttaactgggcccacgtcactaggccggatatcaattgggctggatgcaatatgggccttcatctctctcgtcgctcgatccctcttggactcctccccttctcgaacaaaccctaacaacaacagacaagagag

SEQ ID NO: 1019 - DNA, 1501 bp, Oryza sativa
gcaggctagtaactgatcaattcaagtgtgtgtgtgtttgtgtataatattcctaattagatataacaatcatcactagtgcactacagtagtcgtatggcgacttgcatcaagaatggaaggaacagaaagttgtttgattctccactgcatatattactataatgatatggcctggcgatcatacacagtatcatattattggtcgatctgtagctagctgtacataacatggttgcctagtgagctgcatatgttgtacttaacccccaaacaaatacaaagaagatgaatataagcacaaattaatagtgcgtcgcgagtgtctgtgttgtactgtgtaattctaaaaaaaaagtagtgatgtaagagcatcttaaaattttactcctaaaaatcttggattagctagtatcgtcccaaaaaaattgggcccaaatatcacctcctactccaagaatgcccctaaatttgatttccaccaactttaaaatatgccatatcatctcaagtaggttctgcttcgaccgtttatgtctttttatttttccggtaagagagggatcgatgctaggcgctgctaaccaatcgcacgctagcggctcactatgctgtgcaacaggacgatctcgtgcatgccttgcagttgcgacagcggacagcgtgggcatcagcaagtctacaaggcgcgtcgaggagggcagacagggctcggccatctcgcggcagggcactacagagtaacacatgaggtttcttggttgtctcgacgacgccctagacggaggggtagcgacgccttggacggaatggatgccgcacactagtcggagcagaggcgagcttgtcgatgcctttctgagcactgcccctgtgacggagggtcaccaacaccaggagcgctcggcaggatgcgacaactctagattgtcacgagaggagaagaaaaggtgcgagcggcaaaatcctcccatgatttcatcaatggttttgggtgtcagtaaatattgggaccgtctttggatatctctttaagacatggttttagattagattcctataatttatcttttagaactggtattagggagctcttggagatttctaataatctactactttatctgtttcacaatgtaaatcattctagtattttccacattcatattgattttaatgaacctaaatatatatgtctagattcattaatttcaatataaatgtgggaatgatataatgatttacattgtgaaacggagggagtacttgtactggagtagtatactaagtgatttggattaagttttggcagcgcctaaaactcggcccatcccagaaatgggctcccaggtgaatgaggagcccatacagatgaagtctggtgggtggttggcccatccatgttcctcttcttcctcctccgactccgacccgcagccgcaggaacccaagaggagatcggaagaaagagagagagattgaggaggaggaggaggaggag

SEQ ID NO: 1020 - DNA, 1501 bp, Oryza sativa
ctcctgattccatccaatcatccatccatccatccatagactaattaagatttctacgtactacatactactcgtacgtacactttttatatacacacatatatgtatggagagcccatataattaaaaaagagtgtgcatcagcagcgtgtgcatgatagtgaacacgttttgtgtatactacaaaataaccgatgtttctcgttagctgatatgttggttgataataaacaggcagcctacgtcatcttcatcttcttatcgttacaagcaaaaaaaaaatatggccatgacatcgaggatggattctaatctcttaaatggattctaatctcttaagtagacgtacaccaatttcttgtatatcaactaaataattatgattttttaataaaaatataagatagattaatgtgtaagtgtacgagacttgcgaagtggcaagagtgttgggatgtattccttgggcaaagatcaataaaactcttattgacagcatttgttctccctacaatagcatgtcttgattatctatgggtacagaactattattatccattcaatctctcctatatctcctgtaatcactaacagaagatgcatatctttcgccatcttaataagttctgagctgtgatctaacttgactgataagtgatggcaagtttaagtagcttttcagaataccgctaggagagtgatgggcctgaacttgctgggaaccagaaatcagaattggatatgtgacagcagtctgccagtctctgtgcaagcgtgttgacaataagacggtgccaaacttgctgggaacaagaaatcagaattgatatgcgagcatgtaacctgaatacatgtcatgtaacaagaaatagggaaggaaaaactctgttgctataggttctgatgtagatttaacgacaggattgggtaaaaaaagaacctccaatccaataaactgaatctattcagaataacatgtaccgtcagaagtgccaatcaaccgattgggatgtcaggagtatttcattcaattcaggagtcaggagcaaccaagccaagagaccagatcaatcatagttcagattcaagataactgtactgtataaaatatcaatgaacgctccaaccagatcaatcatgaatattcatgaatgaatgacattaatattgaaaaccaacactcacaacatgcaacggatagaagtgttgatgttctcaccaacctggtacatgtcgaaaagaggtgctgagcttgatgcaccaatcgcaccaaccacatgtaatagaagcgggccacttactgacatgagctgtcaaactgaaattaccaagggccattcatcatatcaacattcaacattacataagtagggcagtagcaaacattcaggagtggctcgaaccttctcaattgataaaaaagtgagtacacttcctggaaccagaagatgcaaagttacaatgcaactgtcatacaccagactttctgcagaagatattc

SEQ ID NO: 1021 - DNA, 1501 bp, Oryza sativa
acacaatagactatacgggttgcctaccaaagtttgaatttcaatgttcaactaattccactatgagtcacatattcccctaggattagatcgatcctaggtagactataggtacgggcatgttcgctttccgcaggactccgcatacacacaaaaggctttcaggtctatccaatctctttttagttgtccacggtataggattaaagcaatgaataagcaataaaagctcacatcctgttttgcaatatccattgtgagggaaggtaacaataactatcaactatttgtgctacttcctttaggaagccaaaaaatatattatttatatagtgtttacaggcagatgcgttaaaaaataatgtagcagttaaccgttgcaattcctgttgcggcaacgttgtcgctttatccttaaagaacagagacacaagtaaggaaattttcatgcgtttcatcaaacttcactagagagaatggatccatccatccaatagaggtgcggaccagaagcgaaggccacgcctcccgccgtcccgcggcctaggcagcctccacgatgatgcagatgtggagaggccgcggctgcgtctttagaggggattaaaaagattttctgccatacttaatgtaagccgttgacattgcatattcgatgacttgtgagaacgctttttttttaaaaaaaacagagtttgctccacaaatagaatgggtgcaagcggtgtgcgttgacaaacagaaacatggacatggcattcatgcgcaactggagcaactaattatgtagcgagttgtgtgcgggcgattttgaccttggattgttatcgttacaactggatcctagtggcttgttaattagtgccatttcccttaaacctggcctatcggaggaggaagcagagagaatcgacggaagtgtagctatcgattctgatagcgtgcagtacgtgttgttgacaagtgaagcgcccttgtttggtgttatatataagtgagtaaactaagttggactttgcgaaaacgaaataaatggagttttgtataatctggtcgccatcagagaaaacgacgagtgtgtataatatactgtactactctatgatgtacgcatgcagctggaatatagctagctagtggatgactgggtcaaaagaagagaagattccgtgctcaactacccaatcactccaaattaagctcgcatcgcatcgcatctatgactggagagtgtatctttgcttgcatcgcatatatggtcattatacgtgtataaatacgcgcctaataggctaggcacacatctctgatctgctagctagtacagtacatatccatctatccgtctgttagagtaaaaattccccatttaattaggatcgatcgattggattgaagctggcgatggcgagcggcgtgtgccctcctgcggagctggggttcggggcggagtactactcggtggtgaacggggtgtgcagccgcgccggcagctacttcg

SEQ ID NO: 1022 - DNA, 1501 bp, Oryza sativa
ttgtacaagtgatatgtatagaaggaggtgcacataaatcttgattggtggagactctggttagggtaccatatgatgcagaggtgaaggtccccatgtggcagatatggtagggtggcctagctactaggcttcccttcttgcttgtcctggtaggcctttgttgctgacggcgtcaaggcttgacacaacaccccaaaaggttggatcccttgcctctcagcagcctatttgcttaaccttgtctcctttgccctctcatgaatgcagcctctgagaccaaagccatgcacgaagtcaaccttagcatcatcgcccaccgccgcgccactccttgagcccattaaccactgtccatttcgttgccttcttgcatgtggcctcggcagccgaccccccatgcgttccatggaggaggaggaggaggaggaggaggaggagggataacatgagagacgaggggacgggcaggtggcgcaacatccctagcactcacaaggcacgaccaaggctgcaacgatgacaatttagtagtggtagcgtcaccggctcctatagatagaaccaaggataaaggtatgtcctctaattggtgcaacacaggcctagatggaaagaagaaaatggtagcaaaaggtaatgagcttatttaattggaattagttaggtggcccgcacaattgtgcgctagcacctatacaaaatgatctaactttttacacatggttttattaaaaaaatgttaaatagccatttagttgccttagtctttcaaaagatcgatcctatcatcattttttgtttttagttttatatttttaaaagtcacaccagccaccactctctactctttcgccacactttttttttctgttgcccgacctcccactgcttctaatcatcatccttgtgacctttaaaaattcaacctgatatgcacacactagttttttacatgcaatgaacagtagcttcttctctctctttgtatagggccaaatttgccttaatttctagcaccaaaatgttgaggtgtgtctcattcattagattctgcttcgatcagtataaattcattttggatgcaacaaatagtagctttcctattttgtagtttattaatttttcccaattttgcaattttcatatgattttcgaatgaaaatttacaccaaatttaagacgatactagtttggacctttcaagtgtgagcgtattttggctttacgccttcgtgtggagtaaacgccctttctgttgggcgggttcggctggatcttttgttcccccttttcctttcttctccggcagcggcggcggcgatgggggacggccgcgtcggaggtggaacgaatcggccggcatggctgcagcaatacgaactagtgggcaagattggcgaggggacctacggcctcgtcttcctcgctcgcctcaaacaatcgcatccccacgctgccgctggcgttggccgccgtggctctcccatcgccatcaaga

SEQ ID NO: 1023 - DNA, 1501 bp, Oryza sativa
tactggcctgccacaactggccccttatgtgtgatgggccacatctagaatgggctccaattgaacccatcacaaatgcgttcacctgtgatgagacactttggcccgttactgataggtcatcatagatggatcaatctggtatagttctctgtcaagaagataaaacagtgcgagacaacataatgttcagaaaatgtatccaacaagtacgtctggcttgaactacttttccctgttttcagtttcttgtttcagaaaggaatgcgatttaattcctagacatgttttcacaatatatatgcacatgagtgattagtcaagaatgacaacggtacagggtactggaacttcaaattaaggaacacaaaacatctttccctgtagaatttaataacgaaataatctcacaacaaccaaacactaccgagctcacacaccctcccagaacaacaaaaacaaaatacaaatccaaaccaataaattaatttccataaataatttgcatcgtgagtatttatgcaatacattcgttcaaaaaaaaagtattaatgaaataggacaagcatgccggaggagtttaattatggcctcacctttggtcagagcttgactgagcttggaggaggcggagccgaagactaagctgatcataaattctttcgataacagaattagatctagacatgtacatgctagctagtataagacgacgatctctttgtttaattttgcgtgtcaatgaatggataattttgctagctgctagtaggaagaaaaatctctgggatttaactagcatatatagggtaaattttgtggaaggacactcaacttttgcatgcgctattcgattcatgattacctttgctgaaatacggtgaactttattttgcgtggttgcctgcaaagtggcagtacaaaatattgaaaccgctagtttatgtctctttgagcaggtattgggagcacccttatatatggatgtgcggcaaggtcatttatttaataaaacatatttaattttctcattaatttttatactaacccaaagattaataataatataattaatttacttatgaggaataacaacccctcccaaaaaagaaaaaggatcactcagtctttgtagatgttgctacttaacccttcaaagattcacgttgcatttcttcaaagattcacgttgcatttcagcatcttcagttttattattctctcgatctatacatagacgtaatcttgcatgcaatgtagttcttcaaagattcacgttgcatttcagcatcttcagttttattattctctcgatctatacatagacgtaatcttgcatgcaatgtagttctttcttccagctgaacagggccaagcatgcctgcatggattctcctatctaattaacttcctctcacactcagtcagtcaaatgctgttacttatcctcgcatgatttacgttgcattacaacctacatcttcttcagttggattattct

SEQ ID NO: 1024 - DNA, 1501 bp, Oryza sativa
atttaagagatatcgttactgatcgaataactccccaacttatgtcatgtcggagcgaattgatatagtttttttttaaaaaaaaacctttccttttttattgtgaaacaataaaagtttagctttattggatccaaggaatgtaccgacatactgttatagtctaaaatccgcgcaatttgatggaacggatttaagagacacaattatcgatcgaataactcagtttatgtcatgtcggagtagattgatatcgttttaatgctttccttatttattgtaaaacaataaaagtttagtttatttggacccaagggatataccgacataccattatagactaaagtcggcacatcttgtcgaaatggatttaagagatatcgttactgatcgaataactcctcaatttatatcatgtcggagcggattgatattgttttaaaaaacctttccttttttattgtaaaacaataaaagtttaacattattggatccaagggatgtatcgacatatcgttatagagtttaaagtccacgcattttgacggaatagatttaagagacagttctcgatcgagtaactcctcaatttatatcatgtcagagtggatagatatggtttcaaagctttccttttcttattgtaaaccaataaaagtttacctttatatattttttccaactagctgctgcattttatcaataaatgtaaatttatttgtataatcagctgccagtacatactgggaagtggacaacgaacttaagcacccattccttcgttttaggcggagcaagaatttaaattatggctttagtgccacgctgtactgtagtaggacactaggacagaactactgacagaatcgctctagaaccaaaatgcatggtttggtggcctactgttaattctagctgtagctagccttgcataattcaaccttattgatcgtccatgttttccggtgaattaaacccacatgcaaacgtagtaggttttttatctctctcggttcacaaatttggacccctgaattccgatcctctgtaataagctgagtagtttgtgcaaattacgtgaaagcctgtcgtttccgtggcccacatgaactggcccccatgcttgctgactcagactccgatcacttcgcccggccaatgctccgctataaaaccctccctttttttggcaaggagttcccaccgtgagatcgagatcgcctcctctctccgtttccttttatttcccgattcgctcggcgtctcggcggcgaccttgcgcgagcgcgcgatgcggtgaaaaaaaaatcatcgcccgcgacagagtacatctgtcccttccgcataaggcaacgtcgctataaatactgccagcctcttcgttcgtttccatttttcctcgtccgctcgctctcgttcatgtacaaataggagggcgcatgcaccttgtttgccattagctctcgacgtagcctagagcgcaagcagcagcagcagctag

SEQ ID NO: 1025 - DNA, 1501 bp, Oryza sativa
ggattattgtgaatgtagttcatgctgagagtcatgttaaataaacaaatgacacaaatgaaaatagcacagactctaatttagtaataaaattcataattaaaaatatcatatcgtatccatcttatactctgaatttagtatttattaattaaaatctagaattcaaaattcataagtagtaacttgtaactaacgtggaccctaattttagtatgagcagatcaatatcaactcacaaccaacacatgcaatgtaataatataattttaatattaaagagtagcctatgtaatgcatgggttagcgactagtggttataatttctaatttccgtagaaacttttatgagattgtatgtgtacttttcatgacatatgtacaacacaccatatgttttcaaactaagtattcattactttttttataagccaattttgaaaaaaaaaatgacacatggccatgtatttttgagcagagggaacatgttatgaaacacaaatcttgaaactgagtcacattccttaatttgagagttaaggcatgttggatatattttccttaatttacatttttctaataattcatgattgttcattccgacatttcctatatattctcaactaatcaatctgcattggatcgatacgatgaaagagatcatcaactcaaattctgatggcatcacctggacagaggttgcatatcatgatactgaaatgacagaaataattacaaattaaatagatcgatttgtaatgcgtctttgaaacttttggatcttagaaactttgaaacgtctctttaatatccccaatgataacaagccatgcgttgcgcgacttttgattccatataagaactatttgttgtataggatctattagtttatagaagattttagatgagttattttatttacaaagtatctattggtctagctaactatagatttagctaagtcgtgctatatgagaaatcactagaagcttcttggttttttttttcttcattatctttgcccccgctctctttgtaccatgtgtctataagaggaggcactagaaacctctataaattcccatatgtttatgctattgttatttttttaatgcatatgtaaccttttgatccaatggccattatttatctaaattctttattcaacggttgatatgtttttgatgatgtggcgtgttctcgtgtaagaaagcttgttgctttcactatataagataagataataagatatgatgatagccaccggccggaatacacaggagactaacagtgctctgattttcttttctctcgggctgaaacgccctcgccgagaaatatcattatatatgtatcgaaattatataataatttgataagatgcacattgtgacagtacaccattggaggtagaagtcaaattaatcataatgccaaacaaattaacaacgacggtgtacttcaaagagataaatttagggatctagctagcttacgaaca

SEQ ID NO: 1026 - DNA, 1501 bp, Oryza sativa
ttagtgaactcatccgtccaaaattgatattaattcaatcaatattccagtttaggtcatgtcaaatccgagcccaatttaagcccacccaattaagcccggttaagtcgatcgagcttggcgaaaattaagagcatgtgtaacagtgcaagcaggacagccagggcaggcaaacccaatccccagaaattccaaggaagcttcttaatcaggcatgcaaagccgcaattagaccctggcttaacggttaattcacacacacaatactagtatacatttctgtccaagttaacaacaattagcagcactggccctgcagcaagcagcaacgggctaatagctagaatagctatagctcttcattaaaagtgtcccacatggcatggactcgatcgacgcacacggtgccggcagattccccaattcttcccaagctttttttaacccaagatcacacctccattgccaagaaatttaatgcccaaatcaggtcaaaacttgcagccacagctagtgtactactctcccagcataaaataatagtaattaagaacaagccaagccagctactacactgtgttagctactcctaaccagtgcaaagtgttagtgttaatctctctataaaaccctactagtggcctacctgatgccttactctggagtctagagtctggagcttgtagtgcagcagctagctagcatcagcagcagaagaaaaagaagaagatcaaagtagcaattggtgtgtacaccctagtgctacttctactactactgatcaactggtagctagtactactctccactgtatctctactatcctcaaatcagctagccactgagtgagctgatctctagacaccagagtgagtgctactagctcttgtgtttgtgtgtttgtgtgtgtgcaactgtgcattggtctcctccaaggcagtctagtctgcacctttcttggatctgaagctcataggcaccttaattagccagggagagtaccattttcttggttctctcatcatcagggtcacagaacaaagaattacagggtgagtagtactgttcatatttgatggttgattggttggttctgccaaaattattcatcttgttgtgttttgtttgtagtagtgtttttagctcatttgatttatctttttttgtttgttgacaggtgagtgagtgagtgagtgagtgagtgagtttgttcatcagaggtaagactgagaaattgaagttaaatcagcagcaacagcaacactgcactgaaaagcacaagatcttgtacctgagggggcaagagggcagcaagcaagggtaacctaaggaggaagcaacctcacatggtgagttgctggaaccaagcctagcaagctgcactttccaacggctagctcatcgtcggcttctccggcgccgcgacacggacaccgaggcgacggcggcggccgcagaggaagagttagctagctcgagctaggtgaggcagcaatggcgc

SEQ ID NO: 1027 - DNA, 1501 bp, Oryza sativa
tggaatcatacatacaggccgctggcagttctttttgtgtgatcaacaattccccttaatcaaattttccatgtttttcgtcagtaattcttagttcttgcagatagcacataacaaagatggaatttgcaacccaaacctgcctcggtctacgagctcaagacaggctttatccctatgcactcaatctttaattcatgttttctgtacttaggctactttcttccaaaataatattcttgctctctgtaggtctctgaataggagtaatttttttatggcccgtctcagtgaagcacaccaccattttctcttcaattcgtcattagaagttaaatacttacaaagttgaatttcttcccaaataaatgttctcttgcttattgcaggcctatctcataattttgcaagaccaaccttcaccgagtgaaatctttaaatcaccgccattctcttcaattcatcattagaagttaaatacctcacaaagatatatttaaatccaatctattactcactacaggtttctacataatttctatggccaatctgagtgaatcctttaaatcatctcccctttctcttcaatttatcatcagaagttaattgcttgcaaagttgaatttcttctcgaatatttgatgattctgaacaaaatctgctcgaaagttgccacaaatggtctgagagaatagtgaaataagaagaaagtaattggccgaaagaaagctctgcattcgatgtacacctcaaaataatttgagtttttgccgttccatatgaattcattgttagctgcaagtttctatactagatgaacaattcttacatgtgtgcggagtgcactaaatttcccctgaactcccctgattcacaagcatttttaatagataaataccagcacttttatgcatgtgctgcttccttcggtgttatgtatatattaaacttagaagaatttcttctacacaatacagttgaccttttattggttcatgtaaaatttaattgttctgtttgtttctttacagggaagctatgaaattatgagaagtagcatgcctaagttgactctcttctgcttgatatgatgtcctgaacatgcattgttcaggtgagcatagttatctatattgagatcccttccgcatcgtgatcgcgtccggcccacaccccggtcatggccattctgtcctctaaaccttccagataaacaatttaagtacgtctccactggtatattttggtattcatttttggatttttttttctcttgtcttttagaacttgccaattttgttgtttctcaggaaatagttaaatgagtattttggctttgctgtttatcactacctaggaagacatgtcatgatttcttttgcttatccaaagtgtcaaacattttattttattagatcctatgctaaactatgtaactgctgctgatatcattttgtaattaatactctgcattttgtctacatgattttgaatcgaggca

SEQ ID NO: 1028 - DNA, 1501 bp, Oryza sativa
ggctacagtattgagcttgttatgaaaatcaaagcttgaatttccataaagaatcataaaaaaagccacttaaagcatgttgtataatatccaaggtactttagttattcactggaagggatcaaggtaatataaagccacggttttgtatactatacctggcacttctgatatagggaatagttttcacttttagggaactaccgataaatatgtttatttttccaaattatcacacctttttttcctggaccatttatctttcctatgctaatataattatttggaaagtctcgcaatcgtattatcttttctctgataatatttcttttatatatttcacaaggttgcatagctgaaaatttgcagcccaaacatttcttctttaaatggcatcccataattaaatgttaaactgtttcttgctaacttatgtatttttcgagcttgcatggtgaaccatcaattctgaattatttgtacttgtctgttttgtcaattgacattcaagcaaccaacaagcacctgaagctatcctgatatacaaaccctgtgtggtctatctataaatgccgatattctttttatttgtttgaatctttagatagataatacgcctaccacaacgttttcttgaatgtgtatacattgggaactagcatgtatacttaaaatcaacaacaagaatgtatgttaatccatacataaatatatctatctggattggatgtagccaatctgtacatgtactaaatttaaaatagcgacggataataatgattcttccataggagtgtccatgacattaaaaatgccattgaagaggcaaatgaacacacaaaatattaggcaaataaaaagggatttgcaacaccaattggcactcctaatgcttaacatgacttttgtgcacgatctacataacaaaaacttttatatatgtctatccgtgacgtgccttgcacgtgcacgctcactagtaataaaaatggaccagctgtggaggaaaactaaggtgaaattttttatctttttagatcaaagaacatggtatatgtggacaacataacactacctgatgtcaaagaaaaaacataaccctgtgtatgttaatctgtatagctgaggcatccaccagagcatgcatgtgcagtatattattggttgaatttggaaaactagaatacgcaccatataacatatatcggtcaacattatcataatccccaaataaaaaagataactttaacaacaaaaaagatgcatctggcatgcagctactaaatccaaatgaacaaaattcatatctcccaaacaattttggtcaaaatggattaaaaactcaagacgatgtcaagaaatgaaaaaaaaatcgacatgctgcatctgcctatttaaagctcaagaacattcagaagaatggcggcgaaaccaaacacaacaatcgcatgatcagctagagatcgaaacagagaaagaccgtgacccatggcgagcggcg

SEQ ID NO: 1029 - DNA, 1501 bp, Oryza sativa
cctgaggaattggaagataaaggtcaaaggtgcataaacaatgccatgatgtcaacaacgttgattaacatacggtctactgaacatttaacattatccgtatcactgtatatgttgtctatataatcaaatcattaattagttaaatctatttaaaatagctcagcagaccacacatgtgagtgatttcttctgttagagtatgtgttgaatgtgtacaaagtcaattgtgttttaaaatttggagttataataaatgtaagatataattagggtcgaactctctcgtatagtttctcttaaatagagaggcaccatcggttgtaatcgtataacgataataacatagacgagggatgattggtcggcgtcctatccgatcgatggtcgtggataacatgatacgttgtaattatgctagatcagataggagtcttgtaattaatgcaattgggatgatagattcctaatgtaaccttatttatactagtattatatactatcaatgtattgtactgtacacgtcctttttcaaataaaccttataagaaaatactgtgtcttggtatcgttattatgtttagattatttatggtctttttaaaatgtttggttacttatgttgattttggagccggttttaagatatgtatggcacttaaatatgacgtgtaaagatcatatatattgcaatctgtgctattagttaggcacaatcaagattagcagagggttcatgcctagcaaaaaagttaagcatgagacatttccggtggatttggatatgttcattagtggggcctaagaaagggaccagaaaacgttttcgaggtgatgtactattcccgggaccgtttctacaaggttttgtttccttttttacccttgaatttttctccagaagttgggtgtgaatccattaaccaaataattagaacaaaccaaatggcatatttcattgcaaaattaccccaaaaaaaagggttcttatgtaaacgtggcagatagctacaccagccgatctacacgtgaccaaatcaaggttgttggttcattttcgtagttcataagacatcaggtacgtcggtgtttaatatttgcatacttgcattacaccatggcgtgaattaattaagtacaacatatactataaatatgcttcagtacattttcacatcacttgtgtttgtacatctagtgaaaccaatgcaagctaaaccaaaacatctgttgatcaatcaaaatgctgatgttcttattcagggggtaaaaaaaaatccaatttaccatcccctccttaaggtgtgtttagttccacgtcaaaattagaagtttgactaaaattgaaagtttgaagaaaaaagttaaaagtttatgtgtgtaggaaagttttgatgggatgaaaaagttgaaagtttgaagaaaaaattgggaactaaacccggcctaaattaaactgaccgagcgtgaaaacaacgagaaaggaagagaaatgtgtaaa

SEQ ID NO: 1030 - DNA, 1501 bp, Oryza sativa
agtagaccccagtaatcagcaggcttcaattaccggggcgcggtaaagaacaaagcgcgaaggctgcggccgggatcgagacgcaggagcgcggcatgtgagtgaaaagaaaaccggcagcgcgagctgagacgccggccggcgcggatctcgatgctcgcggcgaggtgtggcgctggcggtggcgggcacccaccgcaccgcaccgcccccatctccgtgaggcaaacgcagcctcctctctcctctccggtttcgcgcgcgtacgccgtgctgtctcgctgtccgcgccataggctacacaccccctccattttgccatctcgtagtcggtggagccttccccccttgtcctcctccgctgcaaaaccctgacgaagcgaaacacctctctcgcctctgctttcgcgtgcgatagcggcaggcagccgtctcgccgacgcgtggggcctcgcggtggtgggtcacgctgcttaatggcccgtgttaggttaacgccgggtgtttgccgctgctgtgtgttaatcagcaggatggtccctgtcacgtggctgggattagtatcacttgtcgcgtcgctgatctctgtgccatggcaaagcaaagcaccagggcaggggaggggcagggagtttaattgggacttggaaggaggcccaaatggacaggacagggattgcagccttcccatgcacgcaaatgcttccaaatattaatactcgcagcatcagcggggaaacccaacccgtgctccaaggcttcacatgcacggcttatttgtctacggacacatcaggcattaagagacagcaatcagattaacaaaccatccaggacttacagtgcactgggagttggactcacagagcgttagcaagagtcttaagagagagggagaagtcctcgattggctcactgacatacgggcccagcgactagtcttggtcagcgtcgccgcgccccatacgtgtgggcctcgttagtcaaacgttttcgcttaaaagaactgctttggcagcgccgaaccagctgccatttcaccaccctctagagtcccccacaataattacccacccttaatccactggtctcacccccacactgcaaacaccttaattagtactactactagtcaacatcaccggtaattaagctctaggtaccagtacttaacaataggacagtctaccatacatcagtagtgatacacaatgcagcagtgtgttgacttcaagaacctaaaggagaaagcaactaaccagagagctagtgaagcttttctattactacaaatcctctgatatcgctgctctcgcctccatcaacccacactctgccccagctctctcacagctgagctggtcctggcatcgtttgaatgccactcatcactgcctccgctgcgccctcctttgcaccttcccctgtgtcgcactcgcgccctttaagcgctagctgctgagcggtgacgacgacgcctgcagccttgcattgcagctcg

SEQ ID NO: 1031 - DNA, 1501 bp, Oryza sativa
cctgaaaaataatttctagaagacaaaatatagcagagaatatcgattatgtactccaaaaaactgcatggatcttctagcattatcaggacataacgagcagatgtaaatatcaggcattatgtaaaccataaacaagcatgatttatacagaagaaaatagagcgagcccctagcattagaccgtagtcgatttaacatcggggacactcgcgcaacagatattgtataaaagacatgctctaggaaaacataataaattatagatctgacaatattgtatagattggaaaaataggtacgataaattgcatataaaatattgcgtacctttgtagatacatgctggatgtatctacgaaattagtagatcaatttaaaaaaccaatctaccaattaccttgttgcgtactcgttcgacatcatatgatctgacattttttggtacgccgcgaagcttgagacttggatggtttcgatagaccaagttgtcgatgacgatgatggttccgatctggttaggttagatctccccctcagctgaagtcgtcgagtagcttatcatcggagaatccatctcttaaacccatcccgtcgaaatcctgaagcaccaaaatccccctacctggcgcgctactgtcgacgtttgatgtcgcgattccggtatttgcatagtatggggatcgttggtgctagggtatacgcgagactgaggtaaaagagacagagacgatgatttttatacaggtttgggcccctgaattgtcaggtaacaaccctacatcctgttggccgaagccggtcgttgatcttattcaccataatcacaccagtacaatatttggggtagcctatctaactgttgtcgacatggcggtctgaaggtttgactcgtagtcaataatagggtagtcttcctcctcgaatccgtgtccggcgagatcagagataacgctttcgtctctcctgatagtattcagagacaccgtaggggactagccgtgcttatccgtgaagtcgatatccggcggcttgtcttagcgtatgttggcttgtatgttgtggcttctgttgttccgtgtatgttgattgtgttgggtgtgtcccctctcctcatagggggtcttgtatttatacacataggtgtccccttgtccaagtagaactagggaaaccaatatggatacaatccgagtagtccttgtcgttccatatagaactctggttgtctttccttatccggaactactcctatatccgcaggttgtttccgtataggatatggtatgtggtgggtcctgccgagacttagtcaactactattaggtatgtggtatccataaccctgacacgcgcggtctcgcgtcgttgccgcgcgagaccgcgcgataccgtccgcgacatcattcgcatgtcattttcacgcaacggttctgcgacaccgacggtatatttttgcacaagtttttacatcccgaatattcctgagaaaaattgaatg

SEQ ID NO: 1032 - DNA, 1501 bp, Oryza sativa
caacccgttctgcaaccacgctgtcacgttggggatcagtgggctcgtctcggcgtgggccggctggtacaggaactggccgtcgtgagctgttccaactctatttttcgcacgctcttcggccttgttacatcataatgattttgccaggcactgaactctgcttctgtagcaaattttacagtcgagataccgttggtgtatagtcgcatagatcgacgcatactgtactgaacagctcactggcaatcccaaccaatctttcatgatcgatgagtctgttcttaagatcaatcgtcaattcctcatacagtacgtactactttactcaaggggttgattggatttggaaaccgacacttgaggcacatcggcacatgaaagaagagaacgtagcaatcttccgtttatttcaaccaagttctcttttttcttcgtctctctcttcagtctgaacatattttcggggaaaatgcagccatcgtcgtcgcagaacacatggagaccaatagctagcttgggcgcctggctgaaataatctgtacatgacagcaattccgatatctaataagattgaaaatattgccaaattcgtttggagtacagtaaaatgtgtgtttgattgtgaaatgccaaatgggatgcagaatttaatgggaccttggatgaagaaatttacccaaaagacaataaagcttgttaaatatgtgattcgaattttagatctgcaatgtatttggataagtctttctaatactaacttaactattaggattagtttgatacgactacggatcgggcgcccgataactggctaaaaaatcgtgcgctcctcaacacacgcacactccactccactcctttacatgtaaattggtcagacccctttctctcacgttgacccttcacatagcagtgttgtaggagcatgcatgagatttctgtagggttagttaggttgttttaagtctttttagcaaatttgaaactatttttttcacctaaattacttcttcaatttataattcgatttcactgttatattcgttgtaattaaatctttacaacaagatcagacatgattatattccaacggaaaaaaaatatttagctcttttttcaatagatattttgggcctgtttggcacagctccagctccacccctcctggtaggggtgaaaacggtaaggaatttttccggattccgtacctattttcagaaacggaatcagccggtcggaaaattttcagaatttctcagaaacggaatcgaaaacggaaatattttctcggaaacggaatcaaatatgataatcgcagtttgcgtcggaactcggaatcggtcggaaacattccggaaaatttgtcgaaatttccgaagttaaaaaggcccatccaatcaatagtccataatccctccccaagtccccagccggcccaacccaagctgctaacccaagagaagagagtggagagagagaagtcagacagatcgggagg

SEQ ID NO: 1033 - DNA, 1501 bp, Oryza sativa
gacataaccagtggaaggtctatcaaccatatagtcttgtttctgaccaccagatcaatgcccaaacatggctgagaaggtatgagcatgactgtgttgggagttttgctttctgagtatttgtcgtactgcactaggcctcttcagcgaagtctgctgaaggctactcagtttgttctagtatgttatgatgggtgtctttttagccctcatgctcttctcctttgtagaatatggctagattgctttttctagaatttgtactgtgttgaattaaccagaaataaattgtctgaattactattccattcttggatcatggattgtgggtgttttgtttagcattaagatatgattggtgggtaagaacctagttgcatgtgtcatgtgccaatcaacacaggaatgggcatatgcaggattgccttgatcttctcctgcagagatacgttgaattctagcagttagatggtctttttggatatggtagtataggttgtgagatggtgaacattgctgcgggtctgcagagtatatgcgcgcccaagaactcactgaatgcaactctttataggattatactaaaggagaagtagttcatcttccagttaggcttgcaaattcgaaagcagctgactacagaagccaaccatgatttggtagctcagctgtgtcaaaccgtcaaggacactctgatacagcagtgaattgttgatcggcaaagaacttgtgaatagcagcagtgaaaacctatacaactgcctacaaaatttgtttaaactaaactatggcactaatcttagtcaatctcaaagattttttttgtgtgtcgattcctaaaacaagtcggcattttgattgatatttcccttaggtttagaaacatgaaacggacgtgcaattcgcctattgctcctaaaatttggatgactccctacccctagagtttgggtcaatcaggtcagggcagaattgcgttgcatatcaaaagaagctgaattcatttgtgttggtcgcagccgcaaaagattgatttgatcctgttttgaagaataaaggaaaagaaaacagcgtctcaaaattggtcctgttttgaggaataaaggtaaagaaaacagtagcaactggctaatcctcagtgtgaggaagaatggaaaaaaaaaaaagaagacagaactcgctagtcattgcatcccaccaactttaactttgtctgacgaaaagataagggcaatagaacaaacttgcggctaatcctctgtctgaaactgcgaccgaacgaactcgtgaagcaggcaagccgcaagccgcacaaaaagagagagacagagcgatttaggtcaaagcttaaactatttcagagcaagttcaggtaaaaccatacggcgatacacacttacaaaagcttcatcgcacgaaactctcgacggctaaaaaacacaggggatcacacgacgccagccacatcacacggttcagactcccttccagccggaatcac

SEQ ID NO: 1034 - DNA, 994 bp, Oryza sativa
atatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgatcaagcaaatgttgaaaaataaattatgataaaagaacatcaaaattaactttaaattcacattttagttgtggttgataagctgaagaataaacgatggtagtttatagctgcatgtgtttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaaca

SEQ ID NO: 1035 - DNA, 1501 bp, Oryza sativa
gggggtgtcagcctgtggaacacgtcatgatatcgtcttcgtcgccgtttccccactggagctctggagcttttccttccttctctgttactcacgtgaaaagccacgggaagaagatgaacagtgccggccaacactgtttcctagtggttgaacccaaccaaccccatcaaatccacctaaatagtgcctaaccacaataaaacctgtccaaacagttctattaagatgttttgctcctgttcgagctctaaaacaccaaatcaatttcagttgtcacctctgttatctatagcgttaatatcaaattgcaatcactactacacagaccatgaatcataaccataggataaatctttttccattcaaatcaacttaactctcgatttatcattttcttttgctcaggctccgattcataatatttattttatcgtttatttgtagtatttttattataggcttatttggtcgtttcttcatgtgcgtacgatagatcgcgttgaagatcccactggactcgcaggaactgaagtggacctagaaggctaagctgaagcttcagaaggccacgttccacaaggcaagccacagtttcaatctttgatcatattaaaacctagtaaagaaccacttagttattttctgcattgagtatttataaaattattttgcgtataatttatttttgaataaacttgtaagtttagttattacccattattacattgttattattggccaaatccatggattgctatatcacgccctttgataatctaggtgtagatttgtatacttcacaataatatcccagtggataagaccaccaaatatctatactcatatacatggtttacccgtcgtcacgtggtggtgtgtcgggtgatataaaatgtgttatttgatatgagtcactcgcctagagtgatatggaagattaattccgggtgaagatggatgttgtggtgtgtgaggccatgcatattgttataattattttgtggaaagtgtaaatttacacttgaagtatgcacgggcctgtgctagttttggtggctttcccccggatataaggactaccctcttatgccatggaaagtgatgtaatttgcgcccatccacaggactgagtaatcagacttagcctagtacattgtcccactatatgaaagactgtagggtggctctatgagctggtttggggtggacatgtggaaggggcttcggccaggttgacatgatccacaacggtggaacccgtgaaagcagtgaccgtctagccttgcttaggcccagcaagtgcccgactattaggacggatcaatatcccactgggcagtaactagtagtaagtgggactctcgaacggctatgttgtcctcagccttgcaagctgttgacatcatgtgggtaaagctggacagtctctgcagagatgagtcttaaatcattcgaatgtgccgtgcttccggttaagaagctatgtcattgggtgatt

SEQ ID NO: 1036 - DNA, 1501 bp, Oryza sativa
atgttattatcatttattttaccgtgacttgatttaacatcaaatattctttaagcatgatataaatatttttatatttacacaaaaattttaaataaaataaatggtcaaacattgattaaaaagttaacggtgtcatacattaaaatacggagggattacctatctgaaaatacatttcagaaaggttttagcaaatctatttgtgctcgccagtcgccaccaccgcaatccaaccgattatctcgcacgcatgcatgcttctaccgaagcatcaccaagacccgtttctcaccggctcaccgccaacaagtggtgtggaacgttcatcatgcaaatcgagattctcttatatgaccacagctcatccaaaaatctcttggggtttaattccaaaagagacatgtgacaactgatgcaagtggaaaacaagcaacgaaaccgcaagaagctgctatcaccgtaggtcgctattatacgtaggaacttccggattgttgccactgcaccccttatatttcctaattaatttgttgcactgaacatataaattgctagagtttgtgcctatatataaagccagttataaagtgggatatataattgcaataaatgtttaggatgaaagtaaaattggagtacattctattatctcttttgaatagagagacgtatatgatgtaacaagatgacaactaacataggtaagctaaaaaaacgactggtcggtaacctggacgatcaaaattcattggtatgctaatacattataattatgacagtttggtggtgaagatacccgtgagcaatttatagagaatgtaaagttttggcttaaatattgttaacaaatattgtgacttagtgttatcaatgtttctttcactttgataccgatgccactattactgtcggtttttttcatcatgaacttgttgatcacttaacaatacaccgttgatcggtgatttatgcaggtaccgaaacacagcacacgaacaacacgtaacacaattactagtactccctccgccccacgatataagggattttgagtttttatttgcaacgtttagccactcgtcttattcaaaaaaattttgcaaatataaaaaataaaaaatatggtacctctaggcatcttctcaatgatggtaaaattgcccattttttagctccttcatctcaattccaccaccaacttgtactgtgaacttcattgtttgaatttggcgaattggattcctaacaacttgtatcattacatgttcttgtgacaccagatttggaacactacttctagctaatgtactctctaatataatcaaaagcaaattgattggcaaacgtacttctatatttggccacatgcatcatctaccaacctattctatatttgttggttgagatgggatctttcatctccttaaacttcattgtttcaccaccaattgctcgcatgttttgagttgagtgtaggctgtagcaggaatacatagca

SEQ ID NO: 1037 - DNA, 1501 bp, Oryza sativa
gggcctcacctccggcgaaacctccgggcggcggagcgggccttgcgcttgcgcttgtcccgggcgtcctcgtgcctccgccgccacctgatctcctccatgactcccgcacgggccacctcccgcctgaaccgctgaagcagctcctccccgtccacctcctcgtcgcccgcgttcaccttcgcgttgtggtacttggggttggccgacggcggggcgggggccggggcggaggaggccgagaggagggaggtcgtgggaggcgatcgccgcgggaaggagacgaaggtggccctggtgttcgcccagaggagactaggtgtaggcggtgagatgatccccgcggtggcggctgcggcggcggcggcgcacatggtggtggtcgccggcgacggggacgcagaggttggtgggctttttgggtttgagcctttcaggtggagatggagaggccgtggataatagggatttggactggaagttacgttgcttgatgggccttataaattgggcctaaataaaacatgggtctatttgtgcagcgcgtttcaatttgggaaaaagtacatcgaaggtctctcaacttatcatcgagttacaaaatcgtccttaatcgcaaaactagatacaacgcatcctccaacttacagaaccagtgtaaactcagcgtagacctacgcgggtcccacatgtcagcctcttttttccctcccctctccacctttcttcctctctcctctctcatcccctctcttctgtgtatctaccagaacccgctcgcgtgccgcccaaggaggtggtggctggcggcgtcagcgccgtcaaggagtacatggccaggcagtggcgcgacgcccgcgccgaggaggcgcgccggggcagcgtcgtcgccaagagccccaaggtgtcgatgcctaagaggtggcttgtgcgcagcatgtcattgatgggtagatgggtgtccgacgtcatgaggtacaacaccgggtaggcggcgagagaggagctgtgcgcgagcctctgccggtgaaggagcggcacgcaagtggtgggggagtagctgcgcgcgggggtgggtcgcacttcttctgcccatggcgaggggatagcgtggagagccgccgcccatggcaaggacgccatcaaggtcgaagggcggcgcaaagatggaggagacgcggaagagcaagatgtggcgcgcgtcctcctccttctcctcgaacccgtcgccatcatcgtcgttgtccaccactgccccgctccgcgccgccagcttcgcgtgccaccgccttgcaggcctatctactccgcccaccaccgcctcgctccacgtcgtcggcttcgagcgctgccgctctgcccaccgtcgcccctcttcacctacctggtccgcccaccgtcggcttcgcgcgccgtcgtcccactccgcttggctgctccgctcaccgctactccgctccgccctacctgccgtcaccccattccacctgccttccccagc

SEQ ID NO: 1038 - DNA, 1501 bp, Oryza sativa
agaagattcaaacaagacctcagatacttttaaaaattaaaatgtgcattataagaatcaacagatttatacgaaagggccatataaaagaatgtacctgttgacgagaaatccgcgctcggccgatagtaccggaactgtgttggcacggactaagtcgacgaaaacaacggcctgggagatctgcttagctcaagtgtaggtccaaaggttgatgagatacgtgcgtgccagacagtttgatcctacaactgacaagagatacaaatagcaaattaataagccgatagagtaattctaaccgatgccgataccagccgatagcgataatattttgagctatcggctatatggttgatgtagaatctgacaatcagttgatggtaatataatgaaataacaatataatccagtagaaaccaatcggctaacaatgagttgatcaaataagcactgatccaaaggttaaagcatacatcggctgaagatccgatgccatgaaattcacaagattagataaacagtaaaatctttgttgtgatcggccaatctaacttgtatgtaatccttataagccgttgcaacatccagataactcatcggctgaaaccccgataaaacctttattggcaatcaaaagcaggctagggactatggttctaagcacgacttagtagatcgaatgtattgatgcagcattaaatgtgaaaagaaacataatatctagacaatcaagctgttgactgattttcagggtggtagttgtctaaggtaatctaatctagcaagacgatttagctgatactgacagaaaccctaaaacgagagatagccgatagaactaaattaagatgctaaaattagattaacagagacttcagtgtaagcttaacaagccagctcgtgagctgctcatttagctcactagtataaaatatcatcgtatctttatatacttaattactcttgttaactactacttaattagtcttttagttatagtcaaactatatatttgtatttagtgatttctttgctaattattgtttattattacgttaatatatgataaaatggtaaatttaaaattgtacatgtaatacaaatgagatatatatatatagctcgttaattaatgagcataacgagcttaacgagcgagctgcgctagctaggattttttttagaagcacaatacaaacgcagacactcacagcttacacttagctaggattttaactcgttaaagttaacaacccgagctgaactgggttgttatccttacctatctccactgcttgacattttgtgttcttgtatgggctataggtttctaggaggacatccaattaatataggataaacaaagattaatcacaagaactatggttgatgtgcacaagccctgcatgtagaagccaaaggtgtaattcatcttccatatctgcaggtatcctgcgattcttcaaaatctaaaaatggattactaccgctacttcgt

SEQ ID NO: 1039 - DNA, 1501 bp, Oryza sativa
tcaatattgcttatttttaattccgaatttcagctatttttaaatcgtatttctacttggactctccttttcttttttttctttttctccgattaatgtgggaatttctagccccacagcgaacgtggtgcctcctttcaaagctgttttaataatataactagctgggtggcccacgcaattgcgcggctagcaacaaaataatatttttcggtatgattttacttaaaatttattaaatatctatctcattgtcttaagactttgaaaaaccaaacattatcatccacgtatttctaattatataatttttaaaagtcacaacagctgctaccccttacttctatcatatacttctttatttgcttgctcgatgtaccactatttttattcattctctttgaaacctttaaaaattgaatcttagtttttagaggttattgtctcgctgagtttcatttttataatttctagaagtcctgtcaaaggctgccattatacttctctacggcccgtccactgtcttttctcttttattatcgttgggattttaaaaatcgaacataattatcattcaggttcattttttactttctaaaagtcccaccaaaccgttagcggctttgccattgtactcctttatggctcgcccgttgtctccattctttattgtcattgagattttaaaattgaatatgattatcattaggtttttttttactttttagaagttctggaccttaattggaccttgtagtttttagagtttattttctttttgggtttcattttttgtaacttttagaagtcccgtcaaacgatgccggtatactcctctacggcccatatgccgcccactctttattgtcattgtgattctaaaaatcgaatataactatcgttggaatttattttttttattttctagaggtcccgccaaccatcggcggcttctcctttttattattattgagattttaaaaatcaaatatgattataaatggggtttatttttttactttctagaagtcccggcaatcaccttgctcgtttgcttcacggcatgcctgttgtccctccttttaatcgtcattaagattctatttggtgttttattaacaatttttatatgtactatcaaccgctaccactctacttctttataggcttgttacttaatttatctcgtcatatgttttagatggtcttttctttcaatagtctttattttttatcaccaattttagttatttataaattgtattcctaattaaaatcttttttctttttataatttcagaatttattttttaaaaaccttttttattttaatattttaatattttttatttttgaatttcatgtgtttcaaaattgtattcctacttgaactctcttttaattttctaattttggatattattttattttttattctgaattttaattaatcttgtattgggttcttatatggactcttctctcaatattgcttattttt

SEQ ID NO: 1040 - DNA, 1501 bp, Oryza sativa
ttgaggataacaaagtttcagtttccggccgggctgtcgcgcgcggcaggtatttatagggagcacgcatgcaagtgcagtgaaatgtacgtataaggtacagtcgagctgtcagtcagatacttagattaatggctcaagcatgttgctttgcctgagcttgatccacgatactactaatctttatgtaagcaagcacttcaagtcatcttctagggggtatctggttctttttaggcaccatgtgacactttttttttggcgaagcaacatgcagcattgcaaactttagttctgtagtcattcaattcgttgcttttttttttttctgtttggtgcatatattgtgctttaatttcaaactactgaatgcgatatctggagatcgatcaactaaggccatgtttggatcatttagtccctagattaaaaactttagtcccctattatttggatctagggactaagatagactaaaggcacgtggatcaaaggagagagaagagagaggctgccattttagggagagaaaagagagaccctataagtactttcaagagggactaatggattctagttctaatatgtacttgtattcctttttagtcatccatgtttgaattcttaaggtctaaaagggacttaaaatagagattagtcctatgaacaaatagagcctaagaaacttttgtgatgatggctaaaggctaaagctattatacgttccttcattctgtctgattttctatcacatatgccctgcacttttgcctacgcatgcctgaggtctcttacacgttacaagaagtctcatgtcaagcagagcgagaattattagtgcaggaaaacctatacggagatgaggcggagaagtgtagtattaattgatgatggcggccactactctgcagacgttgtggccggccggtgcccgtcgccagcatccttatgtgatgacgacggtggtataatggtatatagcagctagcgtacaagaagtggagggctccgacactattcccggtcgagccctcatatacgtctggggctctaattaagatgctttggcgtgcttggagctgcttaggaacaatgctacatatccctatacaggttcgagcctcctagatgataacaacactgctcctgtgcagatcaggatgccccatacatggatgtgtagatcggatgccctgtatgcgtgcacacctcgcgagattataggctaaaaataatacatatttccctccatagtaaatactaaccacttgtcatccatgaaattaagttagcaagataccaatttgatcactattaaaaattggtgtatctataaatctaaaatgatctatcatattattaaacaatcttaaaaggagacatcacatttcctgttgaggctataaataccattaattggagacagagaaaaaagttcaagcagaaatacaattttaaagtaactgaatttcagaataaaaataaggaacgtcgaaagaaa

SEQ ID NO: 1041 - DNA, 1501 bp, Oryza sativa
ggcgtcggtggtgtggctgtggcgtcgtcgtcgcctcgtcggtggtggtggcagcggcgaaaaggcgagaggcggcgggacggcgccgcgagatggtgggggcgaggacggagcgaagaggaagggcggcgcgagatgcgagacggcgggggcgaggtcgcggggagccaaggaagcgaggacggcaggccggcggtgggtggtggcgcgctctggatgcgccgctccgccgccgcctctggatggcgatgcgccgctcccggcctccctcccgatctgtctgacttctctctctccactctcttctcttgggttagcagcttgggttgggccggctggggacttggggagggattatggactattgattggatgggcctttttaacttcggaaatttcgacaaattttccggaatgtttccgaccgattccgagttccgacgcaaactgcgattatcatatttgattccgtttccgagaaaatatttccgttttcgattccgtttctgagaaattctgaaaattttccgaccggctgattccgtttctgaaaataggtacggaatccggaaaaattccttaccgttttcacccctaccaggaggggtggagctggagctgtgccaaacaggcccaaaatatctattgaaaaaagagctaaatattttttttccgttggaatataatcatgtctgatcttgttgtaaagatttaattacaacgaatataacagtgaaatcgaattataaattgaagaagtaatttaggtgaaaaaaatagtttcaaatttgctaaaaagacttaaaacaacctaactaaccctacagaaatctcatgcatgctcctacaacactgctatgtgaagggtcaacgtgagagaaaggggtctgaccaatttacatgtaaaggagtggagtggagtgtgcgtgtgttgaggagcgcacgattttttagccagttatcgggcgcccgatccgtagtcgtatcaaactaatcctaatagttaagttagtattagaaagacttatccaaatacattgcagatctaaaattcgaatcacatatttaacaagctttattgtcttttgggtaaatttcttcatccaaggtcccattaaattctgcatcccatttggcatttcacaatcaaacacacattttactgtactccaaacgaatttggcaatattttcaatcttattagatatcggaattgctgtcatgtacagattatttcagccaggcgcccaagctagctattggtctccatgtgttctgcgacgacgatggctgcattttccccgaaaatatgttcagactgaagagagagacgaagaaaaaagagaacttggttgaaataaacggaagattgctacgttctcttctttcatgtgccgatgtgcctcaagtgtcggtttccaaatccaatcaaccccttgagtaaagtagtacgtactgtatgaggaattgacgattgatcttaagaacagactcatcgatc

SEQ ID NO: 1042 - DNA, 1501 bp, Oryza sativa
tgcattgaggtcgtccatgaccagcggtggcatggagagcttgccgaataggaggcctttgcttattttcatgtccgcgaaccatgacgcctcggtggcgacaacatcgatgccgatttctgcaagctcgatggcgctgctagattgtcgcagtgcagtagtgaccccttcagggcgcttgaggacccagctgctttcaccaagcttgctcaatcctgattggtagtatcggaggaggccaaggagatgtggtttgcagctaatttcattcaagtcgaaaggattaatgttatcatccaacctgacattgaaacttgcccctgcattagagatgaagttatccacgggcacgggtacgggcatgaaggtcatcagggcctcgagcacaacccacgggatctggttctccagcataaacatgtccctcaagatgctaggttgcttggagccgaaccaagtttgtaacaatgggtcaacggctacatcgcacatatgagccataaattgcagcaagaaacaaccatcgcgtatcatcatagctgcaaactcggcttttcgaacgcctactaccgcatcgccctcgtagcagcttcgggcaccgcttgcgatggggaggatcttccagtatacttcatctgccgagtgccctgtgttcttgcagaaatcgcagacggcactccacttgatcttctccgcctcctgaaggtggcgtgcaccatggtggtaggggccaattgccacaacactcgggacgaagtagcggtagtaatccatttttagattttgaagaatcgcaggatacctgcagatatggaagatgaattacacctttggcttctacatgcagggcttgtgcacatcaaccatagttcttgtgattaatctttgtttatcctatattaattggatgtcctcctagaaacctatagcccatacaagaacacaaaatgtcaagcagtggagataggtaaggataacaacccagttcagctcgggttgttaactttaacgagttaaaatcctagctaagtgtaagctgtgagtgtctgcgtttgtattgtgcttctaaaaaaaatcctagctagcgcagctcgctcgttaagctcgttatgctcattaattaacgagctatatatatatatctcatttgtattacatgtacaattttaaatttaccattttatcatatattaacgtaataataaacaataattagcaaagaaatcactaaatacaaatatatagtttgactataactaaaagactaattaagtagtagttaacaagagtaattaagtatataaagatacgatgatattttatactagtgagctaaatgagcagctcacgagctggcttgttaagcttacactgaagtctctgttaatctaattttagcatcttaatttagttctatcggctatctctcgttttagggtttctgtcagtatcagctaaatcgtcttgctagattagattaccttagacaactaccaccctg

SEQ ID NO: 1043 - DNA, 1501 bp, Oryza sativa
ggtgccctcactatcctggtcatctcccagtttcttcttgtttgggatgtggtgcttcacattcagctctcgccgggtgtcgggaatcgtcttatttggcgttggatgagtgaccagcgctactcgacacgttcggcataccaggcgtttttctatggccagcacacttttgcctgtgttgttcttcactggcacgcgaatgatcctgctaaatgcaagttcttcctctagtttgcattttagcagcactgctagatggccgatttcctccagaagcgtggtattgatagccactcggcctgtcccttttgcacttaggagctttgagttggcgaaccacattctccttgactgcatgtttgctcgataggtatggctctgtgtgctgtcgccttctgatcgggctgccctctctcctcctcgtggcagctggcttcaggactggtggccttcttctagggtatgtttacctgagcatctctgtgccggcttcgactccatggtcctcctagtatcttggcaactttggaaggaacagaactccaggattttcgactctatgctctcttttctgtctcaatggttctagagtccatcctcactaagggccatctatggtcgttagctagcgttgcttgttttggggttttcttggagggtagtatggctctgccccattcccgctgattggagttgtgtttagccgtcatagtagtctcttccttttttcctttgttttttttcttgttttgtcttttctcccttcccttggcataagctggtcagactgattgtgttgtgtaaacaaacactcttttcttctaatatattgatgtgcactacttttatgcatgcgcaaaaaaacatattagttgcattataactatagtacaattatggcccgcgcaataccatggctagcaccattacaaaaattatctaatttgtttacacctgattatcatcttattgtcttaggatttcaaattttattttttattctgaattttaattaatcttatattgcgttttatatggatttttctttcgacgttccttatttttattctgaaattcagttactttaaaattgtatttctgcttgaacttttttctctgtctccaattaatggtatttatagcctcaacaggaaatgtgatgtctccttttaagattgtttaataatatgatagatcattttagatttatagatacaccaatttttaatagtgatcaaattggtatcttgctaacttaatttcatggatgacaagtggttagtatttactatggagggaaatatgtattatttttagcctataatctcgcgaggtgtgcacgcatacagggcatccgatctacacatccatgtatggggcatcctgatctgcacaggagcagtgttgttatcatctaggaggctcgaacctgtatagggatatgtagcattgttcctaagcagctccaagcacgccaaagcatcttaattagagccccaga

SEQ ID NO: 1044 - DNA, 1501 bp, Oryza sativa
ctagacatgctggagggctgggcatcctaaaccttgaaaaagtttgcaagagcattacatctcagatggttctggcatgagtggaggtcaccagaaaaagcatgggtgggatcaggaacaccataagacgacaccgataaattcctcttcgcagcggcgatgaccttaacaattggagaggagccaaaataaggttttctgggattggcttggtaccaggggcgacgcctaaaggatataacaccgctggtctacgcgactactaagaaaaagagcgcaagtctacaacaagcgtcgcaatccgaccaatggttggttgacctcaacctactgacaagctcaggttggacgacggagctaattagccaactcgtcaatgtctggggtgttgtccacaacctataattgacggaacacgaagaggacaagatcacatggaaactaactagccacggcgaatacacgacggcttcggcctacaatgcataactacttggcaaaggagccaagagacggcccaccacctcctggtgggatgtatatacgtgaggagaatttgggcggcaatagcagactgggcgacatgcaaactactaaagccaacgcaaatggcaataaacatcaacgctcctcgagtggtgggaggctactacaacaccagtgaagcaccaaaaaaggccctacggacgctaatgctgctagtcgcctgggtgatttggaacgaaaggaaccgcaaggtcttctagcaaaaagagctcccgacgaccggtataataatcaaaatgaaggaagaggccagaatgggccttggagggagtgaaacacctcgcagctggcttactccctccggtttgagattaattgatgttatgggttactccctcaggtttgagtttaatttacgttttagctttctccactactctctcccttctatttctccagaatacctctcatgcatgcatgcaaacagaaaaaagtaactgctgattggagtattaatgaggggtataacaggaaatatggatctaattaatactgtcattggtatttgccatgatgtccaaaacatcagttaatctcaaaccggagggagtacgttgtaacaatctcgggccaaagaccttgagcctgtacttttttctttcttgtgccttgtgcctgtacagttttactcctttattcaatgaaattggcggctcgccaattcattaagaaaaaaaaagaaatcataagatggaaaacttaacttttccagattcttataaattggccatatctctaatcttctccaaatacaaccatagtctcgcttgttcataaatttgtttgctgttcagtgtagtggactttggagttcggagtaccgtagacactcccacaccagatacttcctttggttttagatatatattacgccgcagacttctaggcataatttgaacaacgcatcgtcttgctcaatagtacatgaatctgcttttgaatatcacatgaataa

SEQ ID NO: 1045 - DNA, 1501 bp, Oryza sativa
tggcccaagtcggcttaaatacgctgagagccgtcggattcaatcgaacggttaggatcgctcgatatatatatatatatatatatataacattccatgttgaaaccctaaccctaaactcattatcctccctctccaaccgcgagtggcgcggcggcggtggcgacgcgtccaaggcgaggcggcggctacctgccctaccacgagcagcgacgacgatggtggcggcgacggcagtggctacctcccaaccacgagctacggcagctacctccctaccgcgagcagcggcagcgacggcggcgtcctcccccgtcgtgagcggccaggatggtgccctcctccattgctagcggcggcggcggcgaccggcgatctcgcggcggaggcggggcggcggctacttgccctaccgcgagcaacggcggcgacggcagcgatagcgatggctacctccctaccgcgatccccatcttcctcagcggcggccggtgatctcgcgactgacgcggggcagcggctaccttcctcatcacgagcagcggtggcgatggcgacgccctcccccatcgtgtgcggccacggcggtgccctctcccaccgctagcgacggcgacgacggccttctccaccgcgagcggccgcggcggcgtcctccgatgggtagatccggtggcagcggtgtcctgcgggtcggcggagcggcctcgacgacggcgcgtctcgaggcgctggcgctcgcctctcctccccatcttccttcgccaccaccgcccatcctctcgtcggatgacgagcttgtcgccatcgtcaaaacgataaatcgaggttgctttgtgattaatttgcttgattccattgatttcaaactttctatcccgttgatcatcccagctgattttattgagttcgattctgagtctgttggtttaatttgtagatgattttgtatcaaactcttgttttttttttctttggccattgtactgacctaactgcgctaggtcggattgacggacccaaaaatactgtgatgattggaaaaatacaaatatttatattagttatagatatactattgcgcgttgtaacagatgaagacaacttttataattgataaaaactcccaccaatttaaacgataaatgtcaaaactagattttggctaatctaaagtgggtagcgaacaagcagaaaagtggatgggttatgatacaaggaaatttttacaggttcaggcattctcgataagaaataataccctactcatgtctggggaaatattccgccgattgtgttatcgatctgatgatcttatgtgtgattatgccccaagaggcatctaacccttctttagatagtctgaagagctagcattacaatgcaagactatcccttacggttcagagtcctgttaatgccaaaatttggtaagccccgaagtcatcatcggcccagagtcagtatcggcttcagagttatggaatcggccgatgggatt

SEQ ID NO: 1046 - DNA, 674 bp, Oryza sativa
ttatgcatctaaagtttatacacttaaagtttatagacccaaagtttataagtcaaaagtttacatacccgattcaaatttgaatttgaattatatccattcaaatttgaatttgaattcaaatattttctatatatggtatttctatgcatctaaagtttatacacctaaagtttatagacccaaagtttataagtcaaaagtttacatacccgattcaaatttgaatttaaattcaaatattagtttatagacccaaagtttataggtcaaaagtttacatacccatttcaaatttgaatttgaatttgaatttgaatttaaatattagtttatagacccaaagtttataagtaaaaaattacatacccatttgaaatttgaattttaatttaaatttgtatggtgtagtagtaagaaaaaaaggggaggtaaattagtaagggggaggggcgggtgatcgcttggaagttgggagggaagggagcgatcacccgctcattaggagtactcatttaccccctccgtcccataaaaacccaacctaatatcagatgtgacatattttagtactacgaatctggacatacacatattcaaattcatcgtactaaaatatatcacatcagattctagattcgtttttaatgagacggcgggagtaggtagcaaca

SEQ ID NO: 1047 - DNA, 1501 bp, Oryza sativa
ttcttaacaaaatgtgtctgggtttaaatgtacaaaaaaattaataacactgatattttatttttatttttattttgcggggaacactgatatggtattagaacgccaactattgatatcggaggataatttgactgctgccatatgcagttgagattatattgtacaggttgggaaaccttgcaagcttgtttgttacaccatagcaaattctcttgtagcgatcacatcatgcgcattctcctcttgcaattgcctagctaaagcttcatcagatgccaaccgggcctcaatcctgtgggtttctgaggagatatggactgaataggtatctggagtggccactgatgaacctgcaactatttgctaattaacaccgacaataaatcaagtaaaccaaacattacagaacctgtctaaaaaaccatcttaatttagaagaactcagattagtagtgttcatgcttccaccaggagcaggtatgtgcaacctgcacttcctgtcgtttccatgctgatccaggaaagacaatttcccctgtggctgatgcactattagaacacatcctccatgcagatgcatctgttctttttttttttttttgggggagggggggtgggtgggggggcgggggagatcaggtaattttacttacccaacctgaaaacccaggcccaaaacgatacatagtctggaaatgcgtctaaatttgactcttaaagtgggcaactacgatttttaaattgtcgaacagtgttcaaatttataaatagtttcccaaattcagatcctatcattcccgaatgtgcacatctactacagtaccacccagtttcatctgaacaggactgactgacagaaatgtgtgaaaaagggacgtcattcccaaatataatcctccgtcagaaacattcatttgattgtactcggagagatacaactcgcaagcacacgacattcttctgcctttccaattgccacaagcccaacatgtcacatgaccagccaaaaagagaatttttctttgcacaatcaaaaagtgacacaaaggtgcgatctttcttctctctcccactttccaatcaagaaacgaagcgcacaaaccaaccaagaacaaccaaggaaggagaaataagagatgagcccagagcaagaccgcataatcatcttcccagaactaacgaaaggagagaactgagatgtctgcttgcccggccgctttctccggagtagcagcagaggagagcgccttccgaacatatcagcatacaaatgagcgattccaacaacagcaacttcccattcatattccgccacataagtctcagtgcaagaaaaataaaaaatgacgagcgaaagccaggtacctattgccaaaatattttgctccaaggaacagatgatgattgcttgaaccgcttgctttatttgaagatactacattgttaacagatcaaagagagagagagagagagcagttcacagttcacaccaggcgat

SEQ ID NO: 1048 - DNA, 1410 bp, Oryza sativa
gggttgtgccgtgctgggagggcggggcccatgggccagggagatcggttatttgatggtccatgacgggtgggcccgggattgtggtttatgataaaatcagagattcagagcagctcacgtcacagctcacgctgcttaattatgccatcatctctttgatttattagtactactagtagctcttttttttttccttctcgtagcttttcacgccctcgctggtccgcctaatcgtgagcgaaacttaaataaaaactgcggcgcacaaatttattgaattgaatttgttatgcaactcttacatataaaagtataattagatattgaaagtatgattaaatttaatgttcattttttttcttttgtttttatgtagttataatagtgtctacttatgtctcgctacgatctaatgatggcttagatttttttcgattaatatggtaattttcaagccttcatagcaaatacgttgtttccttttcgagttgtctttataattataataaaataattaatagatatattgatatgaacaagagtgtatatattttagttaagtacacttgcgggctctaaatttgtacaggtgtgttatctagaaccctaaattctcaaattctcaaaacacatgttcgtgtctttgaatttgtcttagtgccatatagatctaaacgggcatcaacccgctcttaggctgtgttcattaggattagttgggaacaagtattctgtgcacggaaaacggagcggtccattaacacacgattaattaagtattagctattttttcttcaaaaatggatcaatgtagtttttctaagcaactttcgtataaaaactttttgtaaaaaatgtactgtttagcagtttgaaaagcgtacgcgcggaacacgagaaagatgagttgggaaaacttgctaccaaacatatccttagtgttgacatgacatgccacggtggcgcctacgtattagtaggacccactaaaataaaaataaaatttaaaaacatattttctcatgttagatagagaggagaaaagacaaagaaaataaaaaatcatttttaaaaattttaaggtagagagaagaaaatatgttttttttcctatatgaatgttacgtgggtcacactaatacgtagaaaatattgttgcatgccatgtcaatgtacaaagcaaattggaacatgtttggacctatatgatgtcgaagatcaatatagaaacttgaaaatgtttaggggtctcgatgatacacccatacaagcttaggaccgaatatacactccgctcttaaatatataaaataactataaaacatgtgtttgtttttggaagtgggatgatattgattcatatgcaggactcttctaaacatggatggacagaaaaggcacccataa

SEQ ID NO: 1049 - DNA, 1501 bp, Oryza sativa
atgaaaatgctcctcttcgaacgttcaatcaaatgaaaaacgtcggatgcctacgaccagctcagttcttacatgctaatttctcctttctttatgttgatgccagggaaatgctgcaaatcagcagtctggtggattggacgaacccttatcgtactgtaatatacatgcacatgcctagttgtttcttttcattctttcctcctctctttaaatattttttctcctaaattacttatccgatctatggaccgatcacaccgttgtattcgttgcaattaaatatttacaataagatattacatgattatattatgtcaaaagaaaaacatgtgtttcaaaccattaaaacaaaatgtttcatacgtgttagtgatatgtttcaatatgtgtcttgtttcacaaaattcctgaaactacctgctactactctctctccacctcatgcatgcatacatgcatatgttttagcaagcttcaaaatgatttttccctcaaattacctattcaatttatgatccgatcactacattgtatttgttgtaattaaatctttacaacaagatatcgcttgattatattttgataaaagaaaaacatgtgtttcaattcgttaatacttgttgtttcatatgtgacagcggcatgtttcaacgtgtatcttcaccatatttcataaaatatctaaatgttccaattgctgattttctttttcaccatatatatagcatcatgttttacttgttggttaactgcaatatttaaccgttcgatttttttttcaatttaaaaatgtttcacctaatatagtcatgatgtttcattctgtaatgatcaaatgttaccgtgaattgaaacattctttcgctattcgctgaaacattattttcatataagatgaaacagcatccgataaaacattttcgatctacttaatgaaacaattccgatatacttggcgcaacagcgtgcaacagtaaaataattcaataataagctaattttttttatcggattatattcatgtgtggacttgttttaaaattttaattgcaatgaatttaatggtgtaatcggatcatgttttggataaatattttaagagaaaaaatagtctaaaatttgtttaatccatgcatgatggatggctggcgcacctgtgcatggatcgaactgtcgcgcgagacgtccgatttttcgtttcgcgccgtacgtccgacgcgtagcattctccgagtactcgctaaaaaaatgatccaatttgggattcacactcgtgggtttgatgagccggaagggagcacgtcaaagtggggccagttaggacggcccattaggcccggaggagcgcctatctgaagtccaacacccgtccaggcaccggctctccgccgctcgaagcttctctcttctcaccggaatctcgagagcacagcgccgccccgacgacgagatccctcaccggcgccgccgccgccgcggccaggaggccgaggggcca

SEQ ID NO: 1050 - DNA, 1501 bp, Oryza sativa
ggtaacaactagtgttgttgcttataacaccgtgtcctagcacctagccatcaacatcgatattgaccgttgccacgatctcctcctagtgatgttatcgtgcttcattgttgacgggtggctttgctcaggggcgtccttaggcccatgcgggctgtgcgaccgaacagggcccccaaatttcaagggccctaaaatattaagtatacccaatatataataatattaaatgcttcaattttagtaaaactaagcccccaaaacaatgcaaaaggtgaatgatccattttccaatttccatcgtacagtcgtccgtgtcgtcgaagtcccaacgccacgtcgcttcgtctcctctcctcagttactaggccactaggatccattttaatatttcgcacggggacccaatttgtccgggatgcccctggctttgctcatgacaaagacacgagtgtgtgtcgtgggcgtgggatgctgccaaactcacgaggaggaggcaccataatcctgcgacctagcatgggctgctgccgactgattttctcgtgtcgtctcgtctgcaagctcatcctggtgggagcacagcacagcagagagctagacgaactcacaaccccaggtgaacgtggtcaagttgctcaacatacacgtgcaaagctactttagctcctagaggttttgcatgggtttaagggtgcctctcctacgcacgacgacgacgaaaacaggaaagggtgggtgggcacgcttttgcagctgaactccccgagatagagcggtttgatggaacccgagagacaaaggagacaacggcgtgtgtttggttaattcggcagcatcttcggcacgggaccaggcgtagtatcgcgtatatgccctcgtctcgactccgccgtaatctgattcggccgcggtcttcttctggagaatattatgcttgctcattttatgctgtgtttagttggtgaaaagaaaatttttaagtgtcacattaaacttttgattggatgttaaaatgagttctcagacacgattaaaaaactaatttcataacttggttggaaaccgcgagatgaatttattaagtctaattaatctttcattagcacatatatgttactgtagcacttatgattaatcatggattaattaaactcaaaatattcgtatcgcgattttcatacaaactgtataattaattttttttaatttatatttaatgcttatatatgtgtctaaaatttgatgggaattttttgagaaaaaaagtttagggaactaaggtgtccctcctttccaaacaccacctaaacaggcctttacaatctacaaaaaaggcacgggcatagcacgagctttgcccttttttctcgcgctcgcacatcctctctttccacagttccactaaaaaaatccacttcacctagcagccgctctcacctccacgcgctctccgccaccggagcacgagcgcgactgccaccacctccaccggattcat

SEQ ID NO: 1051 - DNA, 1501 bp, Oryza sativa
ctatgtagcctgcacaagtgcagattcagttattatggcatgctgaattttgcctgagcgtccagtcctgaggcctcgcagaggcgctaaagtagcaacaaaactgaagaggccgggctaagctagagacgacgtacgccccaccaccaaagcagaagatcgaccagagacctcgaataacccaaaacagcacgcgaaatctcgattggttcattctcctgcggacaagctgtaatgatgcagccagtattttgacagggaagccctaccatgcggctgacaaatcacgtcctcgtttcaaaacagaagagggccggaacactgggggttacaagtgatggacctggtgccaaagaagatgagtggaacactgagataggtaaaaataaaaatgccaaaggagaacgctgtgattaacagtgctaactgttcaggaaggggataaggtgatccatatatatacgtgttctccagcgagctagcttagagccttagctatctgtccaatccgagtgcctgtgactatggacggaatgtaacgaccacgccgagctatacaaagattagacacagtgatggtctgtttgatgggcaaccgatgagatgatccctgcaaaggttacgccccatcgcgagcgactgaaaatagcactgtggcactgcgccgaacgcgtcgaattgcgaccagaccacatcatggaacagggcgccaggtgggccggcctacacaacaccgagccgcgaggcccacccatatgcatcccccgtccccgcccgctgctcggcgaagctctatcggcatcagcctctgtctgcaccccgatccccaccactcgtcctgcacccctctgcccgcttttcagacggaacagtcccaagatgctagctaccggctactgtcgcagccactgttcccagtcgagagcgagagagagagagagagagagtgtgtgtgtactggacgcttggctttgttgcccccctcgcgtttcccaatctgcccccggggcgcagtggcctgtggcctggcctgatcaacagtggagcctgctgcgtccattcacccaagggccaaggctagcagcagctcaggctcagctgatgcgttgccttgctctctttgtcgctgtcacggctggggtcgcgaagagggaaagaaaaaaacacactcgtcctctctccccggccagccagccggccggccattatttgcgtcccgggctttcaaatcagaagcaacaacagatccgaggctttctcgaatcgggcaaggtccattaaagcatcaaatccatcaggagctagtagcagcgagccactctcactcacgtacccatcaaatcaagagaaaccgcctcaaacctcacctcaccctcacctcatcacatcaacggaaatactatcacatccagaccagagggggaccaaataagccggtgccacccatatatataccccctccgatccctccctcttcctccccccatccgctagcttcatc

SEQ ID NO: 1052 - DNA, 1501 bp, Oryza sativa
ataaaacatgattaatactttatatgtgacttatctttttaattttttataatttttttaaataagacgaacagtcaaacgttggatacggaaatccaaagtttgtctttttttttacgagggagtagctgtggctcgttctcgaggtggtgctgtcgcatcctttgaattaaacgcatgtgtaatcatttttttttctaatagaaaagggtaaggtgacgcatgctaatgagtttgtgccgattcttcgttagtttactcaagtagatatggtaaacaaccaaacaatagactgaaacatgcataaattgcatacaagatattgagttttacttttccatggagttgaatgccttggaaggagcaggcattttatacaagttcgtaaaatattcaaaattcgcaagaagccaaagcaccgtgtccacagcgcgcctaatgaggtaatgccaggtttgatgcatcggatatttgtaagaatgaattaaccagctgacgggacactgacgttgtacgaacccagcaaaattcaacattctgaatagtacccgaattcaattcctttccgggttcaaattctcttttgaactttgcgatgcatttatccttatccatcacacgcacacacggcacacgggtgtttatgctggtgtgcggcgaaacaccccgagtatttccctcgttttgatcattcgatcattccatggtttggttccaccatttggacagtcaacccggcaattgttggcatcaagcgcggcggatggcagcgaccgccgaccggtacaccgcccatgtgccacagcccgcccgcccgcgcgcgccagcggccagcctctcgcgaatcgatcccaaaaacacaacgtttacaaaaactattatgaactagagtggattttaataggagatatttataattgtttacacacttaaataattaaaaaacaatggtaaaattaaaattttgagaagatatattaacatatgatatatcaaattttaagttataccatttaaaaaaggtaaattaaacaataattaatgcatatttatagttaatttttttataatatgttgaagttaaatttaaatttgaatgtctgtgaagcgatttatattaatctatcttttcataaaaagtttaatattttttttgcgaggaaaagtttaataattatttaagtgtgcataccaacaacaagggatgtcggtaggatggtactatccaatagtttccctgttacgaactcctccgctttggtgactcgcgacggcgatgcgcgggcaccacaaagccgccgcggctggtggccgtggccgcgtcgctataaaatcccaccgcggcttcgtctctctctccatcagcccgtctcgctcttgctccgcgttccgcttggctttccggctttagcagagtagtgagagagagagagagagagagagagagagagaggaggaggaggaggaggaggaggggattgtgacttgtgatctgcgagga

SEQ ID NO: 1053 - DNA, 1501 bp, Oryza sativa
tagtggaactgtggaaagagaggatgtgcgagcgcgagaaaaaagggcaaagctcgtgctatgcccgtgccttttttgtagattgtaaaggcctgtttaggtggtgtttggaaaggagggacaccttagttccctaaactttttttctcaaaaaattcccatcaaattttagacacatatataagcattaaatataaattaaaaaaaattaattatacagtttgtatgaaaatcgcgatacgaatattttgagtttaattaatccatgattaatcataagtgctacagtaacatatatgtgctaatgaaagattaattagacttaataaattcatctcgcggtttccaaccaagttatgaaattagttttttaatcgtgtctgagaactcattttaacatccaatcaaaagtttaatgtgacacttaaaaattttcttttcaccaactaaacacagcataaaatgagcaagcataatattctccagaagaagaccgcggccgaatcagattacggcggagtcgagacgagggcatatacgcgatactacgcctggtcccgtgccgaagatgctgccgaattaaccaaacacacgccgttgtctcctttgtctctcgggttccatcaaaccgctctatctcggggagttcagctgcaaaagcgtgcccacccaccctttcctgttttcgtcgtcgtcgtgcgtaggagaggcacccttaaacccatgcaaaacctctaggagctaaagtagctttgcacgtgtatgttgagcaacttgaccacgttcacctggggttgtgagttcgtctagctctctgctgtgctgtgctcccaccaggatgagcttgcagacgagacgacacgagaaaatcagtcggcagcagcccatgctaggtcgcaggattatggtgcctcctcctcgtgagtttggcagcatcccacgcccacgacacacactcgtgtctttgtcatgagcaaagccaggggcatcccggacaaattgggtccccgtgcgaaatattaaaatggatcctagtggcctagtaactgaggagaggagacgaagcgacgtggcgttgggacttcgacgacacggacgactgtacgatggaaattggaaaatggatcattcaccttttgcattgttttgggggcttagttttactaaaattgaagcatttaatattattatatattgggtatacttaatattttagggcccttgaaatttgggggccctgttcggtcgcacagcccgcatgggcctaaggacgcccctgagcaaagccacccgtcaacaatgaagcacgataacatcactaggaggagatcgtggcaacggtcaatatcgatgttgatggctaggtgctaggacacggtgttataagcaacaacactagttgttacctatgggtactaaccagatgatgtgtcatatgacgtacctacacataaggtgggtgagaaacatgatcgcttcaccatgttaggtgccaatcaaa

SEQ ID NO: 1054 - DNA, 1501 bp, Oryza sativa
aacgatagattaattatgcttaataaattcgtctcgcggtttccagacgagttatgaaattagttttttcatttgtgcccgaaaaccccttccgatatccggtcaaacgttcgatgtgacacacaaaatatttctttccgcgaactcaacaagacctaaggcgccggctctaggtacactgacctacgcactagggtgaggagggtgtactcctagctcaagctctatgagcagggacaaatgaatgttgactgctattaaacggaattctccattccgaacggtatgatacgagatggatattagctaggcttgctaccacgtgaataccggtcttgttacttatagcatccccagtagatgatctatatttgattctccaaatgcccgtataaagtatcatccaaaaaatatttctcatccatatcccatcattctatattttagtaatatcttccaactaaccttacatttgtattttaagaatatcttccaactaaccttacatttgtattttaagagatatattttttgaactacttatttatcgtgataatatttcaattagattttaacggaaatctttttaactgatatatttaaaatgtggtgtataaataaagtgtcaagtgtcaattatattttctatactgaaaagagctcttctgttccaaactttcgttttatctgttcttctatgctctcaaagagctcttcttttccaaacagggagaggcaggcaaagggacgggggagatggtgaggggcggcggcggcgggctgctcaggggtggcgctgggcgacggcggcaagggaggcgcggcggtggctcacgggcgcagggcggcggcggcggctcgtgggcgtagggccacagcggcaagcgaggggcggcggcggttggcgggcgcagggcggtgaccacgcgcggggagacggcaacagacgaaaggcgcgcacgccggaggaggaaggcgcatggagacggcgccccaaatctggtaaggctcgctccacaaatcgctgaaaaaaagcaaaaaacagggatggggaactcacctacgccggttggggacaatggcgatagaggggaaggctcgccagaggggaggtggttgccgatgtctggatgggggcgggatctcgatccggaggtgttgggggtgaaatggcgtgaggagagagaaacactatttttacctcttctctcttactatggcgcatccgctaattttagcgtgtgggttagcgcatccgctggagggcgttttttcgcctctacacgccaaaaccgggatggaggatcggttacaatatctgctgggatgctctcacaggtaccaagggtggtacctcgctatcatgcttagtaccataagtaccaaacctagtacatgtagatcttttatttttaaagagtacatgtacatgtagatcatgggtcttgaatcttgatcatggtggcaacggtaacaatactataatttcatatggaacatc

SEQ ID NO: 1055 - DNA, 1501 bp, Oryza sativa
gcgtcaccatgattacctggctttctgggccagacacgccggtgctcgttttcagttggggtcgatcaaatgttaccatttcagacgagagaaaggtttacacccactctatctgtgaatttttcagatgaggaaaggtggcaactagcgctggccggtgtccaccactgctagtctctgctgctacataagctgcacgcggcagtggaagctccgtttcggggggtgaggctgagcgtgatcggagggagctagctaggggtcgctgtcgttggcgggtgcggggaggtggcggttacggcgaaaaaggccaatagaaaaacgcggggctccgccgcgtcgctctccggccgcggtgctcctggattgtagccagccttggcccgcaatccgtccgcgctttccggccgcgtccccttcccctgccctccgcgcgcgccacccacctcggtcgcgcccaggccatcaccaccaccgcgcgcgggatatatagaccccgccgcggcctcgtccctcctcatgcgatcgatatagctgctccatccgtttgaaggctggctgctgctggccgagggaggcgctgcatgctgctgcaagctacgaagcagtagcaattgcaggcgcgcgcgcacaaggtaagagacggctcgtccatttccaacccgtggttttctgcttgatcgatgatgctagcttgttttaccttttgtttgtttaccgcgcactgtgcgcgcgtgctgaactggggtacgtgctgcgtgattagcgatgtcttttcttccgtcttcgtgggtacaaggttcgcgagtccctagggcctaggtgtgtgcagtgtgctttgtcggataggacggcgagcaactttagctctccctagtttgcgctcggtttgtttagctgaacaacttgaactcgatgctcctgtcctcctctatctcgtcttctttttcacacaaaccggcaaaggtttcatcatggatgcataaatggaagtggaagcaaggatacacctcctgttgatcaagctagtcttctataggagtgcagaagagcgagaatcagcctctggtcagagaaacttcactggatgaatttccgattcatcttcctacaaaaagaaagaaactcctcagaatcgttagagagaccagcctctggtcagagaaacttcactggatgaatttccgattcatcttcctacaaaaagaaagaaactcctcagaatcgttagagagaccaggtgcaaaccgatcgaatgctttctcaattaagaaaaggagtatttcctgtgagatttcctgattctagctagtactagtagacatgagctaacgagaagttggatgctatatgttcaaattcttccttggaattcgttacacatgcatatatgcatcgttatcaaactagcctgtaactgaaatatagcttcttatcgtgcatgcagttcatattaacttgctaccagttcgggagctatactttgatccgcggaagaaga

SEQ ID NO: 1056 - DNA, 1501 bp, Oryza sativa
gtgcagagaacgaagtagaactaaccatctgaattgtcaggcatacaccgaaatgatagctgagaggaggcggaaggttgccagtggtgctgaagatacctacgggatggagaagagccagtgaggaattaattactgccaccactgcaggcgtgtcttgtttgtagcattgagtatgattgtgcagagaacaaaacaaaatcatcggtttgtaggacttgttcttcagaatatatgttccatggaatcaatctgttcagatcaatggccatctttgtttaatttgcaatggcctccattgttcaccatgtgcaagttggccatgtaggttaatttgcaattttttgcccgattcacatcaaaacagaaatattctttacagtactgaaaataaacaaaccaaaaaaatggttgcagggtatgactttaatacttatactcttagtggttcaaagccaaggttaaaacataaaataaataaaaacacttaaaatagcacttatcttttttcatcataaaagttttaaaggacacttaggacctaatttaaaattgagtaaatttcacgaaacttgggtattggggcatccataaaaaaatccagttattgtggtttgtttcaaggaaccaaatgttttggagcaaaacatttaaaaaaaaacccatatttatgtaaaacactcatatttaataaaattcttaaagtacgtgttcccctagtctagttttttttttaatttttcattgtacaaaaaaattcaatataatcctcactgataatgacataataactggttaaatatacacataaatggtcatagaataatgatcaacgatcgttgaaaagcaactaacgtgtatatgtatagtttttttttttctgaatttttcattgaacaagaaattcaatatttcctaactgataatgacataataattggttaaatatacacataaatgatcatagaacaatgatcaacgatggttgaaaagcaactaatgtgtatatgtactaaaaatatctcatacaattttttacaataattatagataagtatatagtcgggtagatgatataaacttgtagctgaggttttatgaaacactttgccctaaaacctgggtttcatgaaacaatttgcgttacggatgtcccaaaatctagggttgtgcaaaaatttgctctaaaaaattagattttatcagccaatcaatacccaacaaaatcaattttgcgccttgctgcctcacaggggattgtggccaggccaccacgacagcctagtctacggaaacgctttcttggttcgttcaaaccatgggagcatgagcccggcagtgcggacgaagcggccgccgccgcagccgctgccgcggcggccgccgccgccgaagccgagcgcggagtcgaagccggcgaaggcccgtgcaccggcaacctcgctactggagagcctcaagtcgttcaagtcccgcctggccgccggcccgccgctcgcgc

SEQ ID NO: 1057 - DNA, 1501 bp, Oryza sativa
acaccgcgcatcacccagttgtaaacttctgccaaatttgttgtcattattccatatctagcaccacctgtgtcatacgccttggcccatttctcttttggttcatgcataatctactgagaaaatttccgaatctccaatccagttcttctaaccaatgttggactattcgttgggagaggtccaagagcttgaggagggttagcaacggcggtcgatggagccgctgcacgctgatcactgcatttggctgtcaactcatctaatctcttccaaagctcattgatttttttctcctagttctgattacatagcctcttgaacatgttcatgagctccttgttcttgaattgcttgaagaaagaaattagctcccatatgatgcattcaccacctactctgtacatcttcccaaacaccagggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcactgcgtaagagctcctagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacagtatccaataatccttccatttccccttatacgcgtgcactctccagggacaaccatctttttccttaacacaccgaacttcatattgcgaccggttggacttggcaacccaaaactctctatgaagtgacactacaaaatgttttaccgcctccttcatatcttctgctctactataaatcgctccctggataacctcattttctttgtactcccatctcacactatcctcttcagagacgaccagcccagaaaaatcctcactagcccattctgctggattaatatccgtctcatcatctgacgaatcaccttcctctacacgctcgttgtcagaatcctccctctccatttcatccacaatggcaccgacagtttccccctcgtcggccactccacctggttga

SEQ ID NO: 1058 - DNA, 1106 bp, Oryza sativa
tgacaccccaccccctaaattttttgtttaagtacgtgaacctacataagtgcaggatgtagggaaatacatatctccacgccaatcattggatttataggtatgtaatgtgcattctttgccaatgattagagagctccatcatcagtgtcaaagtgataaaccatatctaactgtcgggaaacttgtaggaatataggaggatagtaaggtaaattaaacttctctcttggatcagttgagacttgagagtagggcaaacctagacacaagaggcaactcaacagggatgagtggcccgaacaagcagcctttttttcttccacttataaacttttttttgaaagatttttgtccacttatctcagttctagtcactccctcctaaattttactatcttcttttcaaaatataagaaaaattttccccgttaaccattacttaggtaaaatccattatattctctgatggacgtagtacatataatataaaaaataaattaatactattaagcagatttctatactggtaatgtatttgttcacttgcatccatgtaaaaaggacacaaatattagggaatgatctaatatcaaataattagaagggtgaggtttcgaatacagatcgtctagcccaccaccttgtgaagctagccggaaaactccggggcgtttctctacatccctgtaaattaatcaacgcctggtagatcaaacacatttacgagtgggagaggacagaggaacaagacggtaaatgtgatcgcgctatttattgggtacattgatcccatctatcgattgtaatcagatgactgtggcctcatcgtttcgcctcatcgtttcgcttatacttatacttatcagtcaaaacttaaattttcaaccttaaatttaaaactgattttgaggttttttcattgaagtttatttttcagtctttgcttttaaatcactaagaacacgtatataaaagttttattcacaaattacttttttatttacaaatataccgtttcgcttttcgtttccacaatttgttgcggcggattccatatttccacggacccacgttgttgacagatgggtattctcctctccagg

SEQ ID NO: 1059 - DNA, 1501 bp, Oryza sativa
attctagttttctcagtttcttcatgtattttccccttaatttttcctattcctattcgcctgtacagaggctgctagctgtgcgtgctgcctcttatatatcttatggacataactagatcgatttggtttaattaccaggtgatcatttgaaatcaaatcgtctgattcttttaggggtggggagttgaaacccttttcaccattcttggtttaactgaacccattggcagcataatatatatttgattttaatgactgatctctttatataagtggggaccagcagtaaaaaaaagttttgaattatgacacgacgagttcacgcatcacatttggttgtgtgagactagagatataaaatatttctattatgtaaaaaatatatacgtactatatcaacacgaataagacaacgtagcagcatattctttgtcaaaaatatgtctgtaatattaaagaattattccgtctattttgaaaatagaactatatttttgcacggttctcaattttatttctcgaaactacggaattgtaattataagcaaagctctaaccagggtttgaaattttggttcaaaatttccgaaatttcgccccccaccagcatactcaaatctcacccgaaattttcgttttttttgctttttttgtgaatttggtcaaatttttaaataatttcggcttgaaatttccgaaatttcagtaacccctggcataaaacccaatttcaaaatttaaaaccctggctctaacccaatatttttttaacttttgagttgacgtaccgccaaaccgcctcaaaacaactgaggggggggggggggttgaattggacctaacccaattttaaatggacatttataatgttttaagataaagttttgcacatttagacggcatgtaaaaggaaacagtttttagaagtgtaatagtacagtacatgtgatgaaacgtggtcagttgaatgttatttcatttcaagatctttttacgaataaaaatcgcaaacattgtaatgagtagtattaaatgcatgtacaggactaagcctcatgtagtatagccaactaaaagaaaataaaatgaagcccaaggagatatctctgctaattgaataattttgggatatagacgaacattgtgaacagtcctggcaaacttaattttttaaaaaaatcgagacaaattgaatatcctgtttggcacgatctgcaatgcgagatcgattctagggcccactaattgtgattgatgtattattggacttggtatgttattccggtacattgccctccgtccattgaaatgactagtgatgcagcagctagccctgatcaacaactctgacccggcctgtcgcgacctcgatcatgcctgcaaacgggcccaagattaagctggcctttacgcatccgtccgctaacgcgactgttcgctcgcgccgactagcctagctacctaggcacgtactataccacgtacgtacgtacgtatg

SEQ ID NO: 1060 - DNA, 1501 bp, Oryza sativa
acgagctgcacggtgcacgcggacgtttcccacgccgctcgcgtcttcccaaatattcaaatcgattttaagctatcgcaaacgtggccgatgccatggccctagtcctaattaaggccagtagcaccagtgtggggggtggtttggtttgataacgtattccttctgttttcctttttaatgcacccgtacgtgaccggtcgtaattagccttcttccgttttatattataaattatttttaccttttttataattaaaattctttaaatttaatatagaaatatttaataacatatagaaattaatatattttgataatatatttgttttgtgtcaaaatattgtaattttttttataaacttgatcaaactaaaagaagtttaattagaaaaaaagtcaaaacgatacaacaaacgatagactaggaggtgattaagaatacaataacgtactctctctgtcccacaatatccagattcagcatactagcatatgtcacattcacccaaaatcccttatattataggacggatggagtattactcacttggatggagggcacagactcgctaggaggacaagagggaagtatgacaactccaattcatttctatagtagcagaaattatgtcattcatttctagacaagacatttatttttccatcttgtttaaaaatttgatataaatatatgaacatataagtcatacttgaaatatctttaatgataaagtatgtaaaaacaaaataaaaatacatatatgtatttataaaaagtagaaacaacataaataatgcttatataacttttttttataaaacaaagcaaatgatgaaatatcatgtttaaaagttaataatgttatatttaaaaaataaagtataattactaagatttgggtaccgaaatctctgatgttgtttaaattttgggctgatagagtcgtagagatgtgacgataatgtttggtattaccaaaactatgtcaataatttcgacataggccgagtttagttttaaattttttcttcaaactttcaacttttcgatcacatcaaaactttcctacacacacaaacttttaactttttcgtcacatggtttcaatttcaaccaaacttctaattttagcgtgaactaaacgcacccataataattttgaaacgagtgcttaattcacttacctatcaaaaagtttaatctaaagaatttcagtaagatgataaaccgaactctcgctctcaagaatattaaattgtgccaaatgatttgagataataaattttaagcagagtatcccccactagcactcaccagtcaatcttcagtcacggccctattgtactgttcccagttacaccctcttgtggctataaatacccagcgagctcacgctcactgcaactcgattcagagcgaaacgtactgattaaagtgatcagttcatcagtccacggcaaacccaggtcgagagctcgagacatccagaagaggcga

SEQ ID NO: 1061 - DNA, 1501 bp, Oryza sativa
ggcgaatgggtcgtataggagtatagtggcatcgtgtgacgatacttcaaaagttataaaaaaatgaaacccaacaagacaataaaccaatttttaaaggttcaaaacttctacaaagtgaaaaaaacgatgataatcatgttcgattttaaaatctcaatgataataagaagggaggcagcgagcgagtcatagaggagtacaatggcaaagctgtcgacggtttggtaggacttctagaaagtaaaaaaatgaacccgaacgataattatgttcgattttcaaaatcccaatgccaataaagagaaaagacaatggacgggtgtcggtgacatgggaccgggagtatcatgactcgaggcttgaggcagacacaatcgcccacgtggcctggcaccctcgggggacgtcgggcccgagggtgatgtgtgcgcccacctcttggtctccccgagggggggggtcggaccactccagcctcgcccccgagggccgaggcgccccgacccctcgcgttttctactccacgtgtatgggttaggtgagcacagcagggctcacctaaccgcatttattgcgcctcggctaagcgtgtcacgccgcacgaagtgcggtgcagtgcactcgattatccggtctgtgaccagtcacagaccggtcaaatcgcgggttaggtggcgacaggcggtcagacgcatgcttcgccccatcctgtcaagacgagagcttctaggcactcgttcccggctggagctagcgtgttacatcccagagatgacacgttagccccgatcgatatatgccaggcttcatcctaaccattacaagcaagatgttgtgtgaagaagggcaaacatgcacgttgctgagccgacgcttggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattctttccagattcagagcctagaacgagggagaggtcggctcacactttgtagctcctccatacacagatccaccaaaacacaggagtagggtattacgcttctcagcggcccgaacctgtatacatcgcttgtgtttcatgttctcttgagaggtggcgatctttccgtcatctacagcgagagcttgagatctcaccctgagcccccggccgaaccggcaaaggggggcctgtgcggtctcccggtgaggggccacgagctccgtcatctggcgcgccaggtagggggctcagcgagtgttttctgagctctcgcacttttccgggtgcgtcaagtttttcttgatcagcctca

SEQ ID NO: 1062 - DNA, 1501 bp, Oryza sativa
ccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctggccggcgcgatccagacgggagactgcatcccagagcatgccgggccctatctcgcccgccaagcggagggcctcggcttccccggcggatgagtctagcgcgcgctgcatgtccgcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccatcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccatgctgaaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaa

SEQ ID NO: 1063 - DNA, 1501 bp, Oryza sativa
gatgccaaaaaaaaccttaccaaattttggcaaagttgccaaaattttagtaacttgccaaaattttggcaggatttcttatataattgccaaaatttggtagcaaactaaatgtagctacttttttttggtaactttaccaaaatttggcaaaatttggtaaggttgaaaatggcatcaaagtgaacaggcctagagttcctttaaacaaatcataatctttttagttgtattttataaaccccccccaaactcttaaaacctaaaattcttttaaaacaaattacaatatatgtggttttactttatggatgcaccaaatcctgatattcttccctcgaaacataaaccctgatgttcctaggaagacagtagctcaaatagttcactgaatacaagcctaatgaccaatgctagtcatgtcatattgcatgttggccttttctctttatttttctctttcctaaatgtgattgggttatttatacagtttatacctcccttgatataaatacatataaaaccaaaaacgtgaactttcgatgctatataaccaattttttctcaataatattagtaaattatgtttaatttgtaaagaaaaaaggaaaaaaaatgaaaatatcaaatggaggagtacatgacagaacaaatttcttgatttcaacaccaaaaaaacaaaaaaaaattactttatcttttcaaacgaattgcaaatttgcgacacatctcgcagtgcatttgtatcgtccatcagcggatgcacggtccagatttttcgatacaccctagatgggagaaacccgaataacagagttcatcagagagagagaaaaaaaaaggaagggaaaacccgaagtcctccttccctgtctccccaccgccacatctcgccggcggcgatggcgtccgccgccccgcgatcgcggctcacgccgccgacgccggccatgcacccccacaggaagcgcgcgcgctctcccccggcctcgggctcgctggtgcgttgctcgtcctccggaaacggcgcgccgcgcgaccaccgccgccgctggcagagccctgccgcgggctcgcctggtcgcgtttatcagcggcaccgcgcgcagcagtacggggtgccctcccggaggtgggtccttgcggaggaagcctcgacctccgacggaggtattatgctggatgtatcgttggtgaaattttgttgcctttgctcaccatctgtttgtgccaatgtctgagtgaagattgcacttttgcttcttttttttttctctttgctagttttgctagagtaaatagtgagaaatcagttgacccagctagtgcaagtatgaagcttcgccccaaccagtgccaatttcacccctaaagttgtgatttttgttcgtcctttttgtttgacttgcatctgtttgggttgatggagctgtattactctgggatgatgccattctggctttgttagtgtaatactaagagtaataaagcttttgtcaga

SEQ ID NO: 1064 - DNA, 964 bp, Oryza sativa
atgggaagcgaagtgcataaaaatgacacatgctcgtcatgatcgtgagacagcagttctcttgtatttatacagcgccgtatccttcagtctgcacacaaggaattttgcagaaaccattagttggtgaggcgttctgccaatgcctcactctgcaagtgcggaggagctgaaccctcaatactcgcaggcaatactaagttagcatttaatggatactagctagtgctgaacaaaataagaaaagaaacttactagcatttaatggatgtatttgttcttgcatcactagagcaaagcaagaacttgttgactaactattgttaactgttatgctgtggtatgatggcttgtacattgcgtactggatggaatcattccagaaatattactggcttatttgacattgttgattgaaaatttaccaggagataacaaaacattttacccctattgaacagtgatggcttatgattatgacctggaagtataactgtttctggtaaaatggaaacatggtactgtatagtgtacagtatgcctcctaaccgaaaaagtacacccagatagctgtactgccagaattcagagaaaccaaagctgtactgccagaattcagagaagcaaaagcagcaagaagtaccaaagtgtggaccttgcattctccatcatctacaaatcaaatgccgggaatgagaggccatccagggatttccaagatagggagccaaccaatcacagaccagcatcctgccacgtgtcagccagaggcagcacaccatcctgccacgtggctacccaccatgcgaggccgaggtcccgagctgtggtgcaagggtgcaccgttaatttcgtttcgctagtagatagcgtgacagtgtgagatcgagctgaaaaaaaaagagaggccacgaagagagctcagctgctgcctctagcttacttggtgataaggaggaggagg

SEQ ID NO: 1065 - DNA, 1501 bp, Oryza sativa
tcaaccttgatcggtctccatcgaaccgctggtatataaacaatacattggaaaagacaaatctcagtgggattctgagatttggttggggattgttggaattaatagatgggctaaggcccattcgaagattaattctttggaaaatcacaaaagcccacctcataggatggcatgcatgtggagtttagtaccaccttgcttattctaggagagggggacctccttaaaatggaggatgccctcctagccacttgaggcatgtgtggtggagagaagagggggaacacacgcgcgcgctcgctcgcctcgcctagcctggcaggcggcgcgcgtgcacgacgtacgcgtcgaatggtccgcaaaattggctcctcacctttgcgcagatgcagcctccttttgcagttttgttttgctgcaggaaaattcagatttgttttgttttggagtccggaaaatccggttcggtgcgtgaaaacggcgtggagtccggataagttacgcgcgacttatccggttcggttacgtggagtggagatcgtgcgggtgcactgagcaagcaaccgtcgccttatccggttcggttacgcgggtttatctctatataaaccgagccgccgccttcacgcaaaacacacgaaatcaatctagggattgcctcctcctctgtgttgtgccgtcgctcgtggactactccatcccgctcgccagcgtgcaccggcgatcgggagagcaggtatcccgaacctctgccttcgacgtcctgcaccgggagaaggcggcaataaggtttttgggaagcgcttcgcgcgctgctccttgttcatccgcgatggctcgccttcctctctgctcgcgtgctgcgcgccttcatcgacgctcgcaaccgcgagtagttcctgccgagcaaccggtctttccgccacctcggtacgtgttcgacatgttgcgcatatttgatttgttcatgttttactgcttagtttacatatgtagatctaatgatgcgttaatgctagtatacatctgtaatgtcatgatttatttatggaatatattaaatcattatatgcctatattctcaacatacttcaagtccctgaagcttttgctgcccacacactcatggtgcaaatgaaacgtagttcatattgtccctatagtcacaagtgtcaaaaatatgagatttgctccgtccaataaaaaagtacctcgacgtaccagtacctcacggtaccaaatcatttctgaccattggatctaacaatactcgtcatgcccaactatatccaacgatcgaaaacgatttggtatcatgagctaccgatacctccaggtactttttgctggaccaaagagcctcgcatgtgcccatcctaaaaatcacaaaaaggaataatgggcaactaaacaactgattttacaaccggggcatgcacattaaactgtaagatgtggagggcataaattacacgaaagctaaagttgtaggaccaga

SEQ ID NO: 1066 - DNA, 1501 bp, Oryza sativa
ttctttatttttgtgacactccatcttaaatatatagttttgtgagaaattttacgctaaatatatagttttgtgatcaacatcttaaatatagttttatgatagtttgatcgaagtatacgtagttttatgaaatctacttctggtatttttatggtttagaatcctatacaacatcctatttatacatttttttatgttcttgcgttatcaaaatcacatgtttgaaaggagcccagagagttaaacctgctagagaagtgacttttagataatggatgaaatccgacattcactacaaccgaagctacaaccaattattatataattattggtttatattccaaaaaggtagctaccataagatgaaatggaatataaataaccactccgccaccaaaaagaagggatacaacttactgagacatcaatcctattacaaaatcttcattcaaagttgacaaaaatatgcataaccgtaatctctaaatttcgatatgcaatatgaatgtattctttctcctcattacaccttcataaatttgtgcaaaataaaaactaatatggtgctcttaagagtatctgcatacaaacacatccttgtaagtacacagtgtacactaaaatgtgaggcagaaaagttcctccaactaaaactactatcatgtttcagacggggatcatgttcaccatcgcgtgcgatagctgataaagctggtgggtgatgccattaccaccggtgacattatttcagtatattctcacttctcagggaggagaagaggcaaaggctatttgctcaaagtttccatagcaacccttgctaaccagaatggacgacgtctccaggcgatcccgtagtaaaatgcatatactcctttttttttaaaaaaaaaacaggttctcaccggaggagctcctccgccggcgcacccagattttacgccttctccgggggaaaaccactttctctctccatctctcgctctcgctctccaaccccaacaaccttttcccacccggcatctatccattcctccgctgcgaagtatctcctcggatcccctacgccgcacaaccccacgcaccaccgcttcaactacccatacacatgtatcccaacccccaaccaccagacgccacacgcgtgcacgccgcaccggatccgcccaccgaacgctgctcgtctccctccccaccccgtccgcctacccgtaccacccactgccaggtgggtccatatcccagtgggtcccactcgtaagtgagaggggttaggatcgggccccgtgatgtccgggagatattgggggactaagagatttttttttttcgtttcctctctcgcccctataaactttaccactactcgccccgtgcgctctcctcgtcgtcgtcgtcgccgccgcgagcgaaccgggaggagaaagtccaaaccctcgcgaaggcagagtcggggatagggatatcgccgaggtgggagaaggcgacgtcgccgaca

SEQ ID NO: 1067 - DNA, 868 bp, Oryza sativa
tataataaaagtaatttacaacatagacatttctttcatcaaaacatagtaatgtaaaatcctgttgtaaagatttaattgcaatgaacacaatggtataattggattatatatcgggtataagtaatttaaaataaaaaactgtaaaaagaaaaaaagatatgtataatttggtatactagtaggcaaccagctctaagatgaatctctggtcaagacaatataacttgcggtttcaacgtagtcatgtccttttaaaatatatcaccaaaactatgaattgtttgattccatatcaccattactctccttgtctgtttctctatatatcgccactactgtcaccattcccccgcatgtcagctacacacaaaataataaaaattggtgtggcccatgtggccccacaagcgaggatgaaatgtatgtcccatggttttaattattttttcgggatccaattgccacgtaagcgccacgtcaatatcatgtgagacgaagacttagccaaaggagtcacgtcagttaaaaccgagcacaatactaccgagggaacttgtttgcacggtattgtaagatgggaaatacgctatacctggtttttgcattcaagcatgaatttcagattcagcgacaaattaagagatctaaagtgaacttattcatgcccccactgccaagttcgcgtagcccacaggccacaaagcccataacaacatcaaagcccaaccccaacccactacctcccctcaagcacacaacgctgcacatccccgccgctccgcgagttgaaaaactcgtgttccctcagatcccggccgccgccccccccccccccctctctctctctctctctctctctcccagc

SEQ ID NO: 1068 - DNA, 1501 bp, Oryza sativa
tcaatgtatcagtatctgttgggtgatcagctgtgagaaattggaaacagcttgtcgtaattgaatttggtagaaagaattgcatcatgtcattttagagttttgtctagtctcctactttcaagcctttgtcggcaccctctgaaaagacatcgacggttttcttacttcgtcaggagctgtgtctagctgttgctgttatgtgtaccgattggttatctgtgagcgggctgttgggtggaagctatcacgagctgcacaaccacacaaatatattcttttttgatttgataatgtattcaattgctatgcagacaagaaggaatcatgcattgattggccatgatcaaggtcttctttcattaggtaaagccaaaatggagttactatatacttcctccgtcccaaaatgcaagcatttttaaggttggcacgggtattaagaaagtaggtgagaatgattgaagaaggtgtgtgattggttgaaaagagaaagtatgtgaaaaagaatggttgtgaatggttgagaggagaaggtagttagaaaaatagcttcattttgggacaaagtactgtgctagatatagctatattttgggacggaggtagtactaatgaagcaatcagtgaccgtccatggtgattgtcggaatcagatcctgagttcatgaaactattttggtctgatgcaaagttgcaaactgcatcctttttttgcgtgccattggacacagagcaaaagtattattgcagtgacaatattacatggtttgctttgttcctccactggagatgagctgaatgtgcgctgagtttctgtagtggaatctctgccggcatcctctcacattttgttcatgggcatggcaagaacaagttggctggtaatagtgcctattttctattcgaagtagtgctctcgttgctgtttgtttttcgaacaagttgctctaaattgtgacgcaaattttcgttcgatttaacttcccgtcttgttaagcttggccacatgatctgtcactgtatggaatgatgcaaagctgctgctgatgctgtatttctaacggcgtgtttgcacattgggctgtttgacctcaaacaaatggcacgatcctgtccccttatgaaacagtctcgatataattatgaattttgaaatatataaacccatgccataaacaagccattagtcaaagaccggccaaaaaattttaaagacttcgatagagtaattagcaagaactacagttactaacctctaagcacgacaaaaaggacagaaggggaggggggggcatagagtcgtgggggcgcaaacgagatccggatctcctgcctctatcagtatgacatgtggggccacctcccgggtcgacagagcctgcgcggtgggtcccaccgcctcgtccccgtgccacccacccccgtggccgctcacgtgggctctcctcctatttatttgcacaagtcttcttcacgcctcgtcgcaggcagaaaccac

SEQ ID NO: 1069 - DNA, 1501 bp, Oryza sativa
gttgttgcttattaagcatgcactgttctgatcacaggacagggatcgcaaactgaggatattttctggaaatgagcatccattccatgatcgccctcttgaaccttttgtgatgccaccacgccaagtgcgtgagatgcgtccccgggcaagacgtgtactgataagggcgcagaagaaagagcaggacagagcagcagcggcatcaaccaaagatgaagaaaatgttaagaatgccaaatccgagatcactgcatagatgcacattcagatgtgtgttgtgtgggtggagattgctactactcctacattgcaaatctacctgttgcttttttttgaaggatccatgtatcttttatttctttgacatgtagcctgttggattcaatagacagtagaatcatacaacctggaaatgagcagctcaatctgaatgtctattttgtgtcttacagtatgtaactaaaacctggtgtcgcttggaataaaatcctcatctgctttgatttcctctgttgttggtcagtataagagtccatcataatatgttccatggaaatgctgataattccatcgaagatttggattcaaacttatctcgaaagtgaaggcgatgattcttggaaatgaggcttataggccttgtttggcacagttcccgtctttcggttcttagattcataatagatttgaagtttgtatgttgaattataatgatttaaaaatttatatttcatctaaaatgggaaaaagatgatttatctagatgttatcaacgcaatcgtggatctaaattcataaatgtgttgaaaataactggcaatttagtttaggggaaaaagagaaaagtttcatattggcccaaaaataatcaggcccagtccagtgcgccatcaaggccttaaaccctagaaagcaagaaagaaaccttccgcctcccacctcgactcgaccagtgactcctccgcctccacacattacagctaccacgccgccgccgccgccgccgccgacgaggaggagatgtggcggcgttcgggagctcgtgctctcctcctcctccgctcctccatccacaggcctctcccgccgccgccatctccacttcgagccttaacccgagcgccaccgcctccccgccccctctcccgcttcctctcctcctccccggagcccctcccggatgccggcggcggcgctgcttccgcgtcctctgatcccaccgatgccggggaggatggcctcgcctctgatcccaccgaagccggggaggacaacctggcctcgctctgggaggaggacgccggggacgccgacgacgtcttcgccgccgacgcctcccccgaccccgccgatgctgtggtcgacgaggtgctggccgcgcgcgtcggcgccgtcgtggagtccacccccgaggatcagatcccctccgccctcgccgacatggtcgtggacttcaacgagccactcctcgccgccattctcgtgtccgccgccgaga

SEQ ID NO: 1070 - DNA, 1501 bp, Oryza sativa
catcccatcccttaaaccaaatgcaaatgcacggtaggtgatcaattcaacgagtttttgactgccaaagtcattagcccatccaattctacattctacgagggaataagttcagtttagatctccatacgtcaagtttgaattacatcactacaccgtgatactagatacatatagcgtgtctctaaacttgcaaaataggtgtacctgaggtcctagggtaatatagtgcccaatcttaactcacgtggcgagtgggtctcacatgtcaacaacccactcttgtttcttctctctccctcctctcccctctcttccccaatcctcttcaagccaggagggggggcggcgagcgacagggagacactggtggtcaacatgagcgcaggagcttgaccgtggaaggtttccaaggaggcggcccacctcggggggctgaaattctatgatgtcgaggaggatgagctggcaggagcacgttgactactagtggaggtatgcagtgtgctagacgatgacgagcgtgtcctcgggactcaggaggccatggtcacgaggtggaggcgatcagggtgggctgcattgcgagcacgatagccgccgatgaccaacctgaagctgccccggcgcggggttgtccccaacccccccccctatgcgacgctatccattagtggtgccttttgccgcgccatacaaaacaagtggcttgtcagcgattgcccttatccccgccgctcggaggcctggtgatagatggggaagatagggaagagaggaagaagaatgctgctccctgcccttctagtttgaagaccattgtccttctagtttgccgcacccactgccccactctaagtcggcggtcgtccctctccttgctactcgttgctcacccgttagtccaccttgttggttggccctctccaagtcggtatccacccttctcgccgtcgctcgaggctaggtgagagtatgagagatgtggaagagagggaagagagtgagtggggggggggaagaacaagagttggccgatgacaaatgtggctcactcgttgcatcagctaaaactgggtactatcttggacctcacaccagttttataagttaaaagatgagcgttatatttggtattatggtaaaaaaacataattaaaactcggcgtcgaagatacgagagatgtaaagtgaacttattccttctataaaatgaatttcgttcttctctacgccaatcccctgcaggccatccgttcgtagaagatgggactaatgctggcctgcaaatttatttgggctggtaacgaggaaacatttcctttcccagcctcacagactgaggcccatcaagccgcggagagcaacccctcaagacgatctgagccgtccgatccatctcccgcaccgcatccgtccgcccgatgcgctcccgcgactagggtttcttcgagaggaaggataaaagggctcgtgggcagccgccgctataaaccctaac

SEQ ID NO: 1071 - DNA, 1501 bp, Oryza sativa
ccggacgccgccgccgcctcgagcatcacgaagctgctccgccgccgctgctgctgccgcccgccggacttggcggcagccgtggcggggagctgcggctgcgaggagaagtaggcggcggtggtggtggagatggccgccattttttgctccgatgctctgcctgatcagggggggctatttataaagaggtaaaaaaaatatttcctggttaaaaaaattgctttaattaggtgacattttttttttggattagttttaggtgagtgctaatttagcaaggatttcttttttggagtgtgtttgttgtgttttatttaagctggctctattttagtcatgcatccctaattgcagttatctgtctctacagtaaagagcagaagttgttttatttttctcatgttggtataaataattgtatcattttactttaactgcttagttataaaggaaaaaaaaacttcggtataagcatattacctggtacctggatgctcccaccgtgcacaaatataacggatttttggattgttcaacacaatttaagcttaagttgaaattgctttgatgtcactaattaagattttacttgattgtaaaattatgatgtctagcgaagtagcgatgcaactaccagtgagcaataatagtggaatttataatcctaattttcgtagataatttttaaatcataaaatgcccaatatttgtatttgtgaagtagagatcacttgatagtgtagtggtgaggatgtgtggttttaacctgagatcttatgtttgatactcaacatgctcataatttcttcttttaaaaatttagaaaattttctccctctaaattattgtttttaatttgagaactgtatatatatatatatatatatatatatatatatatatatatatatatatatatatatatatatatatatatatatatatatatatatatatcacagttgatatgtgcattttgggatattaagaaaagataataatcctagtactaaatctatatgcattcagtgcacgtagatatatgtatacacaccacttgcccatgcgtacgtgccagaaattatgtcggagcactcgaccggaggaaggtgacgtggactgaaaattacgcgcaccttgactgcgcttgtcgtgggggacgggcccacctggcagggagccgggcatcattaactactagtggccgcatgctgagaggcataattactccgtctgttctctggtgacgtggcactgttttccccctgccattaattacatctagtagtccactgtgatgacactatcgacgcatgcatgcactttctcatcgatcttacgtggtactcttagctacagtagataatatacttacacatgtaaaaatcacatattttacatgtacattatacagcattgaacttgtaaatgtttttgttcagatcacttggaattggtatatatactagtacttaatatatagagaaaattccctatc

SEQ ID NO: 1072 - DNA, 1501 bp, Oryza sativa
atagtaatatagtatgcatttgtgtactttcagttgataattgcactatttttgtatttcaggcatgcatggtggatcctgaagataaaacagaactggatcttgatacagaatttcttcctccaatgtcatacttaagctcaagactaggttctcttcttctgcacctcttacatgcactggcacatgtatatctgtggctggcaatttacaaaattgaatgattttctagtaaccttctacaaatgaattgagccactgtattcggctttcatcaatccagagccttgtttcttctccaaagagaacaagccattgctagaaactttatgcatgccgctctcctttcttctagcagaccttgtaactagttaaatgtacttctgtatagaaagttgcttgggatgttcgacgtgtgctggtgcatgaaaaatctttattttttttgggtaacttctgaaacaaacctattggtttttttttacaggtgaacacaacgccaatcatgttctttctgacttggaattcgaacatgaaacatttgctaattgcaatttagacttgaagctcaaggaagaatatggaacataatttcctgaggtctcatactcttgtagtacagtgtactgggatcatgttcaactcttagtacatctagttgtattgcaatttttttttgtttgtgttgtatctgttctcttaaccaatccaactattctgggcagccaaattgactcagatattttgttgtgttgctagttttccttcttgtagtgtaatgctatctctgtagactgtagttattcccattcacattttctggggacaccagttgttgaaatgagtttaacttggcttagtctcatgttatgtttcccatgtcattttaattgcaaatgcttttatatgttgtttctttccaccccaaacagccataaaatggtaaccaggtttactcccaagcaaatgtgcatcacctcatgatgcatgaagggtgtgaatgttcaaatttcaatctttcttccttttcccctactaaatacaaaattaaatagaaaaaagttaaaagatgcaacaatgtgacaagtctagagcattaaaggtcagggtgagggagcaggtgacagaatgtgtgaatgtttacttgcattgtcagtttccatttggtgttaacatgacttgcagggcataaaagtgtgtactcatatggggtgtcaactagagccaaaattagaacataaaagtggtgttttaaaggtggcaaaacacgtagatggtcgaagatatgagactttcatatcttactggaccattggaagaagatacatacaacgcatgaacaagcttggataagcttgccagcagtttggcagatgctgaatgcttgagtgtaaaatacgtgcaaacattgcttgtggttcaaagttaacattttacttttttttcatcctgagttatcttttccctcatcacctataaatagctctcctttgttgagaaa

SEQ ID NO: 1073 - DNA, 1501 bp, Oryza sativa
cagcttcttgccggagactccgcaggcgtcggcggcgttggccacctccttcgccacccggaccatctccgcggcggtgatgggggaggaggcctcggccgcgtccctggccgaggagatggagcggcccaggagcgcggcggagctccaactcgtcaccggaacggggaaaccccgcatcttcttccggtggattcttgatcgcctccggtcgtcgaggatttcttgatttcaatcggacttttggttatggggggcaagggaagaagaagaagaggctaaggaggaggggctagatggcaatggcgtggccgtgtgcggagaaggagctccggatggggagaggcgagccgaggcgaggggtttgggaatggcggagaggcgcgattttgcggttttggatgacgcggctcgaggtggaagacgaggggtcgtttggtaaataagggataagtagggtggcaaatggaaattatttgcaatcttcacgtttccagcgtattgctggattgcggtgatggtgaaagttattactaaactgcccccgttagctccattttgaatcgtttgccatttattgcaaggagggatattttggtcattagtaaaaaaagcattcccttccatatccatcaagttcgttagtgcatcattattatattgcagtcgataataatgcaatatgtatttttcagtgcttattttttcctaatagaagcatgttttctctgatatactccgtagttagaacatcaagttaatggatatagttgattgttggctgttaatttgaccggtgagtgtgtgaccaatatgcaagttacaagccgggatgcttcatcctcagcgttttaaaactgataacttgcaaggtttgtattttttttacttgccccccttaatacaagttcggccgcccagcgaaaaacaaaaaaaaaagtttcaggcttacttctgattgagcgtgcgcattcaccttgttctttttcatcgtttcctccaccgcaatcctgaaccgataggctattcattgcacaccagtaaatctcacgtatcgtctacagagtagagacactgaagaaggcatcggcgtctctgtcgattgcgtgcgtccgccttcgagatgggaagacagagaacagcctaacgactgacacaccctttcacttgcgaccagggttacattaacgtcggtaaccgtccgtgcggttatctcctttaccacggggtacggtaaaagaaataccgcggtaatctccttaaattcaaataaatttaaaaagtaatttaaatttttgataaattttgcacggtttcgtacggtttttcatggtttccgcagttaccgcgtggtaaccgtgcttaccgccagggcgcggtaaccccgaccccgacggtttgggaaaccttgcttgcgacgcgacacgattcgattagaagagcagcatacaccagcatgaaacgagggaggattttgtatggatgagatatatatgtttca

SEQ ID NO: 1074 - DNA, 1501 bp, Oryza sativa
catcagtgtatcatggtggaactcacaattgacaatccccaattccgcgagattcggcaaatggaaatcaatggttccagaggggtccttgaacctgatttgacataaatacagggtctcgagcctccaccacttaagaatgttttctggcacaaataaaagtttagccgttggctgagctctattgagaaagatgaacttggtcaccttcttcgagttaaagagattaaaccaagacatcagaataataaatgcagactcatcatcgtctgtacagaagagaaaattagaagaatataagtgcatgatactttaagcagcgactcatctttaacaagcaaattgatgcaaaacgaccaaagcttcaagaataattacctatgcaatgtaattcctgcaccccaaatggctgaaagcacaagttggtgagcctcaccgtagggaaaggcccatcttgtgtggaaaggactgacccaaccctctcaatgagatccacttgctcgccattctgggggagcagctgttcgtcgtcaatttccataacggtggatagccaaaattcgctggcgaataagggacctaactcccgcaccatctttaccgggagatgactgagaacgtccctcatcaccggggtaccacggatatttgcagcgactggagacgagcgtgtggcaccggcataattgaggttggtgacggcggcgggggcggggtcggagacgacggccatctccatggttttcctgcgggcgagcatcttgcggtgggtgatggtggtcgccggcggcggcgggaggcaggagattagctcctcgagctgcaccatgcttacgagtttttcgatcctctctctcgaagaagcaacgtggatacgagtataggattagctttgccggcggcgggctagggaggcagcggcgaccggtaggggaggggacggtggaggcgggacagtgaggagtgaggagtgaggactgaggggggacttgggcctagggttgtgacttgtccgtgcggatcgacggcctttacgggattttcttttcgtccttccatgtcatatagcccatgaacaagcagaccggcccaagtcactgttctgaagccctgtctacaacgaataagttcactgtgagtccctcatctttgacgacgagtttaaatccatcctaaaccgtaacaccagcagacttgagtcttgaccccttaacatgcaaaattaggttaaattagttcctttaaaagtgtagatggatggttttgctaatatggtaagtttatccggggccactcgtgctgactagacgtttacgtgacaagaacaaaaataaaccccacatgtcatacagtcatactcactcccctccactcttttatctccctactctctctccccctcctctcagtcttcttcctcatctctctccgtgtctcccctctcttctcatctctctcctgcctgacaaaagcgaagggaggcggtgtatggcagcgtcac

SEQ ID NO: 1075 - DNA, 1501 bp, Oryza sativa
  unsure (1)..(1501): unsure at all n locations
ctaccaattttggtaatatatcaaattagacttgatttttaccaatttgaggttctcgagatgtcatactatcaaacggtagtttttcccgttgcaacgcacgtgcactattgctagtcttataaaaaaaagtgagaatccattaaatgccactgattttgtcacaggtttatgatttgccactaactttgtcatgttctataatatacccatcgacttttgcttaacatctacgatttaccatcaccgtccggttagcctatgctaatactatataattttatccaaatgaccaaaatacctctaggacaaaaacttccaaaatttagacaaaaattccgtaatatcatattataaacataagattgtaaacatccaaaatacaatactctatttgctttttgtatcatattatgaacataatattgtaaacatccaaaatttggccaaaaaattaaaatctgacatttcataattattatccaaattttgaaagtttttgtcccaagtgaattttggtcatttggaaaaaattatacggtattaacggaggctaataggacggcgatggtaaatcgtagaagttaagcaaaagtcgatggtatattgtagaacgtgataaagtcagcgacgaatcgtagaaatgtggcaaactgagtggtatataatggattctctcaaaaacataaataacttagaaaaattatgtaagcaatgctgatggggaagtttttttttaataaatcatggtttgacgatcgtggtaagtatagtcgataagtccataagcttaaatgaacatgaccttaagggagtgtttgagaggagaggagaagagaatattgagaagatacgcaaaacgaggtgtgccactagcgtattaactattagttgagtattaactattttaaatttcaaaaatagattaatatgattttttaaaataattttcctatagaaatttttttataaaaaatacaccatttagtagtttgggaaacgtgcgcgcggaaaacaagatgtttctctctctcagtccccatggcgcccaggaacgaaagtctgcaagacaaaacacgttccatcatgaataggattcaggggtggtcctaggacacctgagcctcggagtatgtaccatgaaagcctatctaatttcatcatgtattcaatgtgtgggtcagattgcaccttgggtcagcccaaggcctaggcaaatgttggatcgacccttagttacgttttgtttgggagttttagaacaactggttaagaagctagaaaacccagtttctatattctagtttatttatagattttacgactataaatactcagaatctgaataataattattgtttggggtgctaaagtttctcagaaaaactgcagcaactctgggcctgtttggtacagctccaactccttaatttagcttcaggagttgggtctggaaaaaagttgtggagntgcntaaantnagctccacaactctagttca

SEQ ID NO: 1076 - DNA, 1501 bp, Oryza sativa
acggccgggacgtggccggcgagggcgagcggtgctgccgggacttggccggcgagggcgagcggcgccaccgggactcggccagcttgggcgagcggcgcaatctcctccccactcgtcgcccgccatgccaagagagaagagagagagagagagagacgaggaagggagagaagagggaaagagaaagctgatgtggattgtctgacatgtggggcccacgcaggtcccgcgctgactcagctgtcatgtcggacaaaaccgaggttaaaaccaacgaaggacctagaatgaatagttttgtaagttgaggggtaccacatatcatgttttgtggttgggggacgattttgtatctcgatgacaagttgagggaccttcggtgtactttttccttctgagatattacaacaccaagtgggctgggcctccctgggccacagtacagtggactatggccttggttgacattggattttaggcatggatcgtgcaaaatgaatggaaaaagtacgaattacacccccgaactaccgcgatcgtccgaattacccccttgaaccataaaaccggacattcttcacccccaactaggcaaatcggacgaattacccccctcgaccgaatccgcggtggtttttgtttacgtggcgtacacgtggcagtccagtcagcaatttttttcttaaaaaaattgtgggaccctcctgtcatagtgtcatacctctccttcctctctctatcttcactctttctctctctctcttccacgggcatcgcaagggcgagaggtgggcggcggcgcgagggcagtgaatggcggcgtgcaggggcgggcggcgaccggcggcacggggacgagcggcgctggcggaggctgactagctactgatttcttggcgaggtcggcgccgtcgaggatgagctgcacgccggcgacctcgggggcgagggcggtgaccagggcgactgtggtgggcggggccgtgccgcctcccgctcgcccgccgctctagcctcgcctacccagctgcgcccgccccctcgtgccgccgtccacggccatccccgcgagccccactgcgtgcgacgagcgaggcgggggcgctgcgggcgggcggatctgagggacacccaccgctgctcgccacccagtcgccgctcgctcccgccccctgcgccgcccttcctcgctgccgcctcgctgtagccgccgccgccgccagatgcagacggcgacacgctggcgcacggggatggaggcgcggagcatgggtgtcctccttggccacgacggcgacgccgacgcggaggccgtctcggcggcaccttcctcgatagccacgaccgccgccgtggcggccgacacggcgaagctcccctccatcgtggcggccgactacatctgtatgacaacaattaaacagacacaccataaaataagtatgccaagaagattgttttagagagaaacatcaaaaatgcattcgtagtgattaca

SEQ ID NO: 1077 - DNA, 1270 bp, Oryza sativa
gggggggtgggggggggagaaggggagccaggccggcgaggaagggaaaaaagacttgggctggaaacggcccaaaggacatggacggaattttaatttggtttttaatttaaataattgattaaatgaactttgtattattgaaattaccactcgagcactgaaaattcacgagaaatttcaaagagtactttatggccaactatgatttttaaagaaaaatttatttcccacattaattttactttataaattgcttttaattttaacataaattatagaaatgatgtactatttgatttttaacctcgaaagaaaatcaaggcataacattcattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggccgaagctccatgtcatgactgaataaagcaagggagtctctgtccgtttcattacgtctttctcttactgatctaggatcaaggtagcaattctactactacgaaacaaaaaagaacttgatttttcagggaaggacagctttctttttggcaggaatgcaagcaagctaggccagaacaaggagaaaggctaaaactgtctgagccaagaaccagacgcgctcatggcttcacactcccaccacactaacacaatatgccatttgtttggcttaataaatcatctgcatcatatcaacctttccgtcaatggtttagtttatgtttgactctaagccatggcaatggattaagtaaagcacatgcaaattcaaccactctctctcagccagccactcgctgtctcactagctttctttcttcgtcttcctcttaagaaatccaataatctttaaccgaacaccacttaacccccataatgctcgccatggcgaccatccagaaataggatgagacggcggcggccacga

SEQ ID NO: 1078 - DNA, 1501 bp, Oryza sativa
cagttacctttaggttgaaggatcccaggtgagaattatcgccttgcattcctgggttctgaatgctccgggagccgtagaacatgatgtacattcccatgccaaacgtgagaagagctgtgccgatcaggaacatgtctgcagaagaagaagcatagtttgatttgtcaagatttagtaggcataaattaaatcggtttaacatggaaatggttacttgtatgcagtttaaaagtgattataaggggcgtacctattgcctcgatcagcagctttatgatctctgcttgatcaattgtctgtgtcagggcacgaaactgtacgaagaatgatctcacaactgcaccacatccctgcataattcagcacgaaatctttcagcctcgaatgttctttcacttaatacgatctcgaatcttgattagtccatcatggtttcacttgcagcaggaaatgatcgtagaagctttacctcgagaaagcatggcactgatccgacgagtgatccggccacaccgatgagcgtgaacgactggcatctgacaacaccctgaaaattttacagttcatatgaactccatcagtaatttaaatccgcaaaacttcggctaattcggattccaaagaactcgcaaaatttgctgcattttgaggtgattagtttcagttaattacctggtggatggtggcctcggcgatcttggaccagcactgctgcgtcggccgcgtcgcgcccccgagctgcctcagcaccagcctcctcgcgacctcgtacgccagcggcagcagcaggtcggcgcccctcctcgcctcctccggcaacaacaccaccccgccgccgcgctccctctccagcgccgtcacgccggcggctcccagcgcgatcaacgccgccttccgctccgccgcgcggctgccgacaccgccgccctgcctcttcgactcccacagcgacgggaacttcagggacgggatgcggcacggcccagccacgccgccgccgccgcctgccgccaccgaagacgacgacgatggcatcatacgatgatggctgctgccgtctccatgaaaagccttcgcggttgctcctctcagcaacctgccgctaccaccaccaccaccaccaccaccagctgctgctgctgccattgctgaagctgctgaactccgtcactgtcagctaccgttgctctgaacagcaggaagaagaaggtgtccggagtcgaggccgtatttatagtcgctgataacgtacgatggagaggagagggatcatacgggacacgcgtggtaaattcgcgagtttgggaagtttcgacgaataataatcaaagcccacgaaaatgcagaacgagatggaaacggagaatattccgatggcatctctgatctctctttgtggtgagcttgtggttggcgtggattttgtcccggaaggacggaattctccgaccggtagaaaatcgccgtggtttctttgacgtggaactggtactgacag

SEQ ID NO: 1079 - DNA, 1501 bp, Oryza sativa
ggcgcttcaccccgagttgcatggctggtcacacctgtcaaaacaaagcaccgtgattttttcccaagtcgaactgatccaccgtcacagtctcagtttccgaatagtaatttattatctcgttgctgttgattttttttccatatgcgaccaaagcaacgcgtgttaagtcaacttgaagaaaattgacagcgcaggctaatgttatttcctttttgcgcgaacggatcgttcagtcgtacggagaagggatcaattttgaccaccagggtttaattatgtgatgtgtgaacggtctattttctatcgtggtgatatcacaaacggccgtttacaaggatctaacggattgtgtatggaatactactccagtcggaagaaataaaaacttccatggaaggaaaaatcgacttttaaattatcgtgtgctgctcgagattagagtcagaaatttagaagagcatatgtgtcagggactctcaagatcatccaggagatatctcgcaaggctcaactgcagaagaaccagaagaagaagaaggaagccgtcctgaagttgctgatgaagctggtagcagagaagataaggaggaggtgatccagacttcaggtgacaatcaagcctgggttgcaactcggcgtccagtccgtgagaggaggcccaatccgaaggtccacggtccagagtgggtggcgtaaggtatcagctcgcttgtgagctggcgccggagagagagagagtgggttggttgtaataaatcaaacgaacaacactagaacaattcgggaattggcatctggaggcgttggcggcggcggctcggtcctgttggatctgagaagtaacaaatattgccactaaattcgtgaattgtgaagcgtgttcttgagagcccctaacaatctggtatcagagccctcacgcgctgcaaaatcctcttgatttggctgtaaaattccggggagaggtgggatcctgctacttcggtggcgtgtgatccgcaaaagtttcggctccctcgatctggttggctgaattcggagagctagcgctgaggtttggatccggaatctcgagatggatttggaagctaagttcgatctcctgctcaaaaccatttctgacaatgagaagaagagagtggaaggggaggagcgtaccagagcagagtacctggagctgaggaaaacggtggaatcaaggataccggccgtggagaagaaggcggaaacactgggagaatcggtgcagtcgttgaacgctaaggtggatcacttggagggcaacctgttgcggcaagtcaagtcggaggcgttcggcagcaccgccgcgggtggagctccaggcaactccaagcaggatcaagctgctgataagtcgggggcaactgcgacgccaatgtttggtatgaaggacaatttctccattccccacattaattttggttctgaacctgaaaccccatctcctggtagtggatctgctagttttaatctgagt

SEQ ID NO: 1080 - DNA, 1501 bp, Oryza sativa
ctttacatgtgaatgtattagatctattccatccgccccgtaaaaaacaaatctaagaccaggccaggtgtgatatattctaatactatgaatctggacatataactagaatgtgtcgtatcctatactatgttggttttttatgtaacgaaggaaatactttttatctatatcacaccctctagagaactgaaagttattttactttaattgtttaaagggagcaatggtacaaaatatataaacgtgtatagagtaatggtttaacaaaataaaacaatatatatttgccgacaacacaaaacccgtatattagcacagacagatgagcggtactgaacatcacttaagacatttacattagcaataaatgaatctacacatgaccctgtcaaatataggtgagtgttgatatggatgagagaggagagtcaactcggaaatgctactgggtgagcgcgctcgcccgctcagggcgatcgattccccccctccccctccctccctccacctggtttccttttttggcaccgtattactttcctattttaataaatttatgcacctaaagtttatacacctcaagtttacacatctaaagtttagagaccaaaagtttatatatccgattcaaatttgaatttgaattcaaatattttttaatatagtatttctatacatctaaagtttatacacctaaagtttatagatccaaagtttataagtcaaaagtttacatacccgattcaaatttgaatttgaattcaaattttttatacataaatttttctaactttttgttttttttaaattttttttgtggtgtactgtaataggaagagaagaacgggaggaggaagggcagaagtgggaggaatgcctataggcggagcgcccccccccccccgggcgtcgtgagatagatataggctagaaaaaaaaactaacacgggagaagagaagggtgaaaaaaatgagagttgattagagtcagcaaccattgtatgacatgtttgtggagctgtcatcaaatgaaaacatggactatatctatctgagtatgagtttgaaccatgcatgctcaaagtgttaagcttgtccttaattaggatttaaaccattattgtggtgggaattaattaattagccattttatcccatcttgacagagggagaaacgatacttgattagcttagccaaccggccacacgtttttcacaaaccaagaagctagttcccacaatacataaaattatatctcagcatccgcgattacatggcccaatcctctccttaattagcttgtttgcctatataaacccttattctgtccaagccatgctgcaattaacttatcactcatcagcactgcactaaaagcagtgtaaaagctagctagccctagctgctgtaagattaatcagcttaattagcagctataactagctagttaattaattagcttaattagttagctttagctagccatggacgactact

SEQ ID NO: 1081 - DNA, 1501 bp, Oryza sativa
acttgagggttcatttccttcctcccatcacagcagcatcggaaaaaaaatcgtcgctgctgtacgtcacccctggtttgacactcgcgcgcagcctccacagcattggaaacgcgcgcacacgacgagaggagcaggagcccagcaaggagagaagaaaaaaaaggaaaaaagaaaagaaaagaaaagaaaaacagagaatgcgtggggcccgcgcccaccactgtggcgcctgacacagctcacacctttgacgaaacggcagcccgtagcccccgggcccaccacacccccacaccccagaggaaaataaaataaaataaaaaatataaaaactcaagaaaaaaaaatcggggacaaggaaaaagtccaaggcgcaggacggagacgggcgcgatggacggcgcagatcatcctggggcccacttcggtggccccgcccgcggtatttattttttattttattattattttaatccgcccgaggaggaataccagagagcacaaagggagaaaagaaaattaaagaaaagaaggggcaaaaaagcgagagcactgccctggccccaccctcttccccaccaatttgtttatttattcatttatttattttcttcttcgttcactcagtggcttgcttggactagtactggactctacttctactgctgctgcgcttccctgcttgtaccagccgagggagagagagagagagagagagagaggggcagccactccctctcctcctcgtcgtcgtcgtctccaccggtggaggtctcagccctggctccagcgaggtgaggtttttactctgctgttcttgccctttgctggtaggatcatgcatgcgtatgcgtttcttgtttccgtggatcgagtagtagcagaggcagctgtttggggtttatgggggagtaaatttctgttggtttttggggattggttttaggggggagcagctgcaggggtgatggccatggttgtggagtggagtggtggggtgtggtgatttttttccctttttttttttctgttcttgtaggctcaggtggttcttggattgtgtcaggttgcctaattttggtagtattgattaggccaccgggaatgccatgttgcgtgcccgcgtgcccaattttagctcagctcgtcggaaatggcacccgtgtgcgccgcatgattgtgagaatctccccccctgcatcgcccaggtggtgctgtttcttgaaatcatccagtgaggtggctgttttttttaatatatatatggtaatggaatgattagggctatcagcaaatctacccatgtgttgcttgtttcctatttatatatggaaaatgctcatgatgtgatgtgatccctgtgttagagttgcatattggggctcaagaatttctaggttagagcatttggtggtgagcttgatagatttgtgtgtatgatcagagtcaagaggtgattgatttgtttgtgcaggtagggtgggaggggagtgattca

SEQ ID NO: 1082 - DNA, 1501 bp, Oryza sativa
acactttgagcatgcatggttcaaactcatactcagatagatatagtccatgttttcatttgatgacagctccacaaacatgtcatacaatggttgctgactctaatcaactctcatttttttcacccttctcttctcccgtgttagtttttttttctagcctatatctatctcacgacgcccgggggggggggggcgctccgcctataggcattcctcccacttctgcccttcctcctcccgttcttctcttcctattacagtacaccacaaaaaaaatttaaaaaaaacaaaaagttagaaaaatttatgtataaaaaatttgaattcaaattcaaatttgaatcgggtatgtaaacttttgacttataaactttggatctataaactttaggtgtataaactttagatgtatagaaatactatattaaaaaatatttgaattcaaattcaaatttgaatcggatatataaacttttggtctctaaactttagatgtgtaaacttgaggtgtataaactttaggtgcataaatttattaaaataggaaagtaatacggtgccaaaaaaggaaaccaggtggagggagggagggggagggggggaatcgatcgccctgagcgggcgagcgcgctcacccagtagcatttccgagttgactctcctctctcatccatatcaacactcacctatatttgacagggtcatgtgtagattcatttattgctaatgtaaatgtcttaagtgatgttcagtaccgctcatctgtctgtgctaatatacgggttttgtgttgtcggcaaatatatattgttttattttgttaaaccattactctatacacgtttatatattttgtaccattgctccctttaaacaattaaagtaaaataactttcagttctctagagggtgtgatatagataaaaagtatttccttcgttacataaaaaaccaacatagtataggatacgacacattctagttatatgtccagattcatagtattagaatatatcacacctggcctggtcttagatttgttttttacggggcggatggaatagatctaatacattcacatgtaaagaaatggatcggaacaaaggaaggcgtcacgaagaccttaattttctattgtccaatagctcaatttgtctatgtaatgaaattagcaagttggtgctctcttgagtttgtgcagctagatttggtttgtatattttaacatttttttagccattcgtgtgcttgtggagagcctctgtgatgtattagggaaaacaaatttaatttgcatatgcatgcgtttattaccatccctttcttatatatatatatatatatatatatatatatatatatatatatatatatatatatatatatatatatatatatatatgcgtgtggtgtgtagtgtgtatttcacataacagccatgacatatataccttgtatgtctgacccaaacttgtagtaaaatgaattccagtagccc

SEQ ID NO: 1083 - DNA, 1501 bp, Oryza sativa
gaaacaattttgtcgttacggtgattgtggcgcgaaaaacaccttatttctgataataaaaatggaggtggaattcccctccgattaaaagaaatactaacatgaaaatattaaattacacgcgaaaccatgttaaattggcgtgaaaattataatatcacgtcggtgtcggttaatataatttatcccgaatataaagtgtaaattgacaaaaaaattctgtgaagctatcactgtaacaacaggtgcttgggaaagcaactttctggcagctgccgcaagcacgaagatgtcataaccttacaagggaaaccacctgcattttctactgttctgggttagatcaagctgatatgtgcaaaactaccaacaaacaaagaactactactatacactaggagaaaaaatgattaaacgaagctgtcgcgacttcccaaagcagtttggttcttctagtatccgtgtgacaattcgtgttcctgataaaaaagacctgcatcatcgtctcatccgacgttcgtgtcacgatcaagttgacactgactcgatctaccaaccacgggataatcgagttgatttgataatctttcaccaagataagtttcagcaatgttgtgtgtgtactatctcctttttttttatcctcccagctattaaatagccctccgatatcttgctatttaggagtattaaatgtagattactgataaaacctattccataacccctagactattttgcgagacgaatctaacgaggtatattaatccatacttagcggatgattactgtagcatctatgtttaatacttctaaatagcaagatccaaacagggcgtatgaaactttcaaccaatgatttctcttccctcagacaatggaaacaacatgatatatcgtgtaagatgtaagaagctacttgcttcttcagtcccaaaatataacaacttatcaatagattagacactatcgttgctataattttttgacggagagagtagccatcattttcttgtatgcagtactccagttattttttgtcgtgaaaaaaataaataattgtgaatactactgcaacttaaacgtgcatatactgtaataatactgtatacgatacatatacggagaaaaaaatacggggagctgaaaattctcccaggtgcctctcggctacgcgcacccggcgccgcccacacgcaatcgcctccttctcctcctctctatttatacacacaaatacgccaataaaaaattagacttacctcctcagcctccccacccacgcgtctcaccggagctccgccgccgccgccgccgttttctcccgtcgtacgacgctgcgtgttcccgagtctcccttccgccgccgccctccggagccggcctgagtttggacgaggttgggagggaggtcgccttggacgaggagggggaggaggaggaggtggtggtggtggtggggcggcgccgtcgcggggggagatgggggccgcgcgtggcg

SEQ ID NO: 1084 - DNA, 1501 bp, Oryza sativa
gtcttaagactattcccagctgctaatacgcgtaccgaactaactggtacttagtacttggcttaagatagaattaatttgggctgtaccctgtacgtactttgcattagtacatagtactaggctactagctatagctaattagctacttgttcgtaatcaaacatggtgcagaaataacagtggaaccatgtggccagtggatgtatatcgatcatacatgcaatccactgatcctgtgtcgatcagacgatcgaagcgtctcttacttgttctcttcttttgttcggttccctggaggctggagataggatccatatcacacaaaggtcccattcattctccaataagagttggacgaagataaagatttttgtggcacacttttcaaactgctaaacggtgcgtttcgtgcgaaaactttatatatgaaagttgcgctaaaatatcatattaatctatttttcaagttcgtaataattaaaactcaatcaatcatatgttaataccgtctcattttgcgtaaagaacttcatcttcattttcgggagaaaaaaaataccaccaaagtgccactcgaatcacatcaaacgctgcatgcagagttgataaaccagacaatttttcttttgaattcgctcgatcgagatatatatcgccgtatcgatcgaggaatgtacagactggtgtgtcgatgaggagcagggatcgctggtacgcaatctttcctgtcgcctaaccgacatgagaggagggatccatcgatcgatcgatcgatctcatcacccgttgattaactcctcgtcgccaaggttcctgacagatcgaagatccggattacgcttttgtcgatcgatcgattcgagtgttcggtatagacgagagagaaatcgatcgctctgcacatgcatgatggttggtcggtattagtctgatgaactctgacgaagcaagttgatggcagacatggacgggactgaacggctcatatcgaaaagcagatgacatgtatctgctactagtactacactgctggtaatattcctcgggagcaattgggttttgatctggtaaactgaagatcatgttggttgtgatcgagcgataatggtttgccaatggcatacttaaccaggggaatgtgatcagttttcattgtcttgtttgatttgatgagatggggggatggaggtgacgacatatgatgagcaggtgaaggtacaaaactttatggccccttttgaattggaggaaaaatgttcaaaaaaaaaagaggaattgaaatcctacactattcatgtctttaattatttatgtctttaattcgtataggaaagaaaactttcttatttctacgattctagttgaaaaatgtatgaaatttaacatccactctaagtctctaatctcttgaaaattttctttgaatttatctctcttatttgattcctgcgttttttctactgtccaatcaaatggttattcctgtgttttgcaatca

SEQ ID NO: 1085 - DNA, 1501 bp, Oryza sativa
gataatactttttatacaaatttaaggaaaatatccggcggaaacgtgaaaattaacctatgaaaattagatctaaaaattttatacatttataaaaaaaattatgtataaacatgatatggacgtgactccggctcgggcgtccgatgggaggagattaaaatcgggcgctgacgtcagctcccgatttacgtgcaaaactactttaaactattttttttctcttaaattacttatccaaatcatgatccgattgctccatttgaattcgtttcaaaacaagaccacacatggatatattccgacaaaaaaattagcttattattgaattatttttaaatgttgcacgatgttccaccaggtatatcggagttgtttcactaagtagatcgaaaatgtttcacacgtttaaatcgggtgttgtttcaccttatataaaacaatgtttcagcaaataacaaagaatgtttcaattcactgcaacattagatccatacatagtgaaacattgtgagtacactaggtgaaacatttttggtgaaataaaaaataaaatgaattcccttaatagagggttttcaaaatatgtgggtgatttgttgcaatggaatatttcagttcactgcatcattagatccatacatagtgaaacattgtgagtgcactagatgaaatatttttttaaaacaaaaaataaactaaattctcttaatagagggttttcaaaatatgtgggtgatttgttgcaggtaggggcagggactgtggtgggcccagcggcatgcacgggcggccgtgcggggggcggggccgggggcggggggagcgtccgatttttgctcccccacccggtcgaccgatccctatcattatgggcatgatattaccaccaaatcacaagtccgacttcatcgaagaggaaaaaaagagataaatttcaggcatgttcggttttcagctcctccatcctgctgcaaaaacgatcataaccatgttgggccgtcagacctaaccttagcttcatacccctagttcatatagctaggccatgtaaggtccatggttattcttagcccaagccaggatgcacgtgggccacaaaatttgatggcccagcatggatcgacgcccggtggcccatgttgcgcggtcgcgtcgccgccctccccccttctcccagacccagcgtggcggcgccgccggccgcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggagga

SEQ ID NO: 1086 - DNA, 1501 bp, Oryza sativa
actatccctctgttgatcaaatgagtaaacgacggttgagccagtaagcagcttcgctagagaaaccggtgctcacctgcaactaataccagccgcatgataaaaaagcagagaaggtgctcttgcaaattccaggggacagagcaaacgtgccaacaatgcagcgtcgaccggtggtcgcggggaggaaaaatagcttctgctatttcatgtagtagcttctacaagaccacatgtgccaagacgacgacccaagaccagcaggcgacgcgattaattaaggattaatcaattaacccgtgcgaaagctactatatgcgcgtgcatacgtgttggtgttgctagctatagtgagctcatcaagcagtcgtacatgtaggttagtcgacacgagcggtacacaggcgtacagtactagaatggagtgcagtacgtagccaggtacgaacgactggtcgcggtcagagctagcggagtgtgccgtccaagcgactcggtcgttcgatggttgggtggaggagaggtgagctgaaaagctaagcgtcgccgcgcggtacgccgaggaagctaggtaggccgcggccctccttccttctcgtgcaaaaaacgaaaggatatgatgggtttttcacgtacgcgatccgcgctgcgtttcaccgtgacgcgcgtgtgccgaccggggggatacccacccggcaaacggccaccgcgcggccggagctacgcggtcacgaggcctgcgacccctgcaaggcggggatccggccgtcttgtgcgcggtgcatgctgcgccgcctcagctggtgagagatctaaggttcatgtcagctgaatttttctttaaggtcttcaccgtgtttagatccaaagtttttctttaaacttccaacttttccatcacattaaacttttctacacacataaacttcaaactttttcgtcacatcgttccaatttcaaccaaactttcaatttcggtgtgaactaaacacagcccttgtttagttgtgaaaattttttgggtttggttgtcacatcagatatacagagacatatttaaagtattaaacgcagtctaataacaaaacaaattacagattccaccaagaaactacgagacgaatttattaagcctaatcaatccatcattagcaaatgtttactatagcaccacattgttaaatcatggcgcaattaggcttaaaagattcgtctcgcaatttacacgcaatctgtgtaattgctttttttcctacatttaatactccatgcatgtgtccaaacattcgatgtgatagcatgaaaatttttgttttgggaactaatcagtgcctaacttttggtccttttaaaaatcttattctataaatagatcttaaaaaaattattctagaaaccaataccttgccggcaaattttgctacaggacactacttatgtgtggttttagccctaggacattgcccaaactcacttttgggggaaaacactccataaacgt

SEQ ID NO: 1087 - DNA, 1501 bp, Oryza sativa
ggcatcgctctctcggcggagtggtgagatagatgaggtcaacatctgcaacgctgtccaccactaacaccgtaccctgtgcatggccaagctaagcttggacggcgcgcgttacagtatgcatgcagcgtgcgttccgcagttcatcatctctgcatgctaggccgaaaaggacccctgatctaacgtgtatatattcatgtagcagtagaagtctaacaacaaaccagcatggtaaaaataaacctgctgttagctaattaagcatccggattgcatctggtgctgtgaaaaatgcagaggtataaagtgcaggggacctgggagctagggagggggagtccaggagcagtagaaacggccagggtgggggtgggggcaaggaaaccggttgcaggaaggcgtacaggaggttgatatgctgctccactgccggtgaattgggttccaggtcgcaagcagctggccgaggacgacgccagccaagccctgccccgtctgcactgcagcctctctctccccttttgttgaattgatcaagcaggaacaagtgacgagaccgctcccgatttcacgcaccgatcctcgtggcgcgcccgccgccggcaacaatcccgaacgggggaccactcactcgcaacctccattccttcacgtttacgtttacaccgtagcagcacgtacgggcaaatgccaagcaggccaaccaaagagatggctcggactaaactgtaatgtacttccttcgttcattaaaaaaaaactaacttccacacgtaaaattagatagatactcatccagatttattttcagaaattgattattttcagagtaactacgaatcatcacttgaacaacgtcacgtatggctcgacaattaatgggaggttttagccggattccggggagcaaatcctaccacatgttgaggggcaaatctcgcaaataccgcgcgacggcatgggcgatgatggacgatcgacgccgcagccggccaaaatcatgtcgagcccgagtccgaacccaatgggtcgcactgcacacggtcccccacacgggcgggtgggatggagaccggaggcgaaggggaacgagactgtgggtggggggggggccactagtcagcgacggtgaaatatatcatgaacagcgcggagaggtccatcgcctcgtcacccaacgatgctattccgagctttaacctcgagttaatgacgaccccccaggcgtccacgtcacgtccttgtccgtcattagtacacctttttcatgtcactgtggccaagtggccaacctgatcgatgccaaacaagtatccatccaatccaacagtactaatgttgcaatttgtggtgtctccctccagaaaaatcccacgtaaacctagagacctatccggaagaagccaaacgaaaaataatttataaataaaacttttatatatatatatatatatatatatatatatatatatatatatatatatatatatatatatga

SEQ ID NO: 1088 - DNA, 1501 bp, Oryza sativa
aatagatgtgaactccgtgaattaagactgcaaaatagacgattcacttggagtaacgagagagatgccccaaccctcgagaagttggatcggattttttgtaacccagatggcgatatgctcttctctaaccacaacctacaagctctctcttcctccaactctgaccactgccccctgttgctctcaccaacacaccagctgctgcgaaaaccaactttcagatttgaaaacttttggccaagaccgccgggcttccttgacaccgtccagacggcttggtcccagccagttagcgcttctcaccctgtcaagcgcttgagttccaagctgaaagctacagccaaggctctacggtcctggagcaatcgcatcctaagtgacagtcgcatccaattccatctcgtaaatgagctaatcctccgtttggacattgcacaagaaaacagagcattgtcgcccttggagatctccctcagaaaagatctaaagctacagattcttggtcttgctgctgtagagaaggcaaggagaagacagcgatccacactaacatggctgaaagagggtgatgcaaacactaagtttttccacttgaaagtcaatgcgtgccatcggaagaacttcattcacaaactccaccgtggcaacgtcatcccagaaactcatgaagccaaagagcgtgccctacacgaacacttctcctctctgatgggccagcgactccctcgctcttgcaccctaaactgggaggagcttcacctaccccaggtgacgccagaagatcttgactcccccttcaccgaggaggatgtttgggaagctatcaaacggatgcttgctgagaaggcacctgggccagacggcttcacaggcaccttcttcagatgttgctgggaggttatcaagtcagacatcatggaattgcttgacaaattccactccttatcgggaggaaatttcgggagtataaacagagcgacactcatcctcatccccaaaaagaatgatgcttgcactatgggcgactatagaccaatcagcttaattcactccttagcgaagctccttgcaaagattttggcaatccgcctatccagacaaattaacaaagtgatatcacaagctcagagtgcgttcatcataacaaggtgcatccaggacaatttcctctatgtctccaacctggctaagaagatgcacaggtccaagcagcccaccctattcttcaagctcgatattgccaaggccttcgactcggtctcatgggagtacctcctaacgctgcttgaaaaaatggggttcagtactagatggcgagactgggtggctttaatcctctcaacctcctcttccagggttgcactaaatgggattgagggagaaagaattgatcaccatagagggctaaggcaaggggatcccctatccccatacctttttattcttgcgatggaccccctacatagactactcaagattgcaactgatgagggcctcc

SEQ ID NO: 1089 - DNA, 1501 bp, Oryza sativa
gaacatatatcaccagcatgctgataccaaataatttaatgtatttaattctattgatacgattctgagaggttaatgattgttacctgcgagtcttttgtggcatccctctccctattgagggtacttcttagttgctacaggtttcactctgcaaaattctttgctcctgcatattttaacaatagtatgcaggatgtaggatggagtagaatatagcaatggaaaatgaatgtaacttaattttcataaaaactgagttgtacattgtacctgaataatttataggttgtaactgatcttggcttcgtttattcatgagtgcatggctttgattgcattatattgtgagaatttcttcctcttgaaattatgttgaaaattgttgcattctttgctgtttggctaatttgttgtgtatcagtcttcaagctctaattccatcctgttgcaatcagaaaatagtttgtgcatcccaatcaaccatgagctgtaactttcttttaaaccaggtggtgctgatcataaagtagtaaggaatttctgttacaatcagaaacaatggcaggactgtcgaagaagctcatgaaaaatattgagaatacaacccaaattgcaaaggatggcaggactgtctaagaagctcatgaaaaacattaaggtgaaaaatattgagaataaaacccaaattacctgactgttcctgtattctagtacctcggatcgttctgaaatttttatcgatttgtgccattttgaaggttgctaatgaagcaagagttgatgtcaggttgaagataaatccaattttgtctcaaagatgctcttgataagtaagcattcaactccaacagttccctttattcctttatttttcaattttggtgaaatgcatatgtactatttcttgtgtattgtggtcacacttattttagcagattctcagaactgattaggctaatatgagtttcataagacattgtgttttgtacttttgtatggctacattcacaagattttgaagattcaaatatgtgttgttatgttggaccattacaccccattatgttgtttactgttgtttacttccagcaacctgtcagaaatttaattcgaggtttctattcacaaagctgggaagttgctttatgatgatattgcagttgatttgctattaacagataaaatagttttgtatggtatgaattgattttgttctgccaccatgtttgctcccacctgaacaaattaattgcgttatccacggtaatttgtaatgaaaacgacaatatttctaaccccccccccttcttctgtagtgcttcccgatcactggcactgagcaggccttgctctgctctggtgcagactcaatggtgttgatccctaccattggtatctttccctagtccaatccatgacaacaccaaggtcgagcgaaatcctctatggacctcatcacatcccccccccccaccacactgtttcttggcatgtcata

SEQ ID NO: 1090 - DNA, 1501 bp, Oryza sativa
ggatgaaaaggtcacattttcaaccaaattatgactccgtaaagtcaaccgttgatgattgtgcataatcagaagcaattaataagcacaaaatattttatggtatttctgaattcattgttctactgtggaccatgtggctttttaagtgtacttagaccattctcaacctatgacactagacataatttccataaactccccatcatcaagaaaatagtgttagacaccactcttctaatgcaaacaccactattccatacttcaatttaatgctacttatctcacatgatgtcttggatgttgtgtagaaaccatgtctcaagacatggttttcttctctttcctcatttatttacttgacatatcattttttatcctaggtggcagcttatttaatgctatggacactatcctagtcattggattgggaatgaccttatatcatgatgatataaactattattcttggactcgatgaattagtacagatactatccttgttgtttttacttgattcgttgtactataatgtgtcacatccagtacaagtttgctatattttaggatgaagggagtacttagatgatgcttttacaggcttttttaatgtttttttcatacatatatattaaaatttttataactacattacacacgaacgatccgctgcaacactggaggtttcatatagtatccgctccacacaaaacattaaagaattttacaactatcccctgccccactctcactcactcatctagtatatattttttgagtgaattgcatttcgagccatattttattgccaaagttttactttaaactaccctataaccaatattcttactttgaactatgtaactttacctttgttacataatgaaccaacctaattctatttgctagtcatgtctagcgtctccttgggtaaagggataacatgcatatagatataaaagtttgccggcatgtctttaacaatttactcgaagtcattgaagtgatgaagatgcggtttgggggtgatcaattgtgcaacaaagataaaattacctagtccaaattgaaaaatttaaacaaagaatgattttaagtgaaacctaaagaaaaagtatcatccaaaatgaaattaactctatatttttttttaccatcggactgtatctcccttcccaggcccggccccccggtaagcttactcgctaccgatcttgttctctcgccccctcccggcgcgtgattcccggacgcgactcgactcgacatcccaattcccaatacaccaccacgacccccctccgtcctcatctgtcccgcggcctcgaccacgccgggaggagccgcagccagtccgggagacgctcgtacgcctgcctcgaccgatccagcgccgccacggcgaccgtggccaaggagatccgccccctcgtcggtccgccgccaacgatctccgatcgagacaaaccctagccacgcccattgccttctcccgtcgcca

SEQ ID NO: 1091 - DNA, 1501 bp, Oryza sativa
agtggatggcacaaatgatgctagcattatgggttgacccaaggtgccaatgtcattggcgtcatcccccgggtgccccgtcgaccgggattccatggtggcaggggaatggccacggcgtcagcgtcatttgcaccaaaaaaagatttattaatatcataagttttcttgagagttttgtttataaaataagttttagaaaagattaaattgtaagaaatctaggctagccattcccgcacaacatagggaaggaagaggttaacatagggaaggaagaggtggggatgcaaggcatatcgcatccactgctagcctaaaatccaatttctaatccttcgttttccactgatacttttcgtgaaactactaaccggtgtgtttttgcaaaaaaaaaaagttctataggaaagttacttgaaaatcatattaattaattttttaagtttgtttagctaatacttaatcaagcatgcactaatctacctctccattttacgtacttgagaagggctcccaaccccaatggaaaccagccttaacatgattaaattccaatcattattatcaatgtttaagaataaaaatgtactaggagctacaagagagcacctatacattttactttttcagaaatatctcgatctaaattggggaacactgttcctagtaagcaaaagcttcttcacgtacgaacaaggcaacagcacactccagtactccacataccactatcacacagtgggatcgcttacgtcatatacttttgtcctatccagccgccctatgtcagccacatgccagatgtgccctacacgaccagacgcctttcccgttaaaagcgacagcccatttatgggccccacaaccctgccgccctaatgccctatgaacactatattaatccctccaactgcacttagagtaagtttaatagtatagccaactacggactccaatttatttatagccaatctaatagctcattcatataataattacatactacactattaatacttggtcccatctgtcatacacacactgcatcttggagtccgtgctacagctggttacaaatctgtagcccgctgcccatctctctctttatttatcttcttaaaatatgtttacagctggcttatagcatgctattgtacatgctcttagcgagctctatataaacctcgctacccgattcgctgccttcctggaaccaatcagcagctaaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggagg

SEQ ID NO: 1092 - DNA, 1353 bp, Oryza sativa
ctcacccccaccactactcctttttaaaggagtatagactagccaagagcccgtgcgtcgcaatgggaaacagattgagtagtacttttattatttttcttattgaacaagtaggtgattttgaaatttggtgagagccaacagtggaacggggaaggacttgttgaagggtggtgttggtgtaatagtatggattgtggggcccaagtgccagtggtaggggtggtgtggcagaacggacaccaccactactaacattttaagtagtatagatatagatatagattttgatagagcactaaaccctccaaacatttttgttggctcactttaccccctgaactgcttaaactatggttgcccttggcgttttatctctcaagtttattgcatagcatattgccgtcaagatatcatagtagcttttccttctgtaatagcatgcacataatattgacattttggttgaggaaccaaggacatttccattaccaaacaggaatccacatctgctgaaatctccatttacatcaacttagcacaaatgatggctacactcttctttttgtagctaggatgtttcataagttcgaggacatgctattctggtttttatgcgcagtctgctttttgtagctaggatgtttcataagttcaagaacatgccattctgatttttatctgcaccccgcgtggatgtcagataatcttttttatctgaattcataattcattttccataatgttggttattcatgccacttgtcttgatgccatgaaaggggattccataatttatttttcgtcattggttgagctacggcttataagccgaacaaaaaataaacgaagcaaccaaaaatgattttagggcaggacttttagatttctactcattgttttaaaagccaaggttgaaaaatagaaaacaatgaaagaacacctagattaatttgaaaaaaagtttcccatgtcatgattggttgaaaacatgagtctcatggactaaatgatgcgaacatgtaaaagaatgtagactatacaatattgaaaaattatcttaattaagatcacaaaacgttgaaagcctgaatacacatactcgcacaaagctgtgcacagttataaatttatgattgcacacacgctgtacatatttatctcttttgtagggtgttcatttttactattatgcgcaatttttctgtagctgcacatagtctgatatgttttacatctatgtacttttatatgctatgtgcatttcgtaaaaaaaatggtgcatttggtatgtttgctagtttaggaaaataatatttgtggttgtgcatgatggttctgacattttgcttt

SEQ ID NO: 1093 - DNA, 1501 bp, Oryza sativa
gcactgcccccgtcccatcgcctatgaacggtcacaggccggtcaagctcgattgacatgggtcaatcgagcggcgccacacgtccctcccacgccgcattaattgcggcgcaggacggttggggcgccgcacattgaaggcgcggagcagtgtttttcgccccgcctgctctccccgccacgtggtggccgggcgagggcctcggggtagcacgccctgaaagcccgaggggtgcgacatggcaccccgaggtcccctggccacctcagcgctacccaaggggcggggggaggcgaggccgtgtagccacgcgactagatgggaaggatactttcctctactgtgcgtacccccgggcccatttcaccgacacatacatattgtgaggattgctatagttaaagtttatttatgtgggtctcatctatatagactacttttgccatatacattggtgatgccctaacgatcgtggtagctggctttttttgctgcctttgatatatcatttttatgatacagtaaatatccctgaatatctacagtatctcttctctataggtgtatataaaggagctatggtggggagctgagcctgtgccgagttcgacccttgagttgcaagcttagggcctgtttagatccccaccctaaaattttacaccttgtcacattgaacgtttgaacacctgcatgaaatattaaatataggctaaaaaaataactaattgcacagattctgattaatttgcgagacgaatcttttaagcctaattgctccatgatttgacaatgtgaagctaccgtaaacatttgctgattaattaggcttaataaattcgtctcgcggtttactaacggattctgtaatacaccctatattattttttttaataataaaataatacaccctatataatatccgatgtgacactctaagactttaccctgaatctaaacacccccttacctgcgtgagactgggaaatggctgtgattgtcgtacaacgtcagtacgtccaggggtgggaagggtgcagcgagccacccatatgcagcgagtctgcggagcgtaacggtcttccatccaaaggatccttatccttccccagcccagagggcacggcacctctccctctaagacggcacgagcgacattaatcgcccccctctccatctccaaatccaaacgagttgatcgtcgcatcgagaccaaataatgccaattgccagtgtctctgccaagcctctgtctcacctccccgcaaaacgaggcaagtgaaaccatctatcgaccctcttttaacttctaccctggatgtatgcgtgctgtacaattctgaatttatctgcatgattctttcttggcggtactttcaggatcatccaggttcacaacgaaaggtacatcaagagtaagggttatgatgcttaggcaaaaaaatccgggaggccagaagaagagctttgatggaacaggcgagcctctatatcttggga

SEQ ID NO: 1094 - DNA, 1501 bp, Oryza sativa
tgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacggggaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggacaggacgactagtactgtatcatggctataatactgcatcatggctaaagcgtatatataaaactacggaacatgttaaccattttt

SEQ ID NO: 1095 - DNA, 1501 bp, Oryza sativa
tctgaaaccaggacaatgcaaaccagagagctaaaatgaacttattccaataccaaacgctgaggacacaccccgtgtattttcgtaagattcgtttcatttggaagcgaatcgtacatactactcgctaatacctctctgcagctaatactactcgccaacggctcgttctacacgccacacctatgtactgcgtctagactggaatcatttctggacgtcaatgcattgatccgtgccaactctcgcgtcccagtcgtcggagcagcaggcacggcatggtctcaggcagcctgccaccgagggaaaatggtaaaagggacagcgaaaactcaaggccaaggcagcgggtcggtcgagtcgccgctcgtttcgccggctcgcctacgattcgctgaaccacaagcagaaagtatgtatcagagcagtataatagcagaggctacatttgaataagataaaaaagaaaagagaatagcagtgggatacagatttatagccagctgcaatacagactctaagtatgtatgataggtagaaccacatattaattgtgtaatatatatttataggtaactattgtattaattgactattaagctaactatagataatttgaagctgtcagttaactatactcttgagcttgctctcagccagcatggcatcatgccgtgctaattagtcgtcggattcgttaattgcccgggatggccggggagacagctacagctatggatcgatgggggtggtaagcggtcaatctgtgcgggcagaacaaaagcggaagtgtggaacgacgcgtgagattgcaagtctagctcggctcctctccgcttggacaaaatcggcagacgtttctagccgggcaggtggtgctggtgcctgcttgttttgtttagtcaagacgggtggacgcatggtgcgctcgtagtgcggtgtgttcctccctcatatgggcttcgcggaccgagcaaaagtccacttagactctcttaattgttcaccgaatctaattcgtgacccttaactagaaaaccgggtaagacgactcctcgaattagtgaaaccagtcaaatttgactcctccggcggtattggagagtggttttgctgacgtggcgctgatgtggcggtgctaacccggttttcatgccacgtggcgcttacgtggcattagagttaaaacaaatatctatgggactcatctgtcattcaacccaaaattattgtgggacccactggcccacatttcatcatttctccatcctttctttctcctccctctctctcccttctctcttttttctccccattctctctctcccttccaaatcggcggcggcggcggcctgtcatgcccagaaattcacgaaccaaaatttctaagctgaatgtgcattaaacccttgtccaggaccagccaggatacacaaacgacaattgttgacatacagatccacgtcttacaaaaatataaaagattacaaatgcagcagaa

SEQ ID NO: 1096 - DNA, 1501 bp, Oryza sativa
tgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacgggaaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggccaggacgactagtactgtatcatggctataatactgcatcatggctaaagcgtatatataaaactacggaacatgttaaccattttt

SEQ ID NO: 1097 - DNA, 1501 bp, Oryza sativa
aacccgttcctaaggtaagtgcacgctgatcacgatcggccaacagaaacaaggccacatgtcgcgagaaaaaggaaaagcttacatatatatacctaaagtcctaataaatcaactgcgtttgcaaccatctctgggagaaaaaacgccggtaaaatctcaacgatttcttaactattatccgctcctgaactatcctcgcgtcgaccgttgactatccaccggagccgacgacgccccgctcacgacgagagagcgataacgtcgccgcttcgaattttgaaggccattttttttttcaccagctgctgcccacgacgacgtctttggccttggccgcttccctccccgacgtcccaacgtgcgcgcgcgcgcgacgccgccgcggccttccacgttttagccgttgcgtttcgcggaggcgccgtgtcactgccaggtggggtcacagattgcgccgcagagcgagcgagcggcgcgcgctgcgctggtggctggcgtcactaccggtgccaggctgtaagcatgggctccgcggtggccgcctcgagattggtgacgcggacgcttgggggcctccagagcccgacacgtgtccacagggtgagctttttgttcattgattgattcctctctctctctgctgcgacgtgctagattgtctttccgtgttgtatacttgtatctacgggggcattgaattgtgctacggatagaatcatagaagaagagaaaaaaaggatggagaattcaaagacagtaggcttctgcaatctgcactacagctggcttcgacaacgccattacctgtcgctctagggttgcaaagctgccacgaacgattttttttgacagggccttgtcttttctacgatcgaaacccccaaatatttccgcttgtaatatgtgcaagcagaatttttttggtaggcctacgatcatgatgcttctaagtatacagccttatccggtccgttttgatcataaggccatgatgatggcagcactaactactcctaattggcaatgacaactgataggattactagtaattggcatcggctcggacagagtttcagactttcagttcattgcaccaactgaatgtctgaatccaacaaccttccatgtggtggccctgattggtttcacgcaggagctcatccatttacatggtccttgaggtcctgaggacccttgaccttgaggcgaggttttgagctgttcaactctgcaaatgatcccttgactttacgcaaggcaatttgcaaagctcacttaattagtaggagtactagcatataatttcatattctgttcatctaattgatgattgggctgagggagaaatgaaaagcagaggctggcagagcactcgttgagatcagcagtggtatgcccaggaataaagcaacagggtgtgcgtgcacatggtgagttcttgggtgcaaaggtaggtacatatcctttggcattggggaggcagcagctccggtctcct

SEQ ID NO: 1098 - DNA, 1501 bp, Oryza sativa
ttttctcccagagatggttgcaaacgcagttgatttattaggactttaggtatatatatgtaagcttttcctttttctcgcgacatgtggccttgtttctgttggccgatcgtgatcagcgtgcacttaccttaggaacgggtttttgattttgggattaaaaatgtccttgatcagtactacacatgttctcacctttttagttctcatttctgcacgagttaaggatagtcaagatggttacgatcgcaaggtgagtggatcaaccacactctctgtcatgttaacatcttgctctctctctcttttatttactgtcaaggcgccgtttactttgtaggggtcgtactgttcatatttttcctttcgtgcatttgacgacgacttctcagcaataactcgctgcctgaacgtgtagtgttaatcatgttactcgcctacaaatggaaccggaactctggaagagaaaaaaagaagtatttgcgagaaagaagagtagctggaaatttgatacggtcgttttagggttgaattgatatcagatcctaaattctctctccaaaccccatactaattcggcaggatatctttcacgataagtactttcctgattcatctccttatctcaattaaacgataaatatctcaaagaaaacgtgttgagcggaaccagattaaaccgaaattcacaacaactcccaaatgtcgcgcgaaatatactccattttttcttgttagtacggaacaaaaacaaacacgaaactggagctgactgagctaaagagcagtaaaagaagcgatccgcttgacggtgactattacggccgctgccgcccagaggcaccacctcacctctccccttccacttcgctagcccgcttggcttctcagagcctggaggaaaaaaggaaggtgggagaggcagcagaggcgaggcgagggagcgagcgagcgagcgcccgaatccccaaaatcgcagcgcgagaataaacaaaaccgaagcggcagcgggagcagcagcatcggcggatacaataagcaaggggagcagcagccacgggcaggagaggagagtgcgcaggcgtgcgggagggaggaggggggaagaagaaaatcgcctgcctgccgccgcggtggtgggttggtgggtgccgcctcctcctgctgctgctgctgttcccccattacctcgccccgcttcgcatggattccccctcgcttctcccccactccacccgccgatccaccggccggggcagcgcgaggcgatgcaattgaggtgaggtgagaccgccgcttcttccgtcgtcgtcgcgtgggttttttttttctctctttggtgctgggggatacaacaacctggcggccgcgctgccgctggacgacgccatcgcgcgcctgcacggcgtcttggggtggacgaggcccagcagccgcggcggcggcggtgggaggaagaggtggccgcgcgggggaaaggggagcgccatgctgtgggcgg

SEQ ID NO: 1099 - DNA, 1501 bp, Oryza sativa
acaaatgtccaggaacgtgccccctctcagcggatgttcgtgcgtccagcgtcggcgccatatgtctcgcacagaggtcacatgcgccatgcatcatatactcatatgctcgcacattaacccatatgcacaaccgctagggtcggctataatatcatttgtaacaaccctgtcctcaacaaccacgtagcccaatccatctgacagacaagtcccacttacacataccaccccacttacgctttcgtcatcgcttcctataaaagagttaattcaggagtaatatggttgaagaaataagcctttataagttggttccactcttgctcaattagtaagtagatactaatcaattgcacacaacagtcatgggccatatatgccacatcccaattagcctaggatgtcacatgatgcagacgaccaacaccacagcgagagcactccattgagctcatggttagtgaccatgacaggtcattggcgagctgactagatgggttgcatctatggagtatttttaagttctcatctcgaaagaccagaaaacaaaaggatttgagacaaattgacaagaaagaagagcaaacaaaggctcacgagctcgtgtttagcgtgacgcccagcgagactacccatgtcggcaagggaagagggaagtgaggagagagagaggggtgacaaagaagatgggatgaggtgtaaatcattaacatgtgggactcacctactgattcaagtatgtcaaccgtgattaacctatcaagttagcataatccgctttcaaaaaccatcaaaagagataatttgtaccaattttcaaaaattaatgagacgttatggtaattttatgattgagggagacgatttaatcaaagagtaaaagataaggaagagggagacggaacctttgctttccttgctcatttcggggctaagggcagtcccaaccctccacctaggatggtgtctacagtattaactacattgtcatgtagaacttttagcttatgttgcactatattaattaagagagagagtgaagagaggaagaaactgggtctcatgcaaggcacaacttcaacacgagaacctgtgcactagactgggagagaatagtgttttcataatagatgaagaataaatatgattggtagagaagagagatgatgtatttattagtagcctactttaataaaccatgggttatagagtgtagtttctattgtgatgtcttattaacatggcatcatagacactgtttatggacgctatgggttgggaccgacctaatttggcctgatacacttgtcctacctaggttgcgacgaccacggagacaagcaccctctgcatgttgcacacagagacggaatcaacggcaatcacggcgatgaacgtgagaccacgtccacatgtcgcggcaaactagcggaatgaaccaataaactattgacggtacaaaagtgaagggatcgcggcacctgttcgggccgggatt

SEQ ID NO: 1100 - DNA, 1501 bp, Oryza sativa
gtgggacccacgtctcctccagtcctcctccccaatctcgctgtctcctccccaatgcggcgacccagcggtggcctccccatctcctcctcctccgggatccatgcggcggcggctggaagggtgggaggacgagtagtggccggcgaggaaaaagggcagagcttgccgacctgtagacgctaggaggggtcttctcctcagccgacgttgtcctcctcacagtcggcgccgtcctggttggcttcctctcagtgtccgtagcaaccgtcttcgcctcaccggccgccattctttcctccatggcgccgcctgctgccaccttcctggacttcgagacgatggaaggggcctttcgttggccggctcaaaggagcccatcatctcctcgaggtttagcgagctgatccggatgacgtcctcggtccatccccatgaggtggtcgacggtgagcggcatcttcttggccatgacgaggtcgaagaagttgggattgacgaggttgggggtgatgggatcaagtgggacggctcccatgtagccgtcctagccgttgcagaaggcggtgatgttggatcagtaggtcatgtcaatggggccatgtcgacctcgatgaagaagcacttggccttgccgatggagtggccgccggtgaggacaaccatctcagcagtgggcggagctgagggcggagcagcgacgggccgcgggcggctcctctcctctcgccggtggtgccccgcgtccctccggccatcgctgtgacttcgcctgctccggttgccgcccaccacgctccgccggctggagagagagaagagggagagagaggatagacatagaagatagagagaagatggtagtgagagcaaccacagtgtttggttcgaccattgtattgatcgaagtcgaatggagagtgaaatcgatagctgcagtgtgaaatcaatttgtggggccataaaaagaatccatcaatcaatcagtgtgtctaatttctatgtatgtatggacaacaaatattttttctccctagagttcgacttcaacttagagttcgatttttttttctgacaccatgagtcggctgccacaatgtgtatggttcgcttttctccgccttaaatcgattttactttcacgctggagatgctctgaggatgatgtgtgggtccacatagggcccaccttttttattttttgtgtgaaactgacatatgggtcccacgggttttattattttttttatctaattatcacgtaagcactacatcaatgatacgttggacaaagacatagtcaaaaggagcctcataggcgccacctcagctaaaaccggacacaatactactgagggacctcatttaaacggtttcgtaagttggggacccgtcgttttgtgaccagggtccgtaaatcggactggacgacaaatagaagtacccaaagtgaacttattccccacccaaatcccccaacctcaaaagcccagcccaacaa

SEQ ID NO: 1101 - DNA, 1501 bp, Oryza sativa
cgccagattgtgaggacgagacgcgtgcgtgtgcagcaatgtgcaatgcaagcctccgtctctttgcatggagccgagtaatggcgccgccattgtagctaagctaagctcgagggtagtggcgtggggtccatctaactgtttgtctgctaacactcacaaagttgttttgggtgggatatatagagagagagatgatgatgcagagaagacaataagtgggtataatttggtagggtatgtgatctaatctgtgctgttttgtggcatgtaaaatgacaagaaagcactggtctggagattttttttagtgctaaaccctggatctcctttgtgtaaaaggtgcttctttgtctcatcgtcttttctttagtgctctctcagttttttttttccaattcatttgcaagaacagcaaaatgaaataggctcgtcggtggatagatatgctatgtggtgtaatgagtttggatgggtccatagctggcagtacttggattatgtaagcacctactttggcgtttcagctatttatagaccatggcaattggccggcatgatgagtccccaacccacccttgtatcttgtacagtacttgccaaccgaaaatgctgtgccatataaatgcattcatcaatcattcgcagtgaaccagcaaggcgtcctccttcgtaagggaacatatcctgtacatatacaaggtattttcagttagtgtgcagggccagtgcaccttgtgcgcacataatacactccccttttgtaaagcagtaataattcatttgttgacaattctgcagagagagagagagagagagagagagagagagagacgttcaaggcttcaaggagaggtgcaattgatcaatatcaatgacagcgaaaatgccgtagttctagaatcagaagtccggaatccaacgtagatttttttctcgattacacgatagatttctcgattacacgatagatgcacatgtacatagttacacacaacatcacattcacatccccgtgaatgcgttcctcgacacatgctaaagagaaaccagcaacatgccggcatatccctaatatcataatccaacacagattagggatatgccatgcccgttcatagtggataaattccacaggaacttagaaggtaaaggaaacaccagatgcccaaaagcctaatacaatgaaaatcagtccacgtagaacaccgaaagacattaccattgattaggatagcatgagataaataaattagtctgttcggctccacaagcatatacattccaaggtagaacaaggagccttgccaattgccatctcttacaaacattgttaagctagacatttcactttacatactaaggttcaaaaaaaaaaaaaactacggggttgaaatcctgtgagctatcttcccagtgcaaacagaaattttcatctgcgctgttgatagactcccaagattgttagtagcccaatttgttcagttcaggctagattgca

SEQ ID NO: 1102 - DNA, 1501 bp, Oryza sativa
ttatccgactagtcataggggatagtttatatctatggaatatgtaaccgatcatgacttgggtattacgtttccttttatattatggagcggcctaaagtcctgatttgataatattgtaaaatagatttaggaaaccgataccgtattggttaagatttctatcttgtaatcctgccccccatcctatataaggtgggaaggaggccctctagggggcatgacacaaactgatcgtcagatcaatatacacccggtggattcaaatccccaaacaggagtagggtattacttatcattgagagggcatgaacctgtctaaattatttgtctccgcatccatccatttttaggtctcgtgcgctacccccttttattattgccaaattcatgtttcgacagttggtgcgccaggtaggggtgcatcgagtttcccgtcgatgagtgcgatggaactaatctccggcgttgccagattcgtcaagcatgtccttttcgtctcggatttgttggaattaatgaatgggccttagcccactcgaagattaattctttggaaaatcacaaaagcccacctcatgggatggcatgcatgtggagttttgtaccaccttgcttattctaggagagggagacctccttaaaaggggggatgccctcctagccacttgaagcatgtgtggtggagagaagaggggaaatacacgcgcgcgctcgctcgcctcgcctggcctggcctggcagggcagggcagggcaggcggcgcgcgtgcacgacgtatgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgaccgccgtcttcacgcaatatatgcgaaaatcaatctagggtttgcctcctagactactccatcccgctcgccggcgtgcatcagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgttccttcgtagacacctgcgaaaagtttcgaccaagcagccggtcttttcgtcacctcggtacgtgttcaatatgttgcgcatttttgatctgttaatgttattctgcgtagtttacatgtgtagatctaatgatgcgttcatgctagttttcatctgtaatgtcatgatttatttatggaataaattaaatcattatatgctgcccataatctcaacaatccaaaaaccttattataggcactgtgattttacta

SEQ ID NO: 1103 - DNA, 1501 bp, Oryza sativa
gttacggatcgcctccccctccgccactcgcacctcgacccctcccccaccttctttgcgctctttccccttcacctccgttgcgcatcgcctcttccgccctcgccgatctgcatagccaccgccacctcgcaggccttcagtctttgccgccggccaccgctccgtctccctcccctctcatagccaccttcgcctcgcagttgcctcaagtttcatcaatcacatatcactgtcgcactgccatctcaagtccctcccgatgcaagcgccgccgacctcaaatcgataggaacgccgccaacaaccctctcttcaccatcgatctggcctcacaaggtggcgggagctcgagtgacggtggctgagattggaaggggagggaggagtggcgccacagctctccccggtggcccatcgtcctctcctccatctcctctccgctgccttcgcgctttcccacgcacctgctcacgccacctccattccatcggcgccgcagcactcaccgacgtgcatccaccccctgagaccccgctcctagccgttgcccatcttctcctcaaggccaccgtccggcaggtccacgaggccgttctggagtgcgagctcattcctacctagcgccgcgagacattattcatgcaatactggttgccccacgtatcctcctacaccattaagccaaggtgagaggtacgacgacctttcacagaaattcgatgacctcaactagcgtaagtgttccctctcttggtgcagtacttgctgttcggatcaatccatgcaactgaaaacaatcttgatctgaggcctaaaccagtgcggctgattatgcagaactcgactaatatattgttgtcatttctatgtagaggaaatttgaggtattagaattcagaatcgtaatgcagaccaccagggaaatgatgtgggatttgtcatcccataggtaacctttatgatttaccatgttacaaagttaaaccgaaatgataatgcaaagtagctccgtgtttattctattgcttcagccttcagggtcatggaaacgattctaaggttgggtactatgggagagaaggatagttgattgtcacgcccagaaattcataagtaatttccgaactaatttgtgcattaagaccctcgtccaggacttaaccgaggtacacaaactgacaatttaatatacagattcatcaaaataactaaagcaaataaatacttacataagaggcacttagtccttaccatgaagaaaactgcagcggaaaaataaaacctagcgaagcttcagctccactcccacaggcagctcaactgggatctaaaccaaaggtcttctccttctggatcctttttcttcaactgaggtttgatgattattgcaaggtgagtacatggaatactccgcaagccacacagcaagtatgcaagtgcacaaggataccaaaggatggcataatatagggttcatttgcgaaagcagtatttagca

SEQ ID NO: 1104 - DNA, 1501 bp, Oryza sativa
acataaacttgatctagataaaattttattgaatactttgtatgcccaagtattctctggatttttttcagaattatttgagtattggaattatttttaataaatgaaagatcatttcagcaattatttaaattaaaaagttaattaaattctcttcctcagtctgggctgaatcctgcccactcctctctctcccttctcccttccgcagcccgtgcctctcccttggccgaagtctgcattagctccctcctccttctttctctctgacccctggggcccactaggctacagtgccatcttcctcctccagcatctctcccgtcccgtgaccgtgaagccgacgccgcatcctccgctcgatccggtgcatcccgtgctccgtttccaaaattggttgcaaaaacggattcccctcaatctcctctatcttatccctaagaaacccctttaaataccgttgtatattgcgtgaattcgacgcggtttcgagctccgtttttccggcgaatcctaactaatccgtcgccgattccatccgttcccgagccgacctctccctcttccggctataaatagcagcccctcgacctcctcttccgtttcctcctttttcccgaatttttccctaaccccttcttctccaccagtgttcgccgtaaagccgccgtcacagtcgtcccgatctcgccgccgctcgaagctcgtcgccggctgccgttcgtcgcccatcatcatgcaactgtgggtaaggactgtcttgttctcctcttcgctttagtgctctcgctttccaccgttgtgtcatcatttgtcgtcgccggccatctcccgttgccgtttttcgtcgccgtcaccattggtgagttcgtcgtcgcgtcttctctctcccggagctgtccccttatcgtcggagcgtcgccgttcagtcctcgttgctatccagagccatccgccggtgatgatgttatcgctgacatccacatcatctcaagccattgcaaaatcaatataaattttgttatctcttttcaatgacatattattcctttttaatatatgttacctacgatctaatctattttcggaggatgttttaatcttttgtctcagctataaatcatctgtaaattgtttaatcaatttggattagtcttttctttaataggtttaattggaattaaatcttgtaaaattcatatctaactcatacgaactcggaatgaggtcgttcaagtcccataattcatctaaattcaagctctacctatttatgaactttaattgtactgttcatttggtttttattagtgttataggtttagttttccgttgtttcggaggatcgttcgttcgttggagaagttcctgaagacgaattgaagacgctttttcgcaaggcaagcatgttgaatccgtttaaagctaatgttttatttcaagttatgcattattttagaatgtcatcgggtggtgaacctttctcatttaattatggccg

SEQ ID NO: 1105 - DNA, 1501 bp, Oryza sativa
taggtaggaatgagctcgcactccagaacggcctcgtggacctgccggacggtggccttgaggagaagatgggcaacggctaggagcggggtctcagggggtggatgcacgtcggtgagtgctgcggcgccgatggaatggaggtggcgtgagcaggtgcgtgggaaagcgcgaaggcagcggagaggagatggaggagaggacgatgggccaccggggagagctgtggcgccactcctccctccccttccaatctcagccaccgtcactcgagctcccgccaccttgtgaggccagatcgatggtgaagagagggttgttggcggcgttcctatcgatttgaggtcggcggcgcttgcatcgggagggacttgagatggcagtgcgacagtgatatgtgattgatgaaacttgaggcaactgcgaggcgaaggtggctatgagaggggagggagacggagcggtggccggcggcaaagactgaaggcctgcgaggtggcggtggctatgcagatcggcgagggcggaagaggcgatgcgcaacggaggtgaaggggaaagagcgcaaagaaggtgggggaggggtcgaggtgcgagtggcggagggggaggcgatccgtaaccgaggggatacgcgacgtaatctggaccgtttgatcctgtgatccaacaaccctgtgggttggggtgggggagcgggcggaggaggaggagagcgaagggatcgatctggccgttggatctggtgattgtacggatagaatggtgcgtgtccgtcagggttggagtcactgtcaccactacggaattttaaagtagtagagatataggtgatatccatcggaaatcagatatccgtcagatattatcgggtattttccatcggatatccgacttacacataaggcccataatacagcccaacccaaagaagaggcaaatcaaacttcttggcaaaaatgaatttcgatttgaattttatgatactaaatgaactcatatgaaaaagttgtcaaaaacaaagttgtagaactcatttctccatccgagtttgattgaactatataaaatttgaattttaaaatataagaaattcaaataatatttttgggtagtaactgatttcaaatggaaaaattgtcaaaaacaaagttgtattcttatcaagatctataacttttattttgatcatttttctatatgactttgtttgaacagtttgaatttaaatttaaaagtatgacaacttcaaacaatattttcaaatactaaatcatttcaactgaaaaagtcatcaacttcaagttgtataactcaacaagatctataacttttattttgatcatttcttcatccggtaaagtgatagtaatattgttcataaaatttgcatatctctcatttgcatatctctcatttggttttataaaatataagagagagatgtaaattttatgaacaatgttactatcactttgtcggattaagaaatgatcaaaat

SEQ ID NO: 1106 - DNA, 1501 bp, Oryza sativa
ggagcggaacgaattaattttcctaacctacccttccagcgactcctctcccagcccttcgcctcctcccaatccgctgcacccgccgcttctcctcctcgtccaccggcgctccactccggcagcctcgcctcgccgtcaaccccgccgcctcttctcccgtcaacggcgccgcctcgtcccggtaggccgtgccgcctcgtcctggtcggccacgccgcctcgtctcccgtcgatcgcgccgcctcgccaaccagcaagggcgagggggaggaggaggaggaggtggtgggggagtagatccggcgggcggcgaggtggagggccggcggttcttgttggtcgcgcaagcggccaccagttcttggcggcgggaggtgtcccggctaccgcggcggcgtccgccatcaccgcccgcgccgccgctcctcctcccggtccgccgtgcctactcgcctctcacgccgcggggaggagggagcaagaaggcgtcgccacccactgcacgcggtggcggtgaggtggaggaggagtaggaggtgggggagtagatccggcggtcggccaccaccaccagcctcaccgctgcccaccgccaatcctgaccctgccggcgccgccgcggtcagctctgtcaagaaatcaagaagcgaatcattgttcttaatatctttgcatgttctgttctccagttcttgatgagaaaaatcaagaactgctctcctgtttttatctttgcttgttatgttcttatattcagttcttgtgatgtttgttcctgtggtgttttaagacccagagggatcctactcctatctatacttgcttgtcatgctcttatcttcggttcttcgattttcttgccttttcttgactcgatggtgggaggaaaaatggatgtggtgggaggggaaatcgctgggcgggatggggtttttcgtgggcgaatcgggaatttcttcactggatgcggcgcgaggtcacggtgtggcgaagaaccgaagcccacagcgcaggctcctttcgtttttttggccgcgcgtagactcgagcaaacaaggttctacgtcgctcagtatggatggacgtgaggagcctaacttggtcacgggcgctcgttccatgtcgaacaaaatcctccatggcgccccatagcaccggtccagggtggagcacccttaaaggcctaaggaagctttggaatcctctcctcttatggagaatgtatcattggttgatgtactatgctacgaagcactgatacggctaacagtcagcgtatccgtatcggatactccatcggatacgctccgatacatatcccatacgtatcctcaatttttctgattttcaaataaataaagataattcggatacttcttggatacggctctgcgcatcctggatagtcccaagtcccaaccctaacaaatacttcctccgtttcacaatgtaagactttctagcattaccgacattcatatagatgttaatgaatcta

SEQ ID NO: 1107 - DNA, 1501 bp, Oryza sativa
tcttagccatccattttttattttccatatgaattgaactttttgcattggtgttcatcatgggctctgaagatttctgccgtgtttttagcattataaaagtgaaatggacatgatcggaatactgcagccttatctttctttttgttctgtgatgaagtctgcagctacaacgatgtaatatcagaatatatagatcttcagatattagtgtatctttatatgattgacccctgacaaagatggcacctgaatgcatggcgtgcttttctccctgtttcaaacagatttttgcgttctaaaaaaaagatttttgcatcaattattgaggcaaattgtttactcgattagcacgataaaatataagtaaactttacatctggcttacaataagtggtaaattaataatgcagtagatgatattgatttttagaaatcgtatttttaaaagcgtggagcaagtaatctatggcaaaaatctgaaaatgataaaagctaaaaggaagagggcaatatatacgatgtctgaactctgaagggttcattattagaaggatcatgttcatggtcctggagtcctggactcttgtactaccagtgatgaatagaaaggttgacaatgatctcctgtatttcctctgttgtcaacactctattgtattattagactcttgattggcataaacggcgatatttcaaggttagctgcaatgcgttcatactataaatagtggcttgctattggcattcattacgcgtgtgcaacactcaaattattggtcttgtattcatgcagacaataatctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatac

SEQ ID NO: 1108 - DNA, 1501 bp, Oryza sativa
ctagatacatatatatgcctagattcattaacatctatatgaatgtcggtaatgctagaaagtcttacattgtgaaacggaggaagtatttgttagggttgggacttgggactatccaggatgcgcagagccgtatccaagaagtatccgaattatctttatttatttgaaaatcagaaaaattgaggatacgtatgggatatgtatcggagcgtatccgatggagtatccgatacggatacgctgactgttagccgtatcagtgcttcgtagcatagtacatcaaccaatgatacattctccataagaggagaggattccaaagcttccttaggcctttaagggtgctccaccctggaccggtgctatggggcgccatggaggattttgttcgacatggaacgagcgcccgtgaccaagttaggctcctcacgtccatccatactgagcgacgtagaaccttgtttgctcgagtctacgcgcggccaaaaaaacgaaaggagcctgcgctgtgggcttcggttcttcgccacaccgtgacctcgcgccgcatccagtgaagaaattcccgattcgcccacgaaaaaccccatcccgcccagcgatttcccctcccaccacatccatttttcctcccaccatcgagtcaagaaaaggcaagaaaatcgaagaaccgaagataagagcatgacaagcaagtatagataggagtaggatccctctgggtcttaaaacaccacaggaacaaacatcacaagaactgaatataagaacataacaagcaaagataaaaacaggagagcagttcttgatttttctcatcaagaactggagaacagaacatgcaaagatattaagaacaatgattcgcttcttgatttcttgacagagctgaccgcggcggcgccggcagggtcaggattggcggtgggcagcggtgaggctggtggtggtggccgaccgccggatctactcccccacctcctactcctcctccacctcaccgccaccgcgtgcagtgggtggcgacgccttcttgctccctcctccccgcggcgtgagaggcgagtaggcacggcggaccgggaggaggagcggcggcgcgggcggtgatggcggacgccgccgcggtagccgggacacctcccgccgccaagaactggtggccgcttgcgcgaccaacaagaaccgccggccctccacctcgccgcccgccggatctactcccccaccacctcctcctcctcctccccctcgcccttgctggttggcgaggcggcgcgatcgacgggagacgaggcggcgtggccgaccaggacgaggcggcacggcctaccgggacgaggcggcgccgttgacgggagaagaggcggcggggttgacggcgaggcgaggctgccggagtggagcgccggtggacgaggaggagaagcggcgggtgcagcggattgggaggaggcgaagggctgggagaggagtcgctggaagggtaggttaggaa

SEQ ID NO: 1109 - DNA, 1501 bp, Oryza sativa
  unsure (1)..(1501): unsure at all n locations
ggaggcttgaagcttaatttaaatttaaatgataatataaccacgcggcaggtttaagaaatataataggaagaaaggtggctccttcattgtagcttaggtataagggcctcaataaataagaaaggtggagtataatacattccggagattgaattgaccttaaggtgttccccaattttatggctagggagtgaattgaggttgatcttaattttataaaagaaggggcgggccattgtcggccttccgttggcaaatttccttattactccgtgggactataagttccataagtggaatggtggtataacggaanaaaaaaagggatgccaaantttaagccnttcttatcaacgacaggttcttaatttggtttttcatcagttattggtgaagcagtggaaagcatcaatataggtgttaaatcaaacaacaattgttgctaattattctaaaaatacggtattttcagaatgacctcatttatatataaaaaactattatgcaatattgctatgacgcatatatgccattagaaattccatttgttcagtataaaatggacacttaattacaaacatgggagtaaccttgctgactcttcaattttcacactttgagtataaacacaatatttccatgcttacaaatcatttgatagaaaattaatagaaaaaaatattaccctcacaaattgcttgtctatattctatgatcttcggttagcaccatgaagggcaatgccataataatttattagtgaatagttcaactcttagaaagacaagatccaagcgctcagcttttggtgactatggataaacccagcatgacttcaccttttgaaacctcttcagtaatatgaaataagacattagtttcatgagcattacattggaaagataaattaaaccctatgccttagtattcactttaggcaaatttgcacaaaaatgaagccttgaaagaaccctgcttccaagttaatcaatgtgagtgatatgtacatgaggatagcatcgatgtaacttttcagagctggaaataatttagtgagcaaaatttacccaatggaaaaagtcagttttactcccctcaagtatgaccctggagcaaataaccccctaacctttaatttggtttacttaaccccctagattcttaaaaccggatcactattcacctttctaatctaatacaaaccgctttgctgatgtggcacatggattaggtggttttgcttactaggttggatctaacgtggagaaagagaacctgggagattaatcacacgtcgtattctcctccatgcgttggactcttctccctcacaagtcctctcatcatctcctctctcccttccgacggcggagaatccaggtgatgatcgtctcagataggcggtgctgatccgtgagatcgcagccccgtggtgtgtccctccccctccctcccttcctccctccctcctccccactcgatcttggcatgctttagg

SEQ ID NO: 1110 - DNA, 1501 bp, Oryza sativa
gcgcggaaggattgcacgtcaatatattagaagataaacaaacataaatcatgcaggaaggacaataaattatttgtagtgtcgtagtcgtcatatttatagcaatttaaaaaatcttcgcccgatcaaaactgatgttgccaaccaatatgcctcccacctaattattgacttagagattgttcctctcttatcgaaaacataactgtatggagctttcaaaatttaagcgaagcaagtagcaatacggattggatagccatgcctctgaacaaatagaacatgtccataggccgatttcagtagtcagatagcaggagctttggtagaagaacatacagccttggagcaagggttgccttaggaattagtaaaatctaccacaaattggaagcagcattgcagcaagaatgttaacagtaaatttttctccgaatcgggaagcgaatccaaacaagctgcaaaaacgcccacaagaaaggggaatttgccaaaagcttcaattttcccccaaaggcagttcctttcctttctactagtctctaatctctaccgccgcccccgcccctagaccctaacacacccaactccatcaccgcgagctcacctggtgccggtagttcccgtagccggaggagccggcgacgagcaccgcccacctcgtccccccgtaatccgccgccgcaggagcaggagcgggagcagcagcctcagcgtcgtccccttcctccgtcggcatccgaatcagcggctcccacttcccctccttcctcctccccatccgccgccgccgccacagccaggagcgcgacgacgaagccccatacccagcaccgcgcagccatcgtcgtccgcgaccacagcacaagcacagtacaaaggtcaagcagccaaactactccgagtagttggtgagacgcggccttaagtacactcccgagttagcgtgccacgaggacacgtgacccgcggcacgtcgtctcgccatcgcggcagctttcgctcgcgcgctcctcgcaagtgtggtcgcgtggatcacgcgggggcattgcgtggaacaaacttgtggtttcttccatttattgtacttcgtgatttggaaatcccatggcttgtggccgcagaacgtgtacagtcccggcacggtgaacgggaggggtttgggttttcgcgagatttcggttgcaaaatgcaaaacaccgcgcggagatcgcattgttccgtgccttgatgaaggagaaagaaagatcagaaacaagggaaaccgaagctgaaaagtctgaaactctgctgtgtttgggaaaaaggagcggagctccagaaccgtggcaggtggacttcgtgcttttgcgtgagatgatatttcgtgatggaggaatgatcacgatcaactcgcgtgttacatgagacgattaggagtaggtgccttgctgctgctgctgctgtttaccggtggaacgtcaaaagttgagacctttctactttagaggcccaaatgaaa

SEQ ID NO: 1111 - DNA, 1501 bp, Oryza sativa
gcttgagtcgttgtgcgtcaggaaggtgtgtgaattgggaaaaatcacaaaatcgtttctttcccttcgtcagctactacaccgactcacaaaatcagtgcaagctatgtttccttttaggaatattaagtaagaggattatggttttaagaatgctatagtatgtgatgtttatggttaatttgttgtattcttgtagctctttttcttaactattcctatagctcgatactaggaatgtatcaaattagagagatcacaaattatgactagaatgtatgctacacccctcaagtactgtaaaatatttctcaatactaagacaatctagtgtatattttgtactttccttgtttacaaaataaaattaacttcctactttgagaattgatggaaaccttttttaagatttgtattgttcagggctgatgataatgggcggtgatattttcagtgaaatctcgttatttgtacttccgaattcttaataccatggcaaattggttctgcaaaatcactagaaatattgatcttaagttctttacattggttatatgccattcactattgcctacactcacttatatggctattgatccaaatgatttaaagagaaggtcgaaaaacattataacgacaatatcaccattaattatctcaactctgtaagtgattcatttaaaatctacaaatgattgatcaagtttaatcctgtcaactgttgaatctgtgattattgagaggatgtgctacttacctaatccaaatataacggagacgaagaactccaattaaatactgtcttccacgggaagaaaatatccactgtgttacctatttgttggctttccatataatgattaggtacttgtttataaatacccaaaatctaaaccgagaaacctcttggtttagtcttacggcacggcacaactgaagccattactttactgaaaacatactactagtccatcaaacaaataggaaccacctatgtttcaaataaaattttctcttaaactactcatccgatctacgatccgattacaccgttatgttcgtaacaattaaatctttataacaagatctcacatgattatattttgattaaaaattaaaaattactttcataatatatctaaattacttttagatttcactaaattacttcttagacatataaaaataaattcaataaagtctaaaagtaatttgcatatattataaaagtaacttaaaacaaaaagaaagtaattttgtcacgacattagaagtaaattcgttgtacggataaaaatatgactctatctagaaattaaatttaatcagcacatatcagtacaagtaagtttaacaatttttaaaagttacttcaatgttaattggaagtaacttttgaatagttcagaagtaactttctataaatctgttttaagcactgattgttttttttcctttcaattttgtttttcatgtagtatgagaaaagaagataaaactg

SEQ ID NO: 1112 - DNA, 1501 bp, Oryza sativa
tcttcccgtggaagacagtatttaattggagttcttcgtctccgttatatttggattaggtaagtagcacatcctctcaataatcacagattcaacagttgacaggattaaacttgatcaatcatttgtagattttaaatgaatcacttacagagttgagataattaatggtgatattgtcgttataatgtttttcgaccttctctttaaatcatttggatcaatagccatataagtgagtgtaggcaatagtgaatggcatataaccaatgtaaagaacttaagatcaatatttctagtgattttgcagaaccaatttgccatggtattaagaattcggaagtacaaataacgagatttcactgaaaatatcaccgcccattatcatcagccctgaacaatacaaatcttaaaaaaggtttccatcaattctcaaagtaggaagttaattttattttgtaaacaaggaaagtacaaaatatacactagattgtcttagtattgagaaatattttacagtacttgaggggtgtagcatacattctagtcataatttgtgatctctctaatttgatacattcctagtatcgagctataggaatagttaagaaaaagagctacaagaatacaacaaattaaccataaacatcacatactatagcattcttaaaaccataatcctcttacttaatattcctaaaaggaaacatagcttgcactgattttgtgagtcggtgtagtagctgacgaagggaaagaaacgattttgtgatttttcccaattcacacaccttcctgacgcacaacgactcaagctcaacaatgaagacgccatcttcttccgtgccaaccaagatggcgctgggaccttcggcaactacagccaaacacgccgctccttgccctcactacgccagatcctcacacctctgacgggatacctgtgacgggcaaacgaattggtcagtagtgaccattacctttgacgggttatacgggatgccgtcaccggtgaggcatctgcccgcggcccgtcacaggtatcccctcacctgtgacgggccgaaaggaaaacccgtcagaggtataccagtgacgagtttttcttccaacccgtcactggtatcccctcacctgtgacgggccgataaattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 1113 - DNA, 1501 bp, Oryza sativa
tcagtttacgttaattacttagatacaagttcaggcgttcagccacgtacatttgagtaaaatagcaaattacatgtttaattaactagttccaataatggttgtcagatcagtggatcagcacataaactagcaaaatgactagctatatatacatataatgtcaagtattcaacattaaccattaacgagtttcatttcatcaatataatttcgtgcattggttgtcttcttcataaattagaactcgatctatgctaaatcgggcacgtggttgtatggatttaattgtagttcttctctattattaggtttgcctaggctcaatatccgccactgaatctggatagaacctatgtcgagatttatggttacagaatgtgttaaatcggttcagtttagttacattattttatgataaattaaattctatcctatattgcaatattttggaacggaggcagtagcaaattttatttaatttccaaggattgatattgttgcaaattttgtttaatttgcaaggattcatattgtgtgcatataattacataaaagcagcaaacattcgtaactacgaactgagaactaatgatctctaacctcttttcaaaatgatgactattcactaatggttcatactatatagttcccaacacaatcacaatccgatggacttcgaaccgttacacattataaaaactcaaatgatttattagaaacctttaaggttatatctgtgacggtcattatagcagtgaagcataagttaagtaattatatatgtatctgcgctatgcaagttgagccaactgctcatcagtcttgttttcattgttcgacttacgaaacttcttgttttcattgttcgacttacgaaactttcttcggtggtttgagctcatgatcacgcttaatctctaacgcacaaaaataaaaggtatacctataaaaaggtatgaaaaaattgggccaggtacgaaaagtggttggttaaaatggtaattagataccgtggttaattttgcggaagacaaaagcgtatcttcctcctatgatcccatccagcctgcaatgcgaagtcccgatagagtgtgttggaggcatttctatgttcatacggtggttaattaaatgcttagcgattaactacggattcctcaaactaagcgcatcaatttctcaagtggttgtagtgacctgagtaacatcctaaagtcctgagttacagtgacctgagcagcctagtggttgcagtgacctgagtagcatcccaggatcctaagttcaaatcttcataggagcgaagttcccaatttaaaaaatattgcatatatccagttggatatagaagccgggcttctctagaaaaaagagagataaaagcacataaaaaacaacagtaaaattgcaacaagtttgtactatcaatatgaatttttgatattggtgttgcagcagaattttttttttgaaaatacactgttcatcttttctctca

SEQ ID NO: 1114 - DNA, 1501 bp, Oryza sativa
gtaaactgtagtgttataaaaacggtaataagttcattttaggtccctcaatttgtcgtctagtccgaaattcgtccctaaaccgcgataccagatatggcacgtccgttaattctcaaaaccagtgcaaataaggtcccaaggtggtttatacaatggttttggctgatatggcacttacgtggcattgataaaatcagaaaaaacaatgggaaccacatgtcatcaattgttcagttaaaaataaaaaaatacagtgggaccaatgttatctcctctctttcacctcttctctccctcctctctctccctctttgtgttcagaggagagtggcatggcgagtggaaacattgttgagttgtgatccaaattcatttgcacttaataaaggccagcttctgccgtagctcagaggcacagctgatgcttgcttgaagtttggcaggactgataaggggcttgttggatatgtggattcagattttgctgcagatttagataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtccacaaggtaagctaaaggtatgcaagataagtactcatgataatcctgctgatatgatgacgaaacatgttcctgttgctaagtttgagctttgctcaagcttagttagtatagtgatttagcccgagaggctattttggcgccgaaagtgtttttttgtctttgttgtgttcagggtgaaggattgattcatgctacaagaaggaatttgtctcgaggtggagtttgttgagttgtgatccaaattcatttgcacttaataaatgccagcttaggccagcacctggggacgcctgggggatgcgggggcggagcccccgcggtatggatcgtcatcctttttagggttccaccatatatatacctattgtaagccgccatgcggtgatgtaacctcacctcagatatagtgaagatattttgctggctggcgcccgtggtttttttctctcctattttgggaggggtttccacgttaaatctcttgtcttctgtgaatgatatattgttcttttatcgtttgttcgcctatcgtttcctaacaagcatgagctcattgcggcagtgttctagtaggattctggccgccgctcgtgctcgcgccagcgccagaaccctaagacgtcgctggagccccggcgcactttattcacggcgcagagtgatgccaccatcgacgacctaggctgggccacctcacccc

SEQ ID NO: 1115 - DNA, 1501 bp, Oryza sativa
aaatgcagcacaacgtgcagtatgagcaaatagtagatacactgtctgttacaccgaaaagacatataaaaatggtatggagtatatctgccagtaattaagtacctatcaagttgacattcttgtggacaaacagacaccttaattagtgcagagaatgtcgacaagccgtgtttccttcaatgaaagacttgcattaagtccatttaatcatgcatgtatatatgtagtaacatttgcatagactagaatatccattttatttccatccaagactttatttgatgttctgctgggacatagaaattaaaataagagtaaatttcacaaaactatagataatttggatcaaattatcataaaactacaggtttaagaatgtgtatcacaaaactacagatttagcgtcaaacttttcacggaactacagatttaatgcaccatatcacaaaactacagatttagtgatgaagttatcaaagaattacatattttagagtttagatcatagcactattatttatttaaagttataaaatctgtagttttgtgataaaatagtttttaaatatgtagtttgtgataaaatagttgttaaatcaatagttttgtgatataataccttaaatctgtagttccgtgataaatttgactctaaatctgtagttttgtgaaatacattcttaaatctgtagttttgtaatagtttgatcaaagtatctgtagttttgttaaatttactcttaaaataaattgtcttgtgttttttttaatacaggattcaattcgtttccctactaattcaacttgtgaactgatcatcatgagtccaaaattaaattgaggagctagggacatttccaggcctacaaaataaaattaaccatgcttttttagataattgggggtcgggttaattagtactatgttctattcattctgttaatcttaactgccggtagctagctaaaagttctcaaagtcatcaacttaattagctaggatattggtgtccaaagctagccagatttgataacattttctgttgcagttgtaactagtgttcatacctccatagagtcaaatgctaactaaccaacattgcatatatccggccagataactcttgtctaatcccataggaacaagataattatcaagtaccctcttgtgtgtggcaatgtcaacccagctatatacctagctagcttaattaattaattagctcattcagctataccaataatttgttgcagctagcttaattaattacctcctaatcattgatccatccatcatcacccatgcatggttaacactgcattccagtcgatgtcatgctataaatacctgcagagatgagcaggacatgcacacacaccacagtcgcaatcagacattctctcttgttggttaactaaatagcttaattaatttgaggagtttagtctctgaaacatggcgatggcgacagcagcatgcagaaggcctgcagtgatgc

SEQ ID NO: 1116 - DNA, 1501 bp, Oryza sativa
aaacttcaaatataaggcacagtactgctagccagcagtccacacgtctgtccctcttctaaattagtattattgatagtactacaatatataagatgccttaattaactatgttcctaattaagttggattcaacactcccaaatccagaagttgatcttcatccgtcaaaaacatgactttttgttttatcatttaggttaatgagaaagaaaaaaactgaagattggattaaggaacctgtgctgattcctcaaatgctatatatagaattagttgtaaaaatttctgacaattgtttgcaaacaattttttttagaaacatggtacaaacatattcgttcataatgcgtgcacacttaactctataaacatacacacacgctcatcacctttatgaatacacacgcacaactctacctctatgagcacctccagaagatagggccaatatatcttaagattaatgaagtcaccacaggccctttattgtcgacaggtacgtagtataccactgaaagaataattagccgtaaatgcgaatattcgtgtcaaatctggaacttgaaccctggttccaccacaagatatcaaaccagttgagctacgctcacttcgcaaacaatttaatatttaaacacatgagcttagctaacacagattctgccatgaataattatatacaagccttttgttcatcaatgtcttcttttttccctttaatgtgtatatatatccagttgagacttcaattttttgaattttgagacttcaaagtgatagagattatcatactgggctgttaccacattatatttgaattttttttaactacttgattgacatttggggagtaaaggcacatgcccttatgggttcgatcgaacagaagagacttttccaagaaaaaaacagagatacatgtatgtatactaaaaaaacatttcaaaggccagtattatatccaaagcagaatgtaccatcgattgtgtgttggattaataaagtaactgtggagattatggataccccatatctatacggcggttatatttagactggatataggataccgaatatagatagaatatctttatttgtatctcgggtttgtttcttaacttgtacgtcaaggaaatatcctgagatttagtcggttacgattgtattttatttgtattctcgtattctgataaggatatgagttataccttgtaatacagactccttcccctatataaggaggggtccgagtccttcctgggacaccaattctctttgagatcatacattcaataatacactcggcggtttccaccccggacaggagtagggtattacttcttgaataagaaggcctgaacctgtataaatcatttgtctccaaacccatccacttttcaagcttgatagccacccctttttagtattgccgaaatcttgtttcgacagttggcgcgccaggtagggggtgcgtcaagcttttcgccgaccagtgcaa

SEQ ID NO: 1117 - DNA, 1501 bp, Oryza sativa
gatttgtagagcagttctttcaattgtgcttccctcatgtcaagcagagcattcttgtgggctaactcatcattcttctctttctccaaacggtctttcagggcaaaagccttaaacatgtcagcttgaataattgcttcacgtttcactccacggtccaccatatcccacatgccagctagtgtcttcttcaccctcgagtcccattcaggatccacccattgaacgaacttgcattggtcctcgtcttcctgaataagcccaacaaaatcaggtcaaaattgtgggggaaaattaaaaaaaaaacaaaatcaaagaaaacaaaaaaacaaacctctaatggacagcccaagaacctcctgcctgtgtcttctccttcccaagccaccctccgtgctagacacaatccatgcttgcagcgcaatcgagttcctttctcctcaccatgccattctgtttcttccaaatataagggcactgcatccagacttacctcctacgaccccaaagatttcattcgatcccaactcaccaaatcaaacccaatttcgaaaaatcaaaatcaaaaccaatcgcacactcaaatccactagtatatacattgcataccttgcccaatgcacagctcacgctaccctgttgctgggatggtgcacctatgcttcgcttcttgctcgcgctattcgccgatgccatctctatggctagggtttcttcaggccaaagaggaacgatgcggtgaccaggcgaagacgcgagacgacgatgcacgcgtggaaagtgaggaattggccaccgaatgggtccacgtagaggtggccaaatgggccgggccaaacgggccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccggctactgtagcgggccggcacggcacggcccgcggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaattccgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 1118 - DNA, 1501 bp, Oryza sativa
ttggtatagctcctacttcaacatttttgtctcgtaaagttggagctgtacctaacacttccaagctagtgtgagaatatagagtaaagctaccacacagctcttaaaaaagttgtaccaaactaatgctagttaaaactactgaaagaataattagcaaccatcaagttgtaaatacgagcgccggtactaagtctagtacatgaatccggatggataggttctaccacgtggaatctaaccagttgagctagctatactcactgatgcatagtggtttagtaatttataagcatgtaataattaaacatgaaattaattaagtcatatgtgcatacttgcatatgtgcagcaacgtagttggagagatagtgagatacagaggatatctgcacatgcgacgctatgaaataaacgcaactgcgcaacacaatgcacatgcgacgctacgaaatatataatgacgcgttcaatacatatactcagtacgtgctactcatgcctagcgtcgtattgccatcataggacggaccaggacgacccaatttttcaaatcaaataatttatgggcttaaacaaacaaagtacttctgaaatagggctcaatcggaaaacaaaaatggatcgagttgagtcttcctggtccctatacaaatgtatatgttacacgatgccgtccaactaccaaacatcacaaattcacaaaacattggcatatgcttagtttagcagtgatgacctccaatatcacacttgttttcttgttgatgatgtgcttggcagcggcagtagcagcagcagcaacccctggagtcgccggaggtaatgggctcttgcatacaatcccttccaaaaactctctggctcactgcccttctacctgcggcgacattggcttctcctacccatttgggatcggccatggctgcttccggcaaggtttcgagctcatctgcgacaacaccactcatcctcccacactgctcctggcaaacactacaactaaggtcatcggccaatcaggccggacactagaggtgatagaaatcccagccattgccttcaacatcgcgatgaacaacagcagcatcatcgactacatccgatactgggtttctcctgccaatggtttcaccatcgtgaacgagagcaccctgttcgttatcggatgtgggatcgaggcgtgcctgttcgatcttgacacgaacgagaccatgggttcttgcatcaccatgtgttctgacaatttggggatcatggagatgcacgatggggattgtaccggcatcggttgctgccatatcatcgtgagaagggagctgcgtcggttttggttaaagcttgatcatccggatgatagaacaacaccgcgatcatatcgggtgttgtctcgtgctcaggttttcatcctgccaacaattaacagctatcaattcaatacgaatgatcttgtttcgtccagctggatgaacacgagctccattggtggtactcttctccg

SEQ ID NO: 1119 - DNA, 1501 bp, Oryza sativa
tgtgcatgtcctgctcatctctgcaggtatttatagcatgacatcgactggaatgcagtgttaaccatgcatgggtgatgatggatggatcaatgattaggaggtaattaattaagctagctgcaacaaattattggtatagctgaatgagctaattaattaattaagctagctaggtatatagctgggttgacattgccacacacaagagggtacttgataattatcttgttcctatgggattagacaagagttatctggccggatatatgcaatgttggttagttagcatttgactctatggaggtatgaacactagttacaactgcaacagaaaatgttatcaaatctggctagctttggacaccaatatcctagctaattaagttgatgactttgagaacttttagctagctaccggcagttaagattaacagaatgaatagaacatagtactaattaacccgacccccaattatctaaaaaagcatggttaattttattttgtaggcctggaaatgtccctagctcctcaatttaattttggactcatgatgatcagttcacaagttgaattagtagggaaacgaattgaatcctgtattaaaaaaaacacaagacaatttattttaagagtaaatttaacaaaactacagatactttgatcaaactattacaaaactacagatttaagaatgtatttcacaaaactacagatttagagtcaaatttatcacggaactacagatttaaggtattatatcacaaaactattgatttaacaactattttatcacaaactacatatttaaaaactattttatcacaaaactacagattttataactttaaataaataatagtgctatgatctaaactctaaaatatgtaattctttgataacttcatcactaaatctgtagttttgtgatatggtgcattaaatctgtagttccgtgaaaagtttgacgctaaatctgtagttttgtgatacacattcttaaacctgtagttttatgataatttgatccaaattatctatagttttgtgaaatttactcttattttaatttctatgtcccagcagaacatcaaataaagtcttggatggaaataaaatggatattctagtctatgcaaatgttactacatatatacatgcatgattaaatggacttaatgcaagtctttcattgaaggaaacacggcttgtcgacattctctgcactaattaaggtgtctgtttgtccacaagaatgtcaacttgataggtacttaattactggcagatatactccataccatttttatatgtcttttcggtgtaacagacagtgtatctactatttgctcatactgcacgttgtgctgcatttgtgcatacccaactgaaaaattctcgagttagcgaatattgtgtcgacctaactgataacagacaaattaaattaacaaggatgacatatatatgtccatgcatgaatgaaaaggttgttaatta

SEQ ID NO: 1120 - DNA, 1501 bp, Oryza sativa
gatcaacttctggatttgggagtgttgaatccaacttaattaggaacatagttaattaaggcatcttatatattgtagtactatcaataatactaatttagaagagggacagacgtgtggactgctggctagcagtactgtgccttatatttgaagtttgacatgaaataccaaacacgatggaagcacatggcaaatgggacaatcatagtagcttgtatccatgtttcagcggttgggtttgcaattattttgtcccaatattccatgcatatcaaattatcaatgcatgcatgcaacgaccaatgaaggaaatagcagcacttaataataatattaaggatcaatttatacatattattgattcgtagtgaaattattatcaacatgatcatagatataaattcaataattaaacttaacatatagttttaaacaagaaagctaagctaacaattaatacattaaaaatttttagaaaacatatatttaaaaacgtggagcaaataatctgtggtgaagtattacttatttagatacatgagaggtgcggtagtacactcatactaccaaaaagtagtgtcattctccttccatctcctctcaccacgcacgtagcacgtccgtacgttttgtataagtaaccactgatccaatgttttatcctcagttactcttttagtcatccctaattatacggacctaaaataatcaccggatccaatattttatcctcattcaccctcttagtcttctttgattatatgaacctgttacaatattgggtatgtgacatgttactagtataccagaaaatgtgtaaatacaagttaatttaatgggtatatatataagtatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttggcttttttgaagccataagccactctaacactattaagccaaaagctaggttggagaagcttttttggtttatgtgaggtagatgtatgactcaactactaaacttaggacattaaatccaccggcttataaatcatataagccaataagctgacttaaaagtctaggccaataagcctaagcctaaacaaagagggccgtaatctggcccacaaaactggcatatatgactgttcgtggcccaagccatttccatccaaccat

SEQ ID NO: 1121 - DNA, 1501 bp, Oryza sativa
cttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaagggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactctgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggtgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttca

SEQ ID NO: 1122 - DNA, 1425 bp, Oryza sativa
gggggggggggggctcgcgtctctcgcctcccactccgcggcacggcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagt

SEQ ID NO: 1123 - DNA, 1389 bp, Oryza sativa
ttatatatgaaattttaggtgatcaatatttacacaagtttctaagtgaacttgaaaaaaaggcacttcatgaaattttagttcaggttcactaatcaccaataatgtagattagaaaatcaagacgccgtttggcgcgtccactaattagcttgggtgtatggcttttaaaaaccatatagttaatatactaatatttcaatttttcttttatgattttgagcattatggtgtttagatttgacataaaactctaggtataaatccaacaccagaattaatatttgttttattataattgtagcgtaaagatctacatattatttatttatagtataagcagaaaatacatatatttagaaattggttatcaggattatagagtttattgtttatgtcatttagtttttctatttattgcttttagtttctccaaatataggatatgtggtcacgacacgtggaacaactcttctcttgtttttctattcaccgttgtaactgaacgcttgccagttttatagggagggtttattaaccggctctcttttcgacgcttgtatgtcgtcacgtgtcgctcaactaaagaatgttgagggcaacaatcagctggcataaaaccaaccagcatgggattgatagattgcaaaggggaaagatattttgggaagcctttacaatctggatgttatgccttctatttgcttctcggcattccttttattatggatattctctatatttatctttaagagatagataattgagaagtctttaaaaattggatttgtgtcttttattttcttttggctattttctcttatgcatgatttccttagatctatttcaaaatttaacaccgtcatgtgacccaataagatagctcgagacaagccagcttgtggagattatggataccccatatctacatgacggttgtaatttagtcggatatacggtatcaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgcgtgcctcttgggaggtgattctttttcccagtctatacaattaataacacactcggcggaatcatccccggacaggagtagggtattacttctttaataagaaggcctgaacctgtataaaatttcttgtctccaaacccatccattttcctagcttgacagccacccccttttattattgccgaaatcttgcttcgacagttggcgcgccaggtaggggtagcgtcaagttctcgccgactaagtgcga

SEQ ID NO: 1124 - DNA, 1501 bp, Oryza sativa
cgtagggattaaaacggtcggaaacgatatgaaagatctgaaaacacctcaaccatttccataatcatttttttctcagaaatgatatcgaaaacggtaaagtcggaaatgaaaacgatattggaaatatcggaaaaccgaaaacggaataatacggacggaaacatgtcggtacaaatcggaaaccggtaacaaatatgaaaacattaaactatagaaaactttacataagtatgatatatgtacaaataaattcaagctatactatataaatcataaattaactccattttagccatgcactcaagttaggaatttgattgaagagtcattcaacctctaaactatgggtcaagtagagacatgccctataaatatcgacatatttagaactacggtaattatcatattataagaaacggtaatttccacaagaatacggtaaatacggaaacgatcggtaaaacaataaaaccatttccgtttccatttccatatattttaccattttcatatttttttcggtcgattaccattttcatatggctcggccggtagaaagtcagaaacaaacgccggtcagccgggaattaccgttaccgttctcaccccgttcgcccagtgttcccagctcatcaactgtgaatccatctagttatgacttgggctaaaggaaactctaatatttgactgctcgagacatgatgcactcgatctcaggcaatgaaacctcatcgttacacgagtatataatctacagcaccattctatcgcttattcttacaagccgaagtttaaattttaaaacttaactttcgagttaattttgtgaatttttcatcatggtttactttttaaaattgctaaggacagatatatagaagttttatacataaattattcttttattaataaatctcacggataagtataaatgtaagtgaaacaaggggcgttaaaatacgtagtacgagtgagaaagctgaaaataggaaatatcttgcatttgagtaggaagttgctttcacatccgcctttacattcttgcagtgatggagtaggaaataatgttaaggtctttgagctataaaagctgggcttgaaatgacaactacaatcagtggcgaagctatatagtgtttgggggggggatgcacatgaacccctaaattcctaatttctcacttaaaaaaattagaatatacagtgttgtactgaaattttgtagattctcaatgatagtgcaccccccttgttttgatgctagcttcacccctgactacaattttaacgggacataccacggcattttaacattataaaatcttagctactatatatgagcttcaactcttaaatttaatttcataagttggatttggagcgaaagcggcctaaacccaactctccacctatctaataattcattttatgagagcactccaactaatttcacttccttttgatagagctggaaccgtttagttactatagatggcca

SEQ ID NO: 1125 - DNA, 1501 bp, Oryza sativa
acggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 1126 - DNA, 1501 bp, Oryza sativa
ttaactgcgactaaaaatttttttagccctggtttttttaagcaaccgagactattatggtttttggacaacccattaaagatggtttctccagtagtgattattcatttttgtttgatgcaaatcaacactaaaggaaaattccatatcataatcatcataacacaaccattaatgtgtgtctactaaaccaaaacaccggatacaagtctagctgactcaacaggtgccaggctttttccaaattgacgaaagcttcaaatataatatgaccaaataatagaattttcacagtagttgagggatttattattctagctcggattttcttcaaataaaatataaccaaaaaaaaatgatgccacatcataaatagtgaaccgtgggtcggacctaggtataaaacttgagtttctttttgtgagtcgagggacaaataacatatagttttgtaattggatcactaagtggactaacgacgccatagtctatagttccatttttcatgtttttaggtgtgtttttaggaaaggtgccgtgaggacccagctttcataataagccacttctttcttatgtgtttcaattctcttgaaataagattgatagaaccgtaactctagaaggtgagctccgtccgcatcgctcccacctcaggggcgactaggatgcgaaacaaccaccaccgcctttgcctcaccaccgtccgagtcgccatcggaaaattcagatggtgaggtagaggaggaggcgacagtgctagggaagcgaccaatgatggatagtgggaggcaggtcgtgccttgggaggaaccaccaaatcttgtgctcatttggccagttctggcaccccggcgactggatctggcctcttatgtaatttatacaagtgggtattcatttaaattggttataaaagtatagaggtatcttgatatacagtagtatcgctatcgctactatttacataaaacaataaaaatgataatatagtttcgaccatttaatttcatccctaggagagaaacacctagagtcgtgatgcacgggattggaagaaacgatcaaatgtacacagatagatgcacaattgcgtgacagtccattgtattcacacgtggtccactgtattcacacgtggaccactgtattcacactttttgatcgataagcagcactagcaaccaaattggatgccgcatggcgccacgttagttgtgagatgcatgcatgcatgggattgaaaacgatcaaattaatatgtacagtactgatacatgcagcatgtactctttccgagtgattaattcacacattaatttgtctcatcgatcagcagctctagccacatgttttctattaagaatccatgcatatatccatctataaatatacctcatgcatgccagcttcttctactactcgcagcgcatcactcacagctacatccacaagtactaaaccaatctctgccagcagtagctctcagctatggctgatc

SEQ ID NO: 1127 - DNA, 1501 bp, Oryza sativa
actcgaccctggttcccagctcgtcccaagctaacccaggccaactatttccacatttcagtggttaaccaggttttaaaaataaaaacactaacttgggtacattgctcggcttgcctataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctatcagcaggacaccggccctatgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccagtccttatatggccgaggtgctactatcaaaaccatgcaccccgagcccaacctaaaaccattttgaggattttgaatagagggggaggtgtgaatccaattccacaataatccaaccattccatagtgtccaggtgatatgaatatcccaaagtctagagttgtaaaaccacctaatgttacctaattaagcggcgaagcatctacctaaattcatactagtggtaccacgagtagagtgtccactagttggggttttgtttattctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatatgctcaaggatgatgtgacttgccttgctcactttcccaaacgtcggcttcaacctccacgaagagcggatcttccgaagctgcagcgtctacacgaccaacggaaaagaaaaggcttttactctaacaaactccacataacaagtaggaacaaagcacaaaaatgggttcttgacttcttaaggaaaaattagagacttgaacggtccaattccgagttcaaatggccaagttatggccatttgaagtttatatgctatttaaatgaatatttgcgaatttcttcatttaaattttaatttaaaaaggggtttattgcatcagccgagggggaggggcgcgcggaccgggtccacgggagtggggcccacgtggcagcctcacggtccacggtggaccgggtgcacccgggctcacaccggccggcgccgtgggccccacgcgtcagccgcacccgagggcgcgggcggctgacggccgggccccacgcggcagccactcggcgcgcacgagggcggcca

SEQ ID NO: 1128 - DNA, 1501 bp, Oryza sativa
ctcccttggattcgtttggaaatcctcccctaatcccgccgacgccattgatggaacccgagaacgccgcgctggtttccttcccctccggccgctctctcccccttccaaccctatttaaaccctccccgcacctcctccgtccgtttccgcctctcaccgcccttcctcctcgccggaatcgagctcgcgccgtcgctctctctctcctccgttgctgacgacctccggccggctttctccgctcgccgggaccgtctcccgcctcagcgctgcctccttcggcttcgccgcatcctcgccgacttcgtccacctctccgtttcggtcgccgaccaccggagctccgccgtccccgacaacccgagccgcgccaccgcctccctctgctccggccgcctcctccgtcgccgccgtcgccccggggtgagccgtggaccgtcgcctcctttcccccttccctcccctctctcggccgccgctccgccgcgtctatggccgccgccggcgaccatcggggcgcgggcgcgccgcctcccgccgaccgcgccggcgtggccgccctcgtgcgcgccgagtggctgccgcgtggggcccggccgtcagccgcccgcgccctcgggtgcggctgacgcgtggggcccacggcgccggccggtgtgagcccgggtgcacccggtccaccgtggaccgtgaggctgccacgtgggccccactcccgtggacccggtccgcgcgcccctccccctcggctgatgcaataaacccctttttaaattaaaatttaaatgaagaaattcgcaaatattcatttaaatagcatataaacttcaaatggccataacttggccatttgaactcggaattggaccgttcaagtctctaatttttccttaagaagtcaagaacccatttttgtgctttgttcctacttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcgtggtaccactagtatgaatttaggtagatgcttcgccgcttaattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggactggt

SEQ ID NO: 1129 - DNA, 1501 bp, Oryza sativa
caccacgaaaacggcactgatgagaagactccaagatgccggtttaggaaccaacacctttgatgtatacgatttgtaaagaaaagagtaaatttcactttgggcctgatttattggccaaagtttcaccataccaggtataactctaccttttcagttaacaccaggtatgattaccttcttttgcagtttggactgggtttcaatacttttgggccaccatgttggcttgagcctggtgaactcagttcagcgcagagagttatcaagggagactagcgcacgggaaaggaggaagatagtgtcgtggaggtgggggtggaggtggacttgctcaacgcctcgatctccaccctcgccaccggcggctcccggccaagtctccggagcagcacggcgtggcggcggcgtgaccttctccggctccgaattggcatggcggcgtgctcttcagcttcggtgtggtgttggtggaatgaatctgtgttgtttctaaatgtgtatgcaagtaagatagagctgtcaattttgccactaaaaacatggaaagaggttccaagttccatatgtacatgtacctgatcatgaggtacttgtgataatttccctttccagtgccttctctttagtggtacttatttacaatacaattagctaataattcctactctaacttggtgaggcttttggaatcctcccattctgccgtgagctgaaggagcagtgcgtgcaccccgttgccggcaccgcggtcgagcagaagaagagcatgccgccgtcctgccgcgccggagccgaagaagagcatgcacggccgctgcgccatgcctcgccagaaccggagatgtgcacacggccaccgcatcgtgccgctccgcaggcgtagaagccaccggtggcgagggtggagaccgaggcgttgagcatgtccgcctccgcctccacgacactatcttccttctctcccatacactagttttcctcgataatttctcttccccgaactgagttcactaggctcagatcaagccagcgtggtggcccaaagtcttaaaacccggtccaaactgcaaaagaaggtaatcatacctagtgttaactgaaaaggtcgagttaggcctggtttcatggtgaaactttggttaataaatcacgcccaaagtgaaatttactcaaaaagaaaaaaccaggagccgagccgatgcttgaaagccaccaaacataaattaaaaatctaaaaaaaggaacaagtacacatcacacaatcaacaagttcatagatcacaataaacaagttcatcaatacatcaagaacacggtctaaaaaaacaacatcaagaacacagatcaagaagtactctacccctgccgccgtcgccagatagaaaggaggatagggggaggggcgagcctccttctccccttccactacagccgccgctgcctctgctttggcgaaggtgtgggtgctaccattgccgtcgtggaaggccgctttttc

SEQ ID NO: 1130 - DNA, 1501 bp, Oryza sativa
aatgcacagttgaaataaatagagaatttgaatataggatcaacatgctcaaaggaattgtgtttgggatctgtgtgacttgccttgcaataatcggtcttcaattaatcttcttgaacacttccggtgcactcgcgaaccttcgcaacgatggaaacgacaagctaacacgcaaaaccaagaaaaagactaataaacaccaaataaacaatacataaaaagtaaacaaacatgtagattataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttataaaatttttgcaacttgaaccacattaaactgagttcaaatgaattagttatgaatttttaaagattaaatcggattaaaacacttatatggattttaattgaattatgacgcaataatgaattatttttgaaaaggaaaaagggatttattgcgtcagcggctagggtttgcggtggactgggcgcacggcagcggttcacgggaacggacggccgagatcaaccctatccaaaacggacggccgagatcaaacggtccacgaccggctcacggggaacggcaacgatgacgtcagcgatgacggcagcgatgacgtcagcaccggcggcagctcgggagcgcaagctcgccggcgaacgacggcgcgacgacgagaacggagggcaccaggacgtagagcgcggtgcggcgaacttaccggtgaccaaaacggcggcagaaaagcaacggacggcgccggcgacgaggaagaagcggcggcggagatcgggtcgacggcggcgacggtgctccggcggtctccggcggtggcgaagcggtggacgaggacggcggcgacttggcgatcacaatggcgatcttcccgagcgacgacgacgaccggaacggcggcggcgcacagctggagcggcgacgacggcggcgctaggtcacacgacgctagggcgcttccgacggcgagagacgaaggcgagggaggtggcgggtagaggagagctcggggatccttataaaggggcaaggaggcggcggcgaaggcccacggcgaccggcggcgagaaggaaaggtcggggttggagggagaaaagtcgatccgaatcgacctcgaatccgtcgatttccaaacgaaattgaccggagtttctataagagaaaaggaagaggagatctcgaagatcatttcccctcaaaagattcggccggagaaggaaagacgcggccgaattggaaagcggcggcgcacggctcggctagggttcgggcggcggcggcggcgcgaggaggaagacggctccgacagatggggcccatctgtcagcggctgagagagagaggaggaaggggcgcggcggactgggccgagggaaagagagag

SEQ ID NO: 1131 - DNA, 1501 bp, Oryza sativa
ctcccttggattcgtttggaaaccctcccctaatcccgccgacgccattgatggaacccgagaacgccgcgccggtttccttcccctccggccgctctctcccccttccaaccctacttaaaccctccccgcacctcctccgtccgtttccgcctctcaccgcccttcctcctcgccggaatcgagctcgcgccgtcgctctctctctcctccgtcgctgacgacctccggccggctttctccgctcgccgggaccgtctcccgcctcagcgctgcctccttcggcttcgccgcatcctcgccgacctcgtccacctctccgtttcggtcgccgaccaccggagctccgccgtccccgacaacccgagccgcgccaccgcctccctctgctccggccgcctcctccgtcgccgccgtcgccccggggtgagccatggaccgtcgcctcctttcccccttccctcccctctctcggccgccgctccgccgcgtctatggccgccgccggcgaccatcggggcgcgggcgcgccgcctcccgccaaccgcgccggcgtggccgccctcgtgcgcgccgagtggctgccgcgtggggcccggccgtcagccgcccgcgccatcgggtgcggctgacgcgtggggcccacggcgccggccggtgtgagcccgggtgcacccggtccaccgtggactgtgaggctgccacgtgggccccactccagtggacccggtccgcgcgcccctccccctcggctgatgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagaatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggatattcatatcgcctggacactatggaatggttggattattgtggaattggattcacacctccccctctattcaaaatcctcaaaatggttttaggttgggctcggggtgcatggttttgatagtagcacctcggccatataaggaccggt

SEQ ID NO: 1132 - DNA, 1501 bp, Oryza sativa
attgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtactgagtacagctttattgaaaaaaggcgtaatttggagaataggggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccattcgtctttgccagtggaccgctgagcctgagcaaacacaaatcgaagaactctcaaagtcgatcgcaactttattactcagatctgtgtttacaaagtgcaacaacagtgctcctcacgaaatgtcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctc

SEQ ID NO: 1133 - DNA, 1501 bp, Oryza sativa
tttattaatgaaaacttggaagtaataaaaaattctgtggcaacctaaaacagaaccaacaaaaattatctacattataatgtcactatatatagggtcatgtgagaaccattgtagagaggtccaatcaaatacgctatcagcgatagttagttttgtatgaacccctctctctctctctctctctctcaacaaataatgtctccaagaaggcattattagtaattcacaaaaaaaaggaggcattatttggaaacatatgtttttctgtttcgttaatgaatggatctgctcattccattctagtagatagtttatatttttgccacgcggagatggtaaaaggaggaaaagatatatgcaacgaataagattgagttattttcagcctatggacttatggattaagtttatcatgattgtcaaactacgatttctccaaaaactttaaactacagtgcttatgtatataacttggtctaagctttttttcttgtttttatataatattttagttatctctataaacaaatgtttgtaatatgtctaataatccatatataaataacatatagcattaggtgtgagcttataatttttttaccgaagttactccctctatcataaaacatagcaatatacttcgtaatactagcattttagggcataaggattaggatgaaaactctaaaataccccctcataaatgcatgggattgatgggattaaggatactgtgagtggggtgtggtttctggatggctagtagagtgaggacccactaggggtagtgtggtttctagatggctagtagagtgaggatccactaggggtagcacggagagtaatagagtaaaaatcatcttttacttgttctaggtagctatgtttgagactaaggtgacatgttggtacttcatcggtttttagtcgcgtatttattctgttaccatatcacactaatgtttattgtatctattccatcttgattatccaagagggtggttgagaaagaaattctcttggtttttaaatttgagggtatacataaactttttccagaataaatagttctggctctcgacaagatctcggcaagttagaacattgatagaccccgggagatcttctactggccaaaactaggtgtgacgatatttcatatattttcccaaaacgaatcgataggaagaaccctcaagagggtgaatgaaggtatcgacagcacgggactagcattgcacaattggccaaacaaaaggaacgcgcaaacacaaaaaaagaacgcatgcactgatcgatcaggggaacctgaaacaaccaattaatggaaaccaatgtataccagaaaacataaaagtgagtggaaaagtgttgtgtttcgtctgtggtatggtgacaggatgcttgatcagctgcccgcaggactgatgggatggggccctttaggtcattcgtgctgaaagtccgaaagaaaagtgacaactcctgtcagcctacc

SEQ ID NO: 1134 - DNA, 1501 bp, Oryza sativa
aaagctcaccaaatcctcggcccacactcctctgcttcctccaccagtgcaccttggtgcatgcgctagcctctacctgtcctgctccctctggtcgccgtgagcccgtgagtccctgtactgccttcctggccgccgtctcctgcagcgcctttgcgtccctctcgcgacgctgctccagcgtgagcccgtcgtcccggcccttcaccgctggcttccgcgcctgcgccctctgccttccaacgcctccacgacgccggtgcgccacactcctgttgggctgtgtgtgtgttgtggcccaagaggcccatgtaccgatatgcttgcatatgtatagagtaagcaattgacagagggtgtgaagcttccagaaaaacaatcacaaatgtcttcatggtattagagcttggtcgccagcgactgcgtcgacactaaaccctagctggcggcggctatggccagagaagcgcggcgcaccggcggtgtacttaggggtgggcagaaaaagaccgagaccgagaaattcggtcatcaattcggtcctaggaggtgaaagaccgaattttgttcggtcaattcggttagtctcctcggttaaccgaatagaccaaaaagaccgaattaacaaaaaaaaagtataaatacaatctacaatccactaagttcaataggattaaactctaattttcacatccctacttcttctaggcatataacctaataagagtttttactcatacgtgcttacggatttttttttgtgatttttgtgttgaaaatttccattatttctctgcatatatgaaaatgttgctgaatttcggtcagaccgagaccgagaccgaaaagaccgagactgaatttgtcggtcctgacatttttgcgttgaaattcggtcttcacttttcaaagaccgaaataaccaaaaggccgaagaccgagaccgaaaatttcggttagaccgaacgcccacccctaggtgtactggcgtgtggtgctggagctcctgacgaggaagagagcgtgttgagggtggagacagtggcaactattgtggtgagggagcaaggcagcgacggttgctgtggtgagggagcgacagtgttgacggtggaggcaccggcagctgctgtggttgtgcttggaggaatccgacatggagagaaggtgtagctagctggaagcgccaacggcgaccgcatgcgcggagggcaagttgacgatggcgtgtggagtgaaggtgcgcttctactgttggcgattgtgtgtgtggagagaagatggtgatattgcttgctagcgtgtagaggtgctgattgagaaggtgcagctgccgcttgctgcttgagaaagtgttgcggatgctgcttgagaaggtgagaattttttctactgctactgttgagaaggtgaggatttggtcagattgaagtctcacagcaataaaagaaggggaacagattaacttgtggaggtgagaagaagggatatagctgctatt

SEQ ID NO: 1135 - DNA, 1501 bp, Oryza sativa
cattgcattggaattttggatctgctttcaaatttgaagaggacttttgaagtttcaaactcaagtgtggattctccgcaacgtatctactgtatgatgcggatccttggcagtagcagagctgagcaaaggaactgttcatcttgatgacattttcaaccataccatttttttttgtcaaagttgcaaaaaaaaatatctacgtttagtttgttgccaaatttgataaatacatgaaaaatcctgtcaaatttttagtaatattgccatcttgctaaaattttagcattgccaaaatttggtaaggtttattttggctacaatctgaatatgcccaaaatctgtcttcctaggcctacacctttcctgcctgacattgcccaattagatcgtcattggtttaattatttagtattccctccgttccaaaaaaaaaatattagatatgccatatgtatgtctagattggtagtgactaggttattttttatgggatgaaagtatttaacactaggtgggatattttctagtataatgtatctggaactctctatcagatactcctacattcattatacaaaaaaatgtttcatctaagattcttactacttcctacattctataatataagcaacttaggacggaatatgacattttatagtacaataaatttagacatatatctgtctagattaattgtcatatgaaatgtttcatccagtcctaaattgttatattatgggacagaaggagtatattttagacatattttctattgttcatccacattttaagtatgatactacctccatcccaaattatatctatttctagcacagtaacttgtattaaaatgaaactatttctccacctaccctcttctctcaaccaatcacaaccattctcttcacctattttctcttctcaaccaatcataacccctccaattaatcatttctacatacttacttaatatacgtgcctaccttaaaatggttaggttatgggacggagtaagtattcggttgttcatccagattttctggatgattccagattttttttttaccacacacgtggaccacaaaactgttgtaatctctgtagcacatcgaaccttgcgctgcctttccctcaggagacaaaccccgccagctcatgctcggctcaccactccacacgtgcgcagctccccatggcccgcttgtacgccacactcatcgctcgacagctcactcatcagcggcaaagctgattaccaccaccactcgatcaatctctcaccggatcagcttgaaaattctggagtttatctgcactgcatctctcgtgcaccagtggttgatcaatgattcttgcatcaaatgtgccaaaggttcgagtttgtttactgcagtttctctgttggtagcaaaaacccgtgtggagacatgtctcgccgtccgagtcgttgccatcggttaatcgttaatcaggttccatacgggcagagcaagacaga

SEQ ID NO: 1136 - DNA, 1501 bp, Oryza sativa
gaaggaaaaaaagaatcaccggatctatataaaccaaaactttcaaacttagggttttcttagtaggttggattaaaaaaaacaaagaaatagaaaaacacttaattttgcacacaaataatcattttagtagactacaggaaaaccatagaaatcagataatagagataaaattgatagaaatttttttaaaaaggttttagctcttactaacttttcttcaaaatctatgtaggatttttcattttataggaatttcaaaaaaaaattgatataatttaatcctttcttatgaaggccttattgggaattttccctctaggattcaaattctctaaattttaagtattttcctacgaatcaaaagatcatatttttaacctataatatataaacattaggaagtaaatgatcacatgaaagggacttaaagtaaattgcactgttcaagttatgcctgacagaactattcctttaaactctcaattttccatcacatctaaaacttttctactcaaataaactctcaatttttttttccaaactaccaactttctctaaacgtctccctaattttaaaagctaaacacagccctaatgtatttacaagtcaaaggactacagatttgtcacgtccaaaattaatgcgtacactctgcgagcccaaaattaaactctctgtccagagatgcagaaaaggggaaaatagaaaacacgagtcccacgacggtaatttcaccgtcccgaaaatccaatccaagattcccctaattaggacagaggaaaaaaaaacgttgaattttttttaaaacaatgcacttttaaaaccaggtgggcccagcgtggcgcctacacaccgcactctataaaaaggccgcctcctctgcccccctatccatcctccattacgctttcctccaccacctaaaccgcaccgaaccccgctcgcactttcgcagaaacacccctcaccgaccccgtatttacattaaagttacctacctttcctctttattggattttttgcggagagccccctggtaagtttgtgattatcgcatcggtgcccttcgccggagctgtgggtggtgccctctatgaatggtcaaaccccgatggggctcgccgccgccgccgcagtcgcagtgaggccgtgccgccggaggctgctgtcgtcggccacggcggcggcggtggcggcgacggtcgccaccgcgaccccgctgttccccagatgcccccacccgcaccaccacctccacggccgccgcctgcccttcctcgcatccgcggcgtcgcagcagcagcagcagtccgggcagaccgccgcctcgccggcgaccccacctataccctccgatccccgcgccgccgtctccggcaacctccccttcttcgaccgcgtcctcttcccggacacgttcccggtcgagaccccaccgccctcgtcggcggcggcgtccgcggcggctgcggccgatgaggaggtggcgtcggcgct

SEQ ID NO: 1137 - DNA, 1501 bp, Oryza sativa
aaaactcagcagcataaaaggacttgggcaacttttaaggggtatgtaggtgtcaagggagtgattccttggacaacgaggagtggagacccctcccccccaagtgggaagattcaaccaaggggtttgtggtgcaatacttagaaaaagattcaagcaagatcggatctgtggggcccaagctccccgccatgcaaaagacacatgaattatacaggttcaggctatccggaggtgtaataccctactcatgtgttggtttcgttgtcttccctagatcagctgcttacaaaggaggctttttcaggctgcaaaatgaattataccgatctaaagagtccagccctccatctgtagcttgtccccttcattttatagtccaagtaggggctcacattattacaaatatactccttgtcttgtcttatcagctatcttgtcgttgtcggctggtttcctaacacatcttcaagaaaaccctattgagatttgaaatctgcattaccccgtgtacccgggcttctgtccgagacagctgggtcgcgccagctatcccaacacatggcgagtggtgggcttggtggaacccgggctgtctgaaacaatgccacagcctcgcttctgcccgtttggcttaatcaggtggtgcagggcatgttcgacacgcatccaaggtgccaccggcaccaatgactcaacactggtgtcttgtctacatcctttcaactccatgctggctggggctccccataaatctgtttcatttatggcggagaggaccgcttcacaatagcccgtggagcgtgtccatctccccagctggtcgtgaggtcgcacctgcgcgctttttgtgatgatagttcatctattcttaggcatgcttctcgaaaatgtctttgatgagtcgataatgtagttattttacatgtttcgacgctcttttttgcagaagaatgcggaaactatagggactagggcgtgcctggatcccaaggcgaggaatggaccgaggcagaccttgagctacatacttatcccgtaaacaattgaaggtgggcccgggacccaccaaagtgggacccctagccgcatcaaactgggtgtggctttttatttttaaggatggtttaagcatgtcatttattttatttataattgttctgtcagggaaatgggtaccctggttgccattttaccgacagtagggaatttacttttctttctttctttttccctcttcctgttattttttgaaggggggaaaacagagagcaaatctcattgtgtaagtgttcttgcaggaatggtggtgcttgttagcttgtagccatgcgcatccctcctatcatcatccaggaagattgttttaagatccacgaacaaaagagattttgtaatcaattaatatcatgctaagctctactcactttgtgccacgaaagacaaatctaggactggatgtgagatattctattacaacaaatttggaagtacaacgaat

SEQ ID NO: 1138 - DNA, 1501 bp, Oryza sativa
tctcgtttccggtcattggcggaccggttgagatcgacatcgtggcgtaaatcgggaagacgatttcgccgacttgagtccacatcagcatcgttgaagcagggaatacttggctgaggttggtgttgacgctgttgtcgacgaggctggatgacatagtagtagaaccttgagtaccaagtccccctacctggcgcgccactgtcgacgggtggtacccgtagaccggatatagagggtattggggtatgttggtacaaggatctacgtaatacgacatcaagcaaacaaaagacgaggattatactggttcaggccccttgataggtaatagccttaatccagttgatatgggattatatggtggaaaacacaggttacaaagggaataatggaacttgacggatccggtgagatcgtggtcgagttggttcaactagatcccggcgatttggctccttgcaggctccgacttcgtaggctgtgagggttgtgttggctctgagattcgatgccccaggtcctcctcggggggtcccttttatatcgcaggtcaggcggtttccaagtagaactcggagataacagaccctatacgatacattgatgacccagtcttgtccgagtaaaactcttcccctccgtagactttgtgaaggatttccttagtgtacgcggggagtatccgtatgcgcgtgggtatgccataccgatatgtgacgtacatcaaagggtaaagggtatacctaacccgtaaccctgacaactatgtctaaccagcttactaacccactatgtggcaaaacatgtacaccccttcaatttttttatactgcgttgtacataaagaaaataaatactagtagtacttccatttgtagtatgtccttgaggttggcatgctatttagtgttttttttaacttccaattctaagaagcaattgattagtagctaatttttgagaatctgaaattaaaaagctgggttctctagtctttagcttttaatttattttttgcattctatagctatagaatctatggtaaaatttgtttggagagctataaaatttatgttaaaatatgtttgaagagctgaagattatagaagaagttatagatactagaaactttcaaaacatggcattagttcccaactttttcttgaaacttccaactttttcatcacatcaaaactttcctacacacaaacttctaacttttttgtcacatcgttctaatttcaatcagacttccaattttggcatgaactaaacacacaacaattctatgtgacaaactacatctccctctatccaaaaatatatgcaattttgatccgatatgactcatctcttagtactaggatacatcatattttaatacttttggacaagctccccatctagattcgtagtactaatatgtgtcatatctgacaaaaatcccttatattttagaacggatggagtattcaaaaatatcgtagaagtattatcg

SEQ ID NO: 1139 - DNA, 1501 bp, Oryza sativa
tggaagttacaaaaaatctagatgcacttatagcatgacacattagtgttagtaagaatttaataagaaaaagttagtacatatagccttttcctttttttttcttttctataccgggccacagaaagtcaggccggccctgcccaagacatgtatgctctaagtacatgtgtgtacattagcttgagcagtgcatgcatgcacgaggagacatgcatgtgtgctgtgatcaaggttatcattatcccgattcgtatcctagtatcttacgatactacgatcctactaagccgaaacggtaccgatcccatctagtatcctaatttttatagtatatcgatcctactattcattactacacgatcctacgaaatcttaggtgatatcccgattctacgatccctatgatgctacaaaatattatttaaaataacatggtttgaaaataatgttactaaatatgctcaaatttatatgaaaatcagttaaatatataaaaaccaaagtggtttctcttgataaatatctctgtttgcatgacatatatcattactgtatttttttatatggaatggctatatataataaatataaatattaattaaacttaaaaaagaaaatcttgtagtatcccgatactctgatacgatcctacgatacgatattactttgagcaaaacgataccacctagtatcccgatccccgatcttgataaccttggctgtgattggttggcagaggccaagccaaccatccatctgtgatcatgggctaggccaggatgccacatggctgtaccggattggcccagtccaagatggagcaggccgtcatggtccaagtgacggcggcccggctccgtctccgcgtgcgtgggaaagcaacggagacacgtaggatccgtacggtgcgggacccacaggcgacgtggtgcgcatcgactgggagacagacgcgtggcgacgcggcttcgatacggaggagaggcgcgcgcgtggagcggcggcttcactcgctgtcaagcgggccggccggagcacgggcgcccctggcgacgtggcgacgccgggttcgcgccgtatgatgcgggacccacggcgcggagagtgtcaggcaagtgctacggtggacgtgactatcacttctaaatttatttatttggcaaaattttatacagaaaattcaaaaatatgcaattagctatgggacaccgtaaaaacgcgtatttgctgtaggacatcataaaaaactggttattagctcctggacatccgctgcattattttattatttttagaggaatatgagagagaaacggctgtgtaagtacggttctacccttcgaattaatttttctttattcttccttattcttctctctctcattctttctctctttctctctcagctatttcttcaagtgagcctgagggagagggagagcgctggtgatggcgtgggccggtgtagcgcctcggctggggcggcgctgcgcggtca

SEQ ID NO: 1140 - DNA, 1501 bp, Oryza sativa
tactcagtatcataataaataaatgtgaaaactttcgatggcctgtaacaaaattcaaagatcaactttcgatgatatgaaaccaattttgcttataaactatatcagtgatgggatcctatggcccctaggtatccctcaccggatccgcttgtacgccgatggtgtggtcgcattccttaggccggttgctggggaactagctgcagcacaagggatcctggctctctttggagaggcatatggtcttcataccaacttcaccaaatgttccgcaatcctgatcaactactcgaaggaagaggtcgcagccctcgatgactccctcacttgcccggttgaggagttcccatgcaagtatttgggtttgcctctctccatcaaaaagctgcgccgtgaggacctccagcctccaattaacaagattgcgcagtggctgccactgtggagatcaaattggctccagccagccgggcgcctagcacttgtcaaagcaatgctgagtgcgatccggtttacttgctcatcgccattccccccccccccgcgaaatgggtgctgaaagccatcgacaagatacgacacggctttctctggtgcggtatctttgcatgcggttggcaaccgcatgggggagaaggtctgcaaaaatcacccttttcgcatgcggccggcccaaccacatgcgaaaatgggattttcgcatgcggttgcttatacctaaattcagcaaacaaaaaaaaaataaaaataaaaaaacctaaaccctagcccgccaccgcacggtgccggattcgtcgcccccgccgcctgccggagttgccggcaccggatccgtcgcccccgccgcccgccatcgtcgccagcataggatccatctcccccgccggccgccgtcgtcacgggctccggatcggccgccctcgccgcccgccgtcgtcacaggctccagatcggccgcccttggcgccggatccgcgcggggcggcgccgcccgaggcggcagagccgcccccgccgccgtccgaggtcgtcgtctggtgaggaggggggaggggcggtgaggaggggatggcggtagtgccgccacccgaggtcgtcgccgccgcgggggagggcgccgccgccggatccgcgttgaaggagtacgggggagtcgccggcgacgacagagggaggtagaggcggcagatccaggcgagcggccgctcccgcccgccgccgcctcgcgccgcgccgccctcggccgccgctgttagtgatatgccctagaggcaatcatagagatgattgtatcacatactatgtttacatatttatccgacattgttccttgaaatagataactccttattggttaatgaatatgtgattctttcatgagactctttatgttgttttgttactatttctaaaggatccctgatcaaatatcatatgtggaacaaatatgtttatatgatcagcacatgtattaattgatgatcatgtctcatggatc

SEQ ID NO: 1141 - DNA, 1501 bp, Oryza sativa
atcaggccaatgtaatatgccaagatgcattactgcatttcttgtcttgtattattgatagatcttaacatcttaagagctgtcaccgtgtcattgtggtccctagtttggaaggtatacttgccttgttggttgggtcctgtggcttatctaggacatcttgggggatctacctgagtggccatcttaacattaataaatggctacacagatcatctcatcaaccactggttgttagtatgctaatcctgtctctcattgcatgattggttggttccttggttgaaaacagagtgttacctactgatttaagactccgtttaagggcatgtacagtgctacattactggtgttgacagttcacagttgcatgatactactagccagataggcttagattagaaacaccttatcctaagagcattatcttaatgatcttttcctatcagaaattgacaatgcaagagatggaggaggtacctgacagtgactgccgtttcaacaacctgcactttcttgggagggatggtgtaatctgactcaaaattctgtcaagaaaagcatcttgtattattaaaaaaacaggattatgcatgaaaaatctttcagaatgtcttatttaggcggctagtgtaatagtttatgaaaggttggcagaagtttacattttgcacaagaaaagtgcactttgcttatgattagaagcattagctaactttcttttaaccccaaagaaatctgttactttatcctctaaacataatgttgcacagctacacataattacaaatcataaataaacaagaaaaaaggagctagctgtttggcacctttcctgcacaaatttcacctttctagctaaccccaataaaagtggctagctgtttcacattatacacgaataggtcatatggtacactaatgatcaaacacaaactttcacaaagaagagtctacctggaggcaaatctcacagagtgtgctccccttctcatcacaccacctctgcacacatcccctgtgagcatactgcacatgcacaaattaacaaacacaaaccataaacacatcattttagccactaacaaactagtaaattaatcatcacaagaaccatatcatgcatgtaacaactacaagaaatgcagggaaggatcatggatggatgatcacttgatcagcttgtaactttgtacctaccttgagagagccagagcatccacagggggactcaattgcagcgcaccactcatcctcctcctcatggcaaatcctgcactgcctcagcagcgaggacgaggacgatgacgaagacgaagaagaaaacgaaggagaagagggttcagaagaggaagaggaagaagaaagctcatgctgttccatcacttcctctcctcctcaattccttccaataccttgctttcttggctgctcaataagatatgctctgctgctgctttctctcaccctctccctcttttctccatggcgaccaatggtg

SEQ ID NO: 1142 - DNA, 1501 bp, Oryza sativa
gagctcttcattgtctgtcttatccatatgggcatggcttcacaattgtttgatgagattataccactggaaaactggcgaaatccagtgaaatttgaacacatttcaccaaaagttttgaaattttttgaacagaccggtttacctggcgctttctagatttgagccggagtgaatcatctggaaactaacgaatatcaagcggttttcatcggttctgtgaactctgctctggtttaattaaccaactagaccattgtccatcgctctaggcttgctttgcaaataaatgagagccgtctcattacaagaacaggaacgaatgaaagtttacagctatgcaaattcctacccaatctcctcaatttgtcccaggaccacttctattttctgagcgatgacccagatggaccatttacaacaattccactagatttagggaatcgcatttaacaaagaccacctgaaaaatcaattaacccaaattaccttaaaagatatgaacaaaattccagctaatgcattatcatagagtattttgcaactcacttcgcagaattgttgacaaatacatacttttgctgtcataataaatctgtgaagaaataactatattttaagggaaaaaattaacgataaaagtatatttaggactacgggagtatatatattacaccttttgtcggtttatagacactgagggaaagaacacattaggaaaagtcctaaaagaatatttgcaattccatgtaagtgggaaaggaaaaagggaaacaaaagcatttgcaaaaggggaatgcttgtgctcaaaaggatgagtggattatcttatctctgccgtttcatcatgtcatgaggtggcattctagtgattattgcgaccgttactggctctttcattgtcttctttcattgactccttttttattagttaggtattgaggcgtctcaagtaaacaaaaaaagaaattaaagataaaatagttatccaccagctggaaatatatatataaatacaaaatatttatcctgaaagccaaagattacgcgcctaacgagcaaggcgaacgtgcattagttaggctcatgataaatggcagatgagaataccagatgacaaaaggtgacagtagttaggaacaaaatgaaaggttttatctttttctttaacaaatggttggtagtagtaataggccctatttgggggagcttgtcccagttgcagtttttcccaaaagatgcttctgctagaagctgccctaaacagtccacacttctaagaatctgtagttacaaattctgaaaaatgaactaagaagccagaagctggagaagctgggtttcagagtttttttagattctcagaagctgactatcaaacagctgcttctcagaatctaaagctcccccaaacaggccgatagactagtagctggtgggccccatgacacagtcacttggattttcctctttccatgaggtgactgcttgcatttggtgt

SEQ ID NO: 1143 - DNA, 1501 bp, Oryza sativa
gttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttaga

SEQ ID NO: 1144 - DNA, 1501 bp, Oryza sativa
ttcaactgaaaatttctccaaatagcactaactgactgaaaatctattatattattaagacagctcgaaaaggaggcaccacattcgctatggaggctagaaattcccacattaatcggagaaaaagaaaaaaaataaaaggaaagtccaagtaggaatacaatctaaaaatagctaaaattcggaattaaaaataagcaatattgaaagaagtttctatataataacccaatataggattaatcaaaattcgaaataaaaataaaataaaatccaaaattagaaaagaaaaggagagtccaagtaggaatacaacctaaaaataactgaaattcggaattaaaaataagcaatattgaaagaagtttccatataagaacccaatacgagattaatcaaaatttgaaataaaaataaaataaaatctaaaattagaaaaggaaaggagagtccaagtaggaatacaatttaaaaatagctgaaattcggaattaaaaataaagaatattaaaagaagagcccatataagaacccaatacaagattaattaaaattcagaataaaaataaaaataaatccaaaattagcaaaataaaataaaagaagagtttaagtaggaatacaatttaaaattagctgaaattcggaattaaaaataagcaatattgaaagaagaatccatataagaacccaatatgaaattaattaaaattttgaataaaaaataaaataatatccaaaattagaaaaattaaaagagagttcaagtaggaatacaattttgaaacaactgaaattgaaaataaaaaataaaaacattaaaagaacacaatacggtattaactaattttttaaaaaataaattctgaaattagaaaaaagaaaaataagatttcaattaggaatacaatttataaataactaaaatttgtgataaaaataaagactattgaaagaaaaaaccatataaaacacatgacgagataaattaagtaatatacctataaaggagtagagtggtggcggttgatacgacatataaaaattattaataaaacaccaaatagaatcctaatgacgattaaaaggaggggcgccaggcatgccatgaagcaaacaagtaaagcagttgttgggacttctagaaagtaaaaaaaataaaccctattgataatcatattcgatttttaaaatctcaatgacaataaaaaggagaagcagcgggcggggtgtataagagtatagttgtagagccgccgacgattgacgggacttctagaaaataaaaaataaattccaacgatagttatgtttgatttttagaatcacaatgacaataaagagtaggcgatggacgggctgtagaggggcatagtggcatcgtttgatggaacttctaaaaattataaaaaaaactacaagtccaatttttaaaggtttggaacttccaaaaaagtaaaaaaaaacccaatgataatcatgttcaattttaaaatctcaa

SEQ ID NO: 1145 - DNA, 1501 bp, Oryza sativa
taacaccgcacgaatctcgacgcacctccagcgctcttgcgtgctaagcacccttggaacagcgtgtcagcaaaaacaacagttacatcttttaattcagcgagatctgctatgctgaccaaccatcaaccatgtgattgttctacgtacagaaggagaggcccatccgcccatgaagacaaattaaaccgacgacagcctttcatctgtccatagtccatacgacaaatgcaatggacgaacaaaccgcatatgtcaacaatacatctatgtcattatagtactgacatagaaaatgttgtagttactcaaactgtacatgacaagtataacgaatccgtgctaagtgctaacttactcacgtctgcaatctaatcgatatttttaccatagatttatgctcgacaaatgtgcatgaatgaatcttctaggtcgatcactctccaaactaggatgaatcttctaggtcgatcactctccaaactagggcattctttttttttatcaaccttggattatgttttgagatgagctagcacgtgtcaagatagatctaacaattgctaaacagacttaggtctaattcttttcttcaactccaaacttcaattttcacgtttttcgttagcacactttttaaattgttaaacgatgtgttttttttaaaaaatgtatagaagttatttacaaaattcaaacaaatctttttaaaatttataattattaatacttaattaatcatgtgataataaggtttcttgttttgagtgcactaaaaatctatctttaaaagtgcagatcgaatgcagccttaaaaataacctctaaatctaatagaccatgttcatatatattggtgttttagtttatttttccccattccgaaggaaatatataaacaaaactttaaaaggaaaatatatttttaaatttgagccagcaaactgcttgtgttatatatagttaggaaaagtagcaattttgtgcataagctggttggataggtattacccacaaaaccaacctgctcagaagctgaaaataaaaacaaagaaaagaaaagatcagctcaagacgcttacaataatttcgccaaatctttagccctacacatgatccatatatatgttttagaaaaaaaaaactctccatatgttgattacttcctgaattttgctcactatagtaggaattgccatctcttaattcttttaagattctaggtttttttttcgcaccgtacttcctcagcaatgatgcgtaacatatgttaaaccattaaactgccataaagccctacaaaacctcggtaacaagatgggctcgcctaatctgaaccatccattgcccgatccaacggtccagatctcgcgcaaaccttgcaaccacaccacctatcaggctaccaaccaaacagccacaccagtacaccactggctgcagctatctctgatcctcctctccatccacccctcacaagacacagtgttcaaaaacaaaa

SEQ ID NO: 1146 - DNA, 1501 bp, Oryza sativa
ctcaatgctcactactacttcaagttaacctaaatgatacatcaccaatgaaaaggaaactattagcgcaacaaaacatacaagagcagaatgcaaccatgaagaagacatataacatgtaattttcaaaccaacaacgctaaaaagagcgccgtgaacttgagtaaccgcatgtccgcatggcaccatagcaggaaggctcgtctaatatgacaataactccaagcattaaggaatcaaaataacccgattaatatccacgatggaaaatagcatgtattcctatgttaatacacatcccagtacgctacttcaaatagccaacaaacaaagccatctcctggcaggcaattacaacttacaaacacagcatggatccaaatacatccacctaaattagtggcctaaatcaggaaaatcgcgcggaacagccatctagagtacttcccgcacagatcccgagaccgggaggcgaaggatcactacacgccctagaaatttcgccacagaactaggtcccaatcactcccgatccacctcgcgctaccagtacaccggatccagactctaatctcgaccaaatctgacgaccacacgaaccatgaaaacaacacaacccgcgacgattcaacagatccaacctgctcccgatccgccgcacccacgcagctccgaacgatcgggggagaagaagcacgagacgggatcggatcgagggggcgcaggagggaggaagaggaggaggggctagggtttccttaccgaggaggagggaggaggaggaagaggggagcgccgacttctcgcgggtgggaaaccctcgcctctgaacttctggtgtggtcggctgtttcggagagagagagagataaggccccggaattgaaccacgcgatataaccctcggttccgtggggcccacctgtaagccggggtgcggcttggtgggggggggtggggctttggagacgacgggatcggaatgggtcccatccggcggctttcccaggatctggatggacggttggatcgtcaccgcccagaggcgaacggaccggattgggccgaatttttctgcaccaatgattaacaagtgggcctagtttctagttttgttgtccccaacgaatttcttctaccctttctttttcaaatatccatgttattattcacacgtttcaaacatcttcttgttacatttttattaaaattaataaattttttttgcaaaaatataaagtacttactttagctaatactcctataccataaattttatggatttaaaaaagtatcttatacagagttatttggttcactaccaaagttttatggatttaaaaaagtagcttatttggttcactaccaaagtttatctcaccatgtcatagcttagattaggcaaggtgtctatttagtttgtgccacgcttatggcatgattcctccatcgtgacgtgggtccgatatatcattttgcatataaaagtgtggcaaggttt

SEQ ID NO: 1147 - DNA, 1501 bp, Oryza sativa
ttgtgcatgatttcctctatgatcgtgggaaaaaatagtggattaacgtgaccttataagagtgttacacgtcagctattgcttgttaaataaaatgtactgttctagaactaggaaaaagatccaagataggaatatcgtttgtatttatactatattcaggtggacttatttgtggatttctttggcatcgatattgaaaatgatttagagatgtaatcttgcattttcatgtgatcttttttttttcagaacttcatgtgatcatagatcatacgtatttgtcctcctacacaatgttaatcacttttcattcttaggcgaaatacaaaagacttactccctcgttttctagatagttaacgtttaaaacaagtttcggccaattagtattaagtttataaaatttaattagtctatattatgggcataaaacattgatactaccaagtcttttgtttttaaactaagcatttcaaagactattgatagttaaagtttcaaaagtaagatccaaataggtaaagttaactataggacactcaaaatttgtgtttgttgatagaaatcataaaaacgtgtcacggctgaaagacactcttaaaaaactgataatttgctaaatgacactttcggctcaattgaaaagaaaagttcttaaaaaagacaaggatgcccccacggtcaaaagattttgaactgagactagggtgaagataaaatatcacgtatactagtgatgtacttggggtgatgctaaatttggagttgcataatttctaaattcgtactttaacgttatgtttgaagcatgtgattctaggggcattcttgtctttctcaagaatttatctttttaattgagtcgatattgttctctaacaaattactagtatttttagatgtctttcatttgtgaatgttttttcgatgtctatcagcaaattacacgaaatttagatgttttgtagtaaaatttgccatccaaatattgtccggcctaaccatcaaatattcacgaccaaatggtgtattaaattatctgaatacacttattatgggtgattatgctcttgatgaacttcatcacggtgtagttgaaataacggaactgaaaaatgaattctataaattatcaaaagggccatcaagaattattccagaggcagcccaatataacattgccggcccagataagtcagtggttcatctggaccaaaacccaacgagctagtctaacctcggtatgggccttcaactccaaggctgcagatcacccactggaccataactgggcccagcacacagaaacaaatcgaattcgcaccagtctgggccgcaaggcccggcccataaaccaatcggatcccacaacactgggccgagaagattggcccaacatgagctgcttccaacatatcctcggtccagccgtctcttctcccaagttctgaagtgctctctctctctctctctcggtgtttccccttcggccttctcg

SEQ ID NO: 1148 - DNA, 1501 bp, Oryza sativa
gtaggacgcgttcgtctggtgcgacgacgacctggacccgctcgacgtcgtgctcctcgagttgtaggacgccgactgctgctgctgctgctgctgctcggaggcggcttggaggctaaccaacctaaacagcgtatccatctaagcaacggcgacgaggaggaggcggcaacatatggcgcggtacaaccaaacaacgcgcggtaacaaggggattttaatggcgagccgagccgagccgagctgagctagctagtagcagctacacaacctagtaggagccatgtaaattgcgaggtgtggtgagtggcttggtgtttgtgcttttgatgctctctttctctttgcttctcttttggtgagatcgataacatttgagtagcttttggccggatcgatgagagaaggagaggagggtggagagggagaggatgagagggagggggatcgatgatgcctcgctctgattggaggggttctttaaatttaccgggggcagcagcagcaggcagcggcagtgggtgtgggcgccttttgctgcctctgcctttgctttgcttgctttctccatctcgatctcactgccgaggctcgccttgcttttaggttttttttggttggctttgctaacgaactcagagagagagagagagagagagcgctcgcgacagtgtaggggatggatggtggaggtggaccggtactgtcaccctgcaagtaggagcactgtttattatttccccaccactctcaattcaatttatcaccattgttttaaaaattcaatttatcgcctttagttagtggaagagagagacacaatagtgtccaatcgattcaaataccgcgagttactatgcgagcgtacatgatctcagtggtggagccaccgctcgataaccctaggcggctacctgacccatcgacgaacacattataaaatcgttatgttactgttactatagggaataagattttcataacaaatactctctaaattttttttggccccaccgctacatgatctagacctagagaaatagtcttctgtaggactaaagtaatagagacaataaatccattaaacacgcaatctataaaaagtttattggttgtggctctctcacaactatgacggacatttagctagagcatttgtcttttaccatgtgtaagaatctagtgtaaaacacatttcaagcatccaatattatcttgtatcctaattcttttttttttctcttttggatgaactcctcttgcttgctttggttaggtttgacttatgtcttttccttttgttttttttactcaatgtgatagtcctatggtagaagtacaaatcaaaatcctatgtaatagattattaagaaatgttgtaacatttactctagtacatggtttattttttcgatggattgttggatcccaacctcggcggtgcaatggttttgtcaaattttgatgaaattttgctcatatatattgtttgaaatttgaa

SEQ ID NO: 1149 - DNA, 1501 bp, Oryza sativa
tctctttcttttgcggacatttgttctaaagcaatcgagcaacctgttcagacgttcgtttttacttttaatttgggcttaaccattgcgagacactaaaacactcgagcagcaaacgctgaaacatctcgtgtctgcaacctacacatggaacgaattaaagctgatatttattggttcagagtgggagtaggtttcagttcgatcaagtatatgcagtcaaggctcaagggccctacgtgcagtcgtgcggaagaagaggcagtgaaaagttgataatagaaagaacgagagaaggttaattagctgattaagacgtgcaggggaaagaaaaagactctggttgcagtgattcagagacgtacgtaccgatgaagtcgatgacgaggcggccgtcgcagtagcggccgacgggcatgccgaagaaggtcctgccgttgggcggcggcgcggcgccgaaggtggccgacagcccgcccgtgtcggagttggagtcgccgaagttgaacacggccgggaagcggcagtccgcgccggcggccactgagacctgcgacaccagcaccagcacggcgacggtcgccaccaccaccgcggctgcgtacggaggaggcgccattacccccccaccacgcctcgttcgcgcgcgcggggcactgcgagcgagagcgacgacgagcagagcagcgtgggcggaagacgaggcggagcttagcagcagtggcgttggcgtggcagtgggcggaaatggcgaatggagatggatggttgtggatctgcggatagagataggcgggaggcgggaccgcgcgcgtgcgggagagaacggtgggagaccccaaacgcgacgcggtgccgtggacgacagcgatgggagggggagggcgcggtgggatggccggatgggtcacactgactgacgagatggccgtggtgtggtatggtgtggtgtggtggtgcgcgggcgtgggcgcgggtcgcgagcgatggtggagtggagcacagcgcacggtgtgccggcccggtggcgcggcgcacgggacgttggatttttgttgctgtgggttcgtgggagccgcgtccatgacgccgcgctgcctcgtcgcgcgcgcccggtggtggattcgcgtcgcgtcgcgccgcaccgcacgcgaccacgagccgtaacggagatttttctttgctctacgtgacgctttggaggcggcggtggagtggcgatcggcctatgttacatacatacgcgatctaggcaaagcgtgaaccgggcgcgcgtgtacatcaatgacggtacgtgaagtagaaagcagggaagcatggcccacgtggagggaacagatgggtttgttttgctagagtggagcacatcattgggctcaaatagtagtgtgatgtatgcctgtatgagccttatctctcggtcacttggtgtctggatagtgggtggaataagttcaccagagatccctcaacttaatattgagattttttgaggtccctt

SEQ ID NO: 1150 - DNA, 1501 bp, Oryza sativa
cacacgcgatggtgcgcctgacatcttgggtcccatcagtcattcgaccggtcacagacctgttgagtgcactgcacaccgcattaaatgcggcgtggcgcgaccgctcgggacgccataaatgcaggtaggtgggcacctggaagcggacacctaacccaccgtacgtggtgacctagagagggggtcgggggagcccgacccctagtcacgggagggggcggccaccgcccgacctcgggcccgatcccccctcgggagggggggggagggagccacgtggcgcctggggcggccttctccctctagtctcggccagggagtggtcgccgccctacctcgggcccgacccccctcgggggagggccacgtggcattggagggcagcctcctccatccagtctctgggaaggagtggccgccgccctacctcgggcctgactcccctcgggggagggccacgtggcatcggggggcagcctcctccgactagtctttggggaaggagtggccgccaccccacctcgggcctgactcccctcgggggagggccacgtggcatcgggggcagcctcctccctctaaacctaatactcccgggcccatatcaccgacaggtacgtttttttaaaaatttttctataggacaattgtttttaaaaaacatattaattcattttaaaaaattagttaaaacttatacatcgtttgtatgccctcctctcggctcctcccaaacaaagggcccgtttggggagattaagattatgagaagcagctggttggtagccagtatttgaaaatctgaaaaagctgggcttttcaacttccgacttctaatttattttctggattctataaatacaacctctcaaaatttaaaccaaaaagctgtaccgtctcgaaagcttctaattatgaagaaactaaagcagcaagctcccaaacagacccgatcctcactcgagtcgagtctcggtggggaggcccagaagggtcaagaggtcaaacagccaccggttcgcccaaaaccacgtacctccccgtaggccccaccctccatagaccgcgaaccgcaccgagcacatcccatccgccggtctccatcgccctaccatcccagccggtgggcgtcccctcccgcttccgctccgcctagcccaaagctgcgcagcaccctgaacggcaccacaccacggaacccctcaatttccacgacgcttcctaatcctccctcctcatcaaagccgtcacctcgctcgcgtcggcggcctcgactcccctcccccaaatcggttcccctccaaaaaaaccaaaccctcaaaaccctcgcctccgctctctcgcgcacactcgtgctccctcctccccccatccatggcttcctcccccgcctccgccgcctccgaggaggaggccgtcaaggtgaggtttccgccgctggcgtcgtggggggtgtaggggatctcccggtttgggcgtttttgttggtggagttttg

SEQ ID NO: 1151 - DNA, 1501 bp, Oryza sativa
taatcatgctgtgtgctgttgcgatgaacaggccacgcaggagagaacacagctggtttaaggttaggaagcctgcacaacgacaacgtagaggcaggcaggcagggtatccatctcttttcccccccggccgttaatgttagtattattgtgagccattgtttgcccgtctccagctgtatctctctctctctctctctctctctctcaggctcagctttttcttcctttctttctttctttcacctgttggatctaatcttggctttgcgagacaggaggtggtgaagtggcagttcgctttgccttgcgacgtacaggcaggaagcatacaatgcatgcacaaccccaacatagttgggtgcctttgctgtcagtggtgtggtggtggtggcatgcgttgcgtttttcaccgtcaattgtgcgtccccgtgtgcgtccttgcagttgccggtacggatacagccgggttagggcatgttgtcgtacagcagtgttacagtacaatcatgtaatataatctcgaactgcggaattgaatttttgtctctcgagggacactcgttttgtgcatgtcattgaaaaagtcatcaaaaattttaaaaatatttatcaagatagatcaatatatataatatattttcaaaaacatgcaagttaaaattcgactaatacaattcgaaataaaatataataaacttgacaatgaattacgtattctattcataattaaatttgttattgtttttctacctgttaaatttgaatattcatgctttgtgaagtaagatattacttttttttaaaaaaaagtttgatactttttaagtgacatgtaaaaacgacgagacatcctatttaagggatgaatagagttttcccttgtactcaacaattaggtgtgattatattttatcattgtattctcttacaacctacgacttcctctttttcaaagaaaaaacaatcttccaattacagtactggacatatgctatatctaaaattcgtacctagaagttttttttttcatctcttgtttggacaccagctgcctgcaatcacctcattcgaccaatcgaccactgtcatcttgttgtcatcgtgttatgatcgccataatgttctcaagcttgttggtcgaccactccagctgttgtattcacacttagacttcgtgggtccctagatcctacgctgctcactttgctggtggccaaaacgattgttgccagcctcagactatggaaatgcaattgttgtcctccatgatcacctgatttggcatcattgtgtcaccaatcgttagatttggcgcctccaacctttgggcggatttggaatgatcgagcttgttgatgaccgtatacagtactccctccgtttttaaaaatataacactgttaatatatattaaaaatatatatattaacggttttattgttactttgatttatcgttaaatgttatttaagtatgacttattattttatatttgcaa

SEQ ID NO: 1152 - DNA, 1501 bp, Oryza sativa; identical to SEQ ID NO: 1143

SEQ ID NO: 1153 - DNA, 1501 bp, Oryza sativa
tgtcttgtcccaaaataaagctatttcttcacctacctcctcctctcaaccaatcacaactattcttcttcacctactttctcttttcaaccaatcacacacttcctccaatcattctcacatactttcttaatatccgtgccaacctcaaaaatagcttcattttaggacggaggaagtactactagtactacttcagagaagagatcaaaagagagagaagatgattggtgctaatgttttattttagtactagtgttttgtagtggcatgacactgtcttattcctttttttttctttgtaagatgaattaagatcctgctcgccttactaaaatggagcatttgtcgttgtgtttacatacctgtgctatgttggtggtgtgtgtcctatgcgtttggcttctcactgtcacatgatacaagctttgcatgcgtcctcttctaatttctactagtatgattctatcacaaccgtatctgttttggctttaatttaactccatctggcctgccctgccctgtcatgctttaagcctttaggtggtgtttagatccagggacttaactttagtccatgtctttagacactaatttagagtattaaatatagactacttacaaaactaattacataaataaaagctaattcacgagacaaattttttaagcctaattaatctataattagagaatgtttacggtagcatcacataggctaatcatggattaattaggctcattagattcgtctcgcaaattagtccaagattatggatgggttttattaatagtctacatttaatatttataattaattttcaaacatccgatatgatagggacttaagacctcatgacttttcattccctgccagccatcaagccttcaaggtacaatttgtcctaagctgccagctgcaactaaataaaaacaacaaatactactagtactacacattacacatttctattaatacagttgcaaacgtttgattatttatcttatttcaaaagttgcgtaaatataaaaaaataagtcgtacttctgttaataaagcaagtcacaaacaaaataaataataattccataatcttttgaataagataaataattaaacgttacaaaaaaactctaaacgataagtattttgtgacggaggtagtactgcgctgataagaagcgaaaacatctctgaaaaaaaacaccttaatctcaggcagctagccagggaaaaaaactcacacagaatatacgtgaaaataactaatacgcaacaaaatagtatttagaaaatgggagcgaatgaaaaaaaaaaagggattactgggtgctgtacaccaggtccacacagttagtgggaggcaaccaagtcagctccaagaaccagtccacctttcccattcctctccgcgcagcgcaccacctcctcttcctctccacccccactgacacatgggccctatacacccatggccccaccttgcagtcaaaggtagct

SEQ ID NO: 1154 - DNA, 1501 bp, Oryza sativa
acacttagcgaaccaatttaactgtcagtctgtaatccatagggtgctcgaatggcaatgaaaatgtcggaccaaccgaggcatgcacgagcaataattctcctttctttgtctacactcaagtaatggcagcagcaagatgaacctatggagtacactaatgtactgtcagcaattggtgtctgaaaagaacatatccatgtacgaaaccagcgttgtgatgggctgtgttttaagatctgtcaggataatttggatggatccgaaaacaatgattaggacatacaaacatatacagtgtgatgatcgagctaattagttcatgacagggtgtgcatgccagggaagcattacagctctgatgatcctccatgatccatttcatcattttcgttgtatctcttcttccgatggtggttgcaacttgcaagtaggcatgcatgcgtaatgtaatgcactccttccttaatccttcctcctactctacttaattataatgtttctcatacactgtactgtacgtactatataattaattaaactacatgctaatgtatacgaacgtagaagcagatatcataggatcagtgtcgataccgaccaagcgaactttcagagctttgagctgggggtagtagtgccctgtgcttgtcaagacgatacttgaaacgagaaaatcattaacattaacatgtaatcaattaaatactaattattataaacgtgaacaaaatatttgatacttataaagaaatatttatgtaaaaaatatttataaatacatcgtttagtggttcggaaaatacacttacaatagacaagtgagtagctaagtcaagcatttattttcagattatttactgaaccatttaaacgaaatatttgctccacacttaaaaaaatataattttcctagtgtattatctaggccacttatttaaatttatttgtcaaaatatatactctcaataaatgacgccttctctaaagtccaaacattaaacggagggagcagtaatctgtaacaataatttttctcagttatgctctgtatgcctgcaacaccaggcagatttgtcagcgatcaagatggatgaagacccccaacaatttgtcaccttaatcacaagctaaccacgcatggcccacctgtcattctgagacaggtcaacacaatcaaccctaatcaagcccattcccattcaccatcgcatcacacaggcacacagccacagtacattgtagccttaggccgtagtacacgaatcaactaggtacacgagaagacttgggcgacagagagagagagatgaaccagccaccttaattgcctacctcgaggaccttaattaattgattaatgactaaacttggccatcaaccgctgcctaattactcgtgccgctctcctcattatgacgccacccaaacccccgcgccgcgccgctcttcttcttctcttccattgcaagcaaggccaaggccaaggccaagcagctgt

SEQ ID NO: 1155 - DNA, 1501 bp, Oryza sativa
aacgatgccggggacgcggcggacgggaagccccggggcgaggacggcgggcaagaaggcatggacgccggcgtggcggcgcctctcatcgttggggccggaggccacagacgccggcgcctccctccccctaccccgctccgcagcaacgggctctcggtggggtcttcctcgcggaggtcgccgcgcgacctcgtcttcctcgcggacgacgagcggcggcacggtcgtcgtcgaccggagccacgcgaccttgtcttcctctcaaagccgggtggagcggcggcccgagcggcgacggcgacgacgctgggctgagcggccagatccggcctaggcccactggatcaaggcgacgacggcgaggtcggacgcggcatcgacctcgagctcctctccttctccgcgctttccccatcgagccggcgagcttctccgacgaggacggtggcggcggcacggatcgaagcggcgcagcgacgagctccccggcgacatcgaggtcagtgacgcggagcgggagacggcaacgaggtcgacgctggagagggcgcgaggggacgacgagttggaggcacgccctccacagcgcgagctctaggcgttccctctgcctcgcgcgagcgaggaatcgcgtttccttgcttgggagcgagcggctcaacaaggacgtggtgctacgcgacacgtcggcgaaattcctagctagcacaacaaggcaacgctctacctaggagcactgtgaagggcctaagggatggttaagggggttaaatatactttttcctaaaaaggataggagcgagacagacggcgctgggggacgaggcttgttgggccggccttagcccagactcacgacgcggttgtgcgctttctaggtggacggatggatctgctcgactgctctctgccgtcgtgagggctgaagtcagacgtcacgagctgattccgcctcccctcgcccctgccatctcaagcgccgccgttgtttgctccatccctcccacgccaaccgcagcgcagccgctgctgccgtcgattccgacgcccagccttcgccaccggcacccctccccgctgatcgcctccagaccgacgccgcccctccccaccgaccgcatcgcccccacctcaccctggatcacgacgggatctcctccccttcctctcacccggtgccagaccgccgtggcttctcgctgctctgcctcttccttgtgcctcatcaccctggtgttgaaaggaagaaggtgttagaagtagtgatagttcagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataacgcttcctaaaaaccttttatggtatcagagcccgaaatcgccagaatcaga

SEQ ID NO: 1156 - DNA, 1501 bp, Oryza sativa
aaatgtttgataattaagtgtactgaaatatacttatgctttgttttcacaggtttgacagatgagaatttgaaaggttttgttggaggtaagaacagacttatatgtttatataatttaatgaggttatgcatacaactgttcattaaaaaaaattactaatttttgaaaattctatgtatacagaaacagcgaaaaaacaacagttgattgacttggatttaaacaaaaaaatttcacaatcaggtgaaaaaacataaattttttatgttgtttatttcaatatgaaatcagaattataatcagaaaatctcattcaaacaggtttacaattaattgagcaaaattacaataggacaagatcatttataatagatgcaaagaaaagtagtacacgatcaagtactgcacagtcaggtaagaacggaaaaaaaacatttgtccatataaatttttatttcattgatatgtttaaattaacttagaaagaaaacatatgttgtgcaggtattttgaaggatttaagagagagagacaaaaacattgagaagaagacaatatcaaaagatgaaggtaattgaaaataaaattacataatttcttttgactaattgtattcagagtttggttttaaatttcataagaaacaaacatcagattaattcaatttttttaataaataaaggacttgggttactggagcaaaattataatacgatgagatcatatatgcttgaagatggcaaaggtgatacaaaaactggtaagaaacataaatttagaaccattaaataaattagaatttaacaataatctgtctattctattataatatgcaggaaacactcaaagagattcagaaattgacaagggaaagagaatagctgttatcgagaatgtaaaaacaatggaaaatgaaagaattcaatttgaagaagatatgttaggtatatatatttttgactacacagaatttgtttttttgtacatattttagattgttttattttttttcaggagaacaggatatgaactatgcagaagaaatacatcaaaccaatgttctatcactattggatcaagatttcattgatgtaattatacattgtcagatatcgtatatttgttttattttgatttggttttaatttaattaatatattttaagcaggataaatttacttcatacactagtctaatggaacatattatatcttcacaacctacaagatgcaatgatttggaggtaatttaacttgtactctattgaaaattagaatttcttcattttttttgaattgttttttaaaaactatttttattctttgcagaattcgatgtgagaaagcagcagcacaaatgttgacttcaattataatttggtgaatgaggtattaaaaaaatttattatttgaatatatcatttagaaaacattaagattaataaaaaagatcaaaaaatcattatgttgaattttacatgagtgcaggttgaacaaaa

SEQ ID NO: 1157 - DNA, 1501 bp, Oryza sativa
cggttgatggccaagtttagtcattaatcaattaattaaggtcctcgaggtaggcaattaaggtggctggttcatctctctctctctgtcgcccaagtcttctcgtgtacctagttgattcgtgtactacggcctaaggctacaatgtactgtggctgtgtgcctgtgtgatgcgatggtgaatgggaatgggcttgattagggttgattgtgttgacctgtctcagaatgacaggtgggccatgcgtggttagcttgtgattaaggtgacaaattgttgggggtcttcatccatcttgatcgctgacaaatctgcctggtgttgcaggcatacagagcataactgagaaaaattattgttacagattactgctccctccgtttaatgtttggactttagagaaggcgtcatttattgagagtatatattttgacaaataaatttaaataagtggcctagataatacactaggaaaattatatttttttaagtgtggagcaaatatttcgtttaaatggttcagtaaataatctgaaaataaatgcttgacttagctactcacttgtctattgtaagtgtattttccgaaccactaaacgatgtatttataaatattttttacataaatatttctttataagtatcaaatattttgttcacgtttataataattagtatttaattgattacatgttaatgttaatgattttctcgtttcaagtatcgtcttgacaagcacagggcactactacccccagctcaaagctctgaaagttcgcttggtcggtatcgacactgatcctatgatatctgcttctacgttcgtatacattagcatgtagtttaattaattatatagtacgtacagtacagtgtatgagaaacattataattaagtagagtaggaggaaggattaaggaaggagtgcattacattacgcatgcatgcctacttgcaagttgcaaccaccatcggaagaagagatacaacgaaaatgatgaaatggatcatggaggatcatcagagctgtaatgcttccctggcatgcacaccctgtcatgaactaattagctcgatcatcacactgtatatgtttgtatgtcctaatcattgttttcggatccatccaaattatcctgacagatcttaaaacacagcccatcacaacgctggtttcgtacatggatatgttcttttcagacaccaattgctgacagtacattagtgtactccataggttcatcttgctgctgccattacttgagtgtagacaaagaaaggagaattattgctcgtgcatgcctcggttggtccgacattttcattgccattcgagcaccctatggattacagactgacagttaaattggttcgctaagtgtgatcagtgttcagtaacattttgctctgttcttatctccaagttcccaacccatctccctcgttttccgcgcgcacgcttttcaaactgctaaacggtgcgttttttgcaaaaaatt

SEQ ID NO: 1158 - DNA, 1501 bp, Oryza sativa
ttctgaacatccgaaaacaaaactgaacaaattctgccacaactactccaaaaccagccactgttccaatccaaaacataaatcacagggaaatgaatgaacgagacgaacaacagcaccttcttcatgttggcctccgtgaactcccacggcatgtcggggttgttttccggcgaatcgaggtgctgcacaacaagcaaacccacaaatccgactcattatcatcctcagacaaaacagacagatcagggaagagggtagggggtggatccgagggaagggggaggcgcctcacgtacgtagttaagcgccgtggagaacagcctggaggagcagcccgcggcggcgtaggagatctgcaacgagacgttgcccccggagggagagatcaggacggcaaagctccgccgacgaacagcgaggagatacagaggcatttggaggagggggaggggggcactgaccggagaacgggacaagcgtcgcgccgcggccgattccgaggcggaggaggtcgcgagccctaagaggcggcgggccgcgaggcgggcggccggcggcagcatggttggcccgcggtgggggaggcgactcgactcaggcgaagaggggggaggggagcgaagttgtggccgctcgcggaggtaagtagctcggcgtgacgtcagcagcaccggcccagtgggctctcatgggcttattgacccaatcggcccaatagtaataattccttcgtgtactggcaattataacgatctttttttttttggttgggcaattataacgatctactgtccggatttcgtaccaataggattctgatatatcatacttcatactggattgtttattttagtacggaggaaatataccggtagatcaccaatcttcaagcaaaatgaatcgtcctatatattataggccgagtttagttccaaactttcaacttttccatcacatcaaaactttcctacacacaaactttcaacttttccgtcacattattccaattttgtggagattatggataccccataccaacacggcatttataatccgactgggtatggggtgccatgtatagatagaatatctttaaagggacttgggttaaattccaaacttgtatgttaaggaaatacccgggatcttagtcggttaagattgaatcttatctgtaactacctattccgttagggatatggactgtattttataatacggaccccttcccctatataaggaggggtccaggtgcctcttagggcacgatctgctcccagatcatacgatcaataatacactcggcaaatcaatccccggacaggagtagggtattacttcttgttaagaaggcctgaaccagtataaaattctttgtttctcaacccatccacttttccagcttgatagccacccccttttagtattgccaaaatcttgtttcgacaattggcgcgccagataggggtagcgtcaagttcttcgccgattagtgcga

SEQ ID NO: 1159 - DNA, 1501 bp, Oryza sativa
cgccgagcgctcccttcccctccgctctggccgcgcgcgtgcgcgtgagccgcccgcgccaaaccgagtcctccctctccggtccctcgctgccgcttcccgcgcgccgtgttcacgtgcgcgcgcccgcgtggtcccgcccttggcgcgcctggccgtctgggtcgcctggccctgggccccgctgccctgccgcgcagccgcccggccccgctagccagcgcgcgtgcccgagccgcgccgctcaaaccgccgcgccgcccgttgcttcccgcgtgcgcgtgccgtggtggccgaccgcctggtcgccgccgccgtcagcgcctgccgcgcctgtcgctcgtgtcgccgctccgctccacaccgtcccgccgtcatcgccgtcgtcatcgcctcggccccgcctctccgcgcgcaagccgccaagggacggaggcagagccctgccccctctgccgcgacgcccccgctcccctcctccttttcccaaagaagcaagggggcaagccccctttctctccccctttttcctccttttccctctcgccggcgtcacctctgtcgccgttttggccgctagccggagcgccagctcgcgccttgaccgccctaagtcggttcccaaaccgacattgccgcccttaaaacccaagcctccccctttcccttcatctcccattcgcctccgtgccattgccgccgcccccgtgctctgttcgccgtcgccgttcgtcgttgcgcgtgtcggaggagccggcacgagcaaggacgcggaagaggactgcgggcgcgccctcttcctcggcccgaggccggagagattactcccgcgccgtcggcctctcgtcactgcgcccgcccgcacggtagagcatctccccgttctcccttctcgctccatctcctccccttagactcgggtagtagcacgagtagcctccccgtagttagccggcgccacctggccgttgccgtcgctcgccgtgtgctcgccgccgtcgccgcccgagctcggaagcgccgctcgtcgccggcctcgctcggcgtagttccacccaatccgacgctagcaacggattcccgtggccgcgtagatactctcgccgccgggaattggccccccgtgacctcgtcgccgttttccccttttcccgccgccggttgccgccgccgcgattcgccgccgtcaagctccctccggcgaatccgagccgttggctcgtctccccttgtcctgtgcaaccacccggtgtgctcgctttcgcctgtatcgccgtggttcgctccgccgctcgccgcggtcgtccgctgtccgttctggccggcgtcgtcgtctacctcccgccggcccgcgtggcagccacgtaggcgccacgtcggcgccagctcagccaagaccgggtcgagccgaccccggtcagcccctccccgtgcgcgcgttccaccgcgagccgtgaggctgcgcgtgggcccgccgcatccgcatccaccgcgaaccgcg

SEQ ID NO: 1160 - DNA, 1501 bp, Oryza sativa
agtggccaagttagagacttgttaattcgattattaactagtgtaaagatcgaaatcatccaagtaagtaaggaataaagattggatgccgacggttgtgaagataacctaaacaacggtcgatgcaatacacttgttggataaactcgtaactaaactagtacgggttctctcgtagaatcattctattccgtcactgtaatcatacggaacaaaattaacttagtctaatcacacttgatggaatggaacatgccaaatgacagcatgatgtggaattgcaggtgatttttttttaaaaaaaaacaattgcaggtgaaaattgagaacggtttgcacaattgagcacgacggatgagcggccgcctgccacgtggcgcggacactgccacgagcttcccctcgtgctgggctccggagttctagatttcggcaccgcctctgtcccaccttcggggcacagggcgctcagcgtgacagcctgagcgtcatggttcacctctttttctaaacaagttttggtccccgcaactgtgagatgagtagtctccgtccgattttaagagtcgttttcgtctataatatttgatcgtttgttttatttgagctaaacataaagtatttatgttttattatctaataataatatgaatattaattataaaaaaaattaagtacaatgaacgagtgaatacagaaatagggagtagtactgattgcaggccgcagcatcaaaaaatgctttccggttaacctacctccgctgtcaccatgtacactaagtaaaacagcaggacaagacaactaatcagtacggagtaatcaactatggtcagatttgattaaaaaacaacaacagatttgatcggcgaagcagtagtataaaatgaaggagattgaagaaaacgagaggagatcgatctagcttgggtcgcagtacgtcgtaccttcttcgaatcgaatcggtggccgtgtccggcggcgggggcggcgcggccatgtgttaacgcgagctggctgctggccaagtgtcgagcacctgtcgttctcatgcggacgcgggcggtagaagctcacaggctagccggtgaccgtggaggaggcgggccgacggccgtcgcggccgttaaccgaaggcatatatatacgcgcgcctattacgatttgttttgtgacagatatgcatttgctttcgaacctgacagacgtgagacgtggcctacatagcagcctcgcttccgcatttgaatgctccatctataccaacaaacgtttatttttcaccaatctagcacgtaccagtaaaaaaactagaatacgttaacttcattaaaatataatgtaattatttctctctttatctactcctaatacatttatcatttacttttacaaactctgatacaatggttgctttataaaattttcttttataaataggaggatccaaaagtgatcttattttatgacgaaggggtagtaaattataagttatgttcta

SEQ ID NO: 1161 - DNA, 1501 bp, Oryza sativa
agtaaaaactatgtctatcaggatagtaatatgtacagagaaaaagaacgcaagcagtataagttaacaagctgggaattggactcctaccttggttagactcagagaaaacacacattggtacaaaatccttggacatattcaaggagtaactctttggtgtattgccagtgttagtttgagccatctccatcttgaactgccatgccaatagcaccatgttataatgaatgatgtaactataggcaccacaagcaaaaagaaatgagtgatgaaactaacatagaacggggaacaattatcaaacagagcagagcagtatgacgtatcccgctctaattaaacctctgcactcttcaatgcatctgattctgtctagcaattcgcaaatgggaaatcaactgaaatgttacccatccaatcaatcgtattatcacattcggcagtcaaaccctccaccactacatctatgttacggtcggtgcagaattttgtcccatttttcccaagcataatgcatgaaatctacatttgaggttcatacattaccaacccccacggccatagggtcatatcattttgctcgaagagaatgtactaccattcgaatccgcaagggagagggagtgggcgggggaggcttgcctggagggagggctcctcggagcggaggaggtcaagggagaggacgaccttggcgacgacggggttagggttggagccggcggcgtcggaggaggacacggcgccctgccaggcgtgcgagacgaccggggggcacttcatcagccacacggagcgctcggcccgcgccgtctcgaggtacttggcctcctcgcccatcccgccgccccacgctggtggctccgcgctcgcagtctgcccggcgattccggtgtcggcggcggcggcggcggcgctagggcacggagcggcgggcgatctggcttaacgacggagcgagcgggcgaaggggaggcacacgcggagggcgtgacgtgcagttagatgaacgaacgataatccggccggatcggatcaaacgctgtttgcagatgcaccgggctttcaggaatgaatcggttaccgacgaaagttgatagaattcgaataaattttactacaaattgactcagatgttgttgtgaatatatttaatttggttttttaatcctatcgatagatgatacttgttctgttccaaaatatacatatttctagtgttcaaaatttataccacaatataaatattttttagcgtacttcctcatctcaatggatcacaagttcacaaccatcactccagtcattttctataccatctctagtttaatttctatgcctatttccttctaccgatcatgataattttatatctaatcttaatcggcttaaatttatagaatttgattgtttttttatgaagccgtgctaggagctagtgcttgctatctcataatagctccatggatttcatcggaactgttttatgtttcttggg

SEQ ID NO: 1162 - DNA, 1501 bp, Oryza sativa
ctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaaca

SEQ ID NO: 1163 - DNA, 1501 bp, Oryza sativa
aatccaccgctttcctcacccccctcgatgctgggggacggtgttgtggagcaggtgcatccgatcgctgccatcattgatcgtattagcggatacgctgatgaaaacgtcaacgttagctggtgcaacctgatggaaggctgccttgagaacattgtcgctctcgccgaggacacaaccaaacacaaacatgcggaagctatgcagacccacattgtcgacggagggagtaccatgcagggacgagggacatgtcgcgtagcattcccgctaataatatatcatatttattacacttttttacgtatcttgcttgtttgctagaagaaaactttcacacttaacaaaacacaaaactgtttagcattaaatggaaaaaacaagtaagcttaaaaaaaactttcatttcgataacttcaattggaaacttgtattttttattaagtacgcgcttgattgaactacaaatgatgcaatagtagtagccaatcggagtctagatcctactagccgtagcaactctgtcccatatatacaaccgtgacgataataacttatttaaattttatatataggattgaaacacaaatgtaacttatttaatcctctcggccaactaaactttatctgtaaaatctatactacttatctaaatctgatgatggatttgacactgttcttttcagtttattcaccaaattattgaaacgattagttgcttcacactttgaaaaatatgtttttcagataatttttttcacgacattgtttagatcacttttttttaagctacttgtaaaatttataccttagaatgtttggtttatttatataattaagtagataatcgtaacaacattccgattccgtttgataatatataaaccaaacaggtaaaacaggagatgtcataacgcttgagtcgcagataggtaacgcttgtgttcggtatcttgtccaaataggatccgaccgattacactctctttgggaaaacacttgaccaaatcttacccactaccgaacacaaccctagtgcactagctatccgcctggttttcgagtttccaacgagccagaaggaagcccaatttttcccaaaagaaatccacccccgatatcaaaatcccttctccctcccctctcgccgccctcctcctcctcctcgtcgccgtcctcctcctcctcctcgattcgaggggtgccgccgccgccgcagctccagcatccgcgagaggctcgcgttggggatcgccaatttccacgccacggtggccaatcccccgcggcgcgcgctggtgggcgatgcgatcggatgaggtgttggcgacggcggcggcgctgcgtggtggtggagaggaggaggaggaggagggcgtcgagcttccccgcggcggggtttcggccaccgcgcctaggaggaggaggaggagccggtgatggcgcccgccgttcagccgccgccgtccccgcccccgccgcggcggccccgctcgggccc

SEQ ID NO: 1164 - DNA, 1501 bp, Oryza sativa
gagctaattggtgtaagagttaaaatcgatatgacgattattgtgtattatcaaagctgtacgcttgtatatgagctgtgatggcatatatagaatgcaaacatgtgatggcatgagccttaattatatgctttgctaattttctcaactaatcaaacattcattagggtaattagttaaaaaatattctattgttgcatgattaatgaagtgctaatctactacagcatcttaggcggagcctggccgggccttggctccgctgctggtcacttgcatgcttatagtgtcgtatggcgggatgttaagaacaatcacataaaatatattgaacaaccaggatgttttggaatggaaaattttgaagcatggcctggattgttgtttcactttccctagtaaaaatatactatatttaacttttatagttcaactttgaaaaccttgtctaataatatattcaaatatattatatataggagggagtacgagagaccaagaccgttgattttaccgtcgtatgaggcttggttgattttcccgtcgtatgagatagcttttttggtcgtgggggacatatgccccctccccgttctctcgagtgagaattggagagcatcaccatggaactcaacaagttgaggtgttacgctgccatggtcaccatattgaaacaagttgaggtaccacgttgccacgatcaccatattggagtgtactactccaatgttgtactccatcattcacaaatttttggaatacaactttgatgatcaatttttctttaaatattctgatccaactttcaaaaataatatggttagatttatattaaataaaattttaaaatattataataaaacaagtgcattggtgaccgtgtagttgtctaaaacattacttattttgtgacaggaggtactattaaccattaaccataggcatttatgaactatcttttgtttaacttgtgacccttaatattttactctgacatgtgatgtggagtatcatatcactagtaactatatgcttttgtagttagcgtttgaaattttagttcaaaatttccaaattttcggacccctggcatgaaactatttcgcttgaaattttctataaaaatttgaatatggtcaaaatttattcaaactcaatcaaaatctatctaaatttcaaattttgtgtcctgaaatttctaagatttcaaaattttagccccaatataaatatgtaaaacgaaatggcaaaccttgcatgtgcttacaccatgagtcttattggtgattatgaaataaacaataaattttatgtaagtggattatgggtgtgtttagttcacgccaaaattggaagtttgattgaaattggaatgatttgacggaaaagttggaagtttgcgtgtgtatgaaagttttgatgtgatggaaaaattagaaatttgaagaaaaagttggtaactaaaccaggcctatgtataagttggacaatatggattcgt

SEQ ID NO: 1165 - DNA, 1501 bp, Oryza sativa
aatatggtgtttgttgtgacttatgaacatggtgttatagacagggtttaatttttcgtttggccgattctatcggacatcattgatataccgaaatttcggtccgaaatttctaaaattttgaacaaatgttgatcaaatttaaatagaatattaccaaattcacaaaagaataaaaaataaaaaaatcggacgaaataatattgtatcgagagtccgaaatgaccaaaattcattccagaatttcttacactggttgtagacatacatatgtgttttacaatctatatatccatctgttcttggttagcagcatatttaggctgtgttcgggagtgaactctctgacacgcaaaactaaacagcgtttagcctataattaattaagtattagcaaaaataaatttgataggattaatatgattttttaaagtaacttttatatagaaatttgtttgaaaaaacacatcatttagccgtctgaaaagcgtgagcgtgaaaacgagggaggtgggttaggaaagtagagataaaatcagccttatctattctgtcttctgatgaaacaacggctcaattccatgtgcagtcggtaaccgtggcttggcgtccgttccaacgagctgaggaagacatcggcttaactcaaggaaaacgcttggctgcagcaatgtgatgggacacgcgtcgcgaactagcaatttcgcaccaggggggcgctgattgtcattttttcctctcttagtctctcttctctacagcacatgtatgtatatactatatatatatatacatgtgtataaattttgtatatacatatatggtttatatgcagtatatatatacatgtgtgtatatatacatataattttttatatgtacacacttttaatataaaaaaatatacacatgtatataaagtttatgtgtgtacgtataaaaaacctaaaatatatatatatataaactttatatatgtgtatacaaactttgtatacgtgtataaaatattgatatatgtacatataaaaacccacaaaatgcacgtatatacaaacttatatgtgtatataaactttgtatacgtgtataaaaaatttgtaatatatatgtataaaacacaaaaaatacacgtagcatacgagtatacaaactttgtatacatgtatataaagtttgtatttgtacatatacaaagttagcatacgtacgtattaaaaccgaaaaaataaaaaaacaaaaaaacgaaaacagaaggtacggaataaacacagaaaaaaagagagggaaaaaacgggagccaacgcgcagtccgccgcctcctctcatgtcgcgcggagggacgcgcgcggtgcggcactgccgcagaccattttttgccagccggaaaatctatctgtgcttataaatagccattatccaaagaacacaatccactaattagtcgaatccagagctattaactcctctccgttcgattggctcctgcgtctgccatcca

SEQ ID NO: 1166 - DNA, 1501 bp, Oryza sativa
ttatgagagagaagagcaacaggctacagccagctgcagtacggactctaaaacacagtgtgtgtatgactgatgagaccatatattaatagtatagtaagcaactattgtataaattgattattaggttaactataggtaaataaaagctagcagtgaactatactattaaactttctctaagtagccgacctcctagtggcccatcatctccatcatcacctctctagaacacacatcccttttgcctttcctcccggatcgaacctatccgttatttaatccgacactgggtaagttttgtcggaatgatacacgaatatacacaacttctagaatatacttcttcgtctcattaaaaaaatattttttagtttttatacaacttttctttttcatttaacttcctgtaattattatttttaattatttgatgataaaatataaataatattttatatgtgattattttaaattttctaataaaacagacgatcgaatgttgaatacataagccatgtttagttctttggccaattttttttaagtatacgaacacatatttgacgtattaaacgtagactaataacaaaacaaattacaaaattcgcatgtaaaccgtgagacaaatttattaagtctaattaatctatcactagcaaatgtttactgtagcaccatattatcaaattatggagcaattaggcttaaaagattcgtctcgcaatttacacgcaatctttgtaattagttattttttattttatatttaatattccatgcatatgtcaaacatttgatatgacatggtgaaaaattttaccaatggatctaaggctgtgtttagttcctttcaaagttgaaaatttaggttaaaattggtacgatgttactgaaaagttatgtgtatacgacaggttgatgagataaaaaaaattaaaagtttggatataaacacaggctaaatagtcctgaatataaagtcccccagaatccgaacgttagccccctctccttttcctgtccaaaaggccatctcctccccaacactgggccgcgccgcatcgtctcccatgccatgccacgccaaagctggacagcgcgctgtaccgtgcgcgcattgtgcgcacaccgtctctctctcccctttccccctgagacagaggacgatgagtcaccacctcaccgccttggcttggctagcactagcagtagcccaacacagcagcgaaggggagaagaaagaaaaataaagccgttggcatgcggacacggcggcgcctcgcccaagggggggggctctcctgcacggtcacgcacgcaccactgtgacacacaaacgctgccacgctgacgaggtgttcagagagaggagagaaaaataaaagaaagaaagggaaaaaaaagggtctcgtctcatggtcggtcggtgtggctggctgatggctgtgctcgccgataaaaaggacaccgaggctcggtgaggttgacagcactgcac

SEQ ID NO: 1167 - DNA, 1501 bp, Oryza sativa
ttctaatatagtaatatgttcaatatttgtagtttcatacatttacctaaaaaattggcaagctattatcaactttgtccttttacaaaacgtcaaattttcgtcaaattctaattaatcgtccgcataacaactaatcatttggcggtaccttcttcgtcccacgtccgtattctatcttccacaacactgaataaaacaaagtttacaaagcgcgggggcggggggcgaaatggacgggcgtgattttatagctgggaggtcgcgttgtgcgcggcaggtgggggccgggagacgcgaggcggaggaggaggagagagggaaggcagcacgaagtttcgttccggcgagtcaaagccaagccaaagccccaaagcctctctctactacgcctctctccactcctcttcccttcccttctctcttttcttttctctcacacgctttgccttttgctgcccgctgcctgctttgcccacgaaaagacaacccaacccggcgagtcgtagcagagtagagagagaaagaggaggaggaggaaaaaaaataaaattaaggcagttcgttcgttccccacttttgcctgctccaatcgccgccccccgccccgccgcctcgtcgcccgcccgagatccgctccgcgttgcctcccgccgccgccgaggtgagcgcgcgcttccccggacgacgcggctccggccggtggtttcgctgtctgcggtgtgtaaggttttttttgtttgtttggagcgggggtgcagtggaggggactttgggatgagctgcggctgtgtgctcaggggagggaggggtgtgtgtgtgtgtgtgtgtggattgcggcttggtgggattccggtggcgaattggtgactcgtcgctgtggcgcgtggttgtgagctttgggagttggggggttgggggcgtttgtgaggcgatggggggtttctggtgctgcttttcgtgggtggtttctgggggtctcccgggtggaggcaatgtgatttctggatcgaattctgctacttccggtgccggagagttttttttttctctcgagattttgtttcgcttggaaattgagatcttgaggtgttctccctcaatcgtaagcagtgttctagctacccctttcgatgggatatagttcgagctctcaccatggtttaatttcaaacatggagtaggcgtggtttgatttcaagtatggagtaggttcatatatggcggggcaaaacatggcaggaacttgtaacttgtgaatattttatttgaattttcattcagtcgtgtgacagatggcaactgggtgtaacgattctgattgagaatatttatctcctcaaatttcagatagaggcatcgttcccagcattgggttccacggagaattgccaatttggatatctgatccaattgttagttggattgaccgtttcagagtgcctgcagttggctgctggattggtcaatataagaaaaccgttggtttcggagatgatgc

SEQ ID NO: 1168 - DNA, 1501 bp, Oryza sativa
cctagatagatatatgtctagatttattaacatcaatataaatgtgggaaatgctagaatgacttatattgtgaaacggaggaagtaaggtataaactacccagacaagtgatgctagagctttgccttttgctttgttcaaaagtgatacgcattagaagctttgttaaaaggagcgaaactcaaactagggacaatatattcataccagttgcatcgatcactggtgctaagctccatctatcttctgcctgatatcctcagacacgcactttgcttattgcctcaatttcactatcatttcttaattggtctctctccctttctctcccagctccaaatgagaagtgattcttctgtcccttctctctaactagtaaaatttcaatctttttttctgtttggagaaccgatctaaatttttcgaagaaaccaacactgaatgcatgtctttttgtagggtgtgatgctgattggtgagatctgggttccacttgccctgatttgctggtcttgagggcaattcattatgctccgagaggtatttattggcaaaaatattgttttcaatatgatttatgcacaagatgatttatcgattcatgtatgacggggctcacctggacgcgatgccacctgacgcagcacgtcctgctgttctctcttctatgtgtgttgctatttttgtccaacactgataagtttttaagtagtattaccttcattttttaatatataatacaaataactttttttaatatgtttgactattcgtctttataatcattatttattttttatgatgttttatgattaaggttattcaagcatgacttatatttttaaaatgttggcacaaagtttttggataagataaatatctaaaagttaacgacatcatatattaaaaaacgaaaggagtacgtggctaaggttctcatcgtttgagctttggctctaccgtaaagcacacaaaactcaacatttaagcatatactaaatatatgtacaatttattttaagatttatttcctcaaaacttacaaattttccacgcgcaagttggtaatcgaactcaagacttgctgcttgcaagtcaacggcactagccacttgggatgctgtgttttttgaaaaaggaaatgatcaagttacatataatttttttttaaactaaaccggcagggaactgcaaattatatttcaattaagcagaagtaaaaaactagacgggttacagaaaaagaaaaaataacctctcggcaagtagactcgccaagcccctcaaccacgaccggtacaaacaacacaacacactgagcaccacacaactctaaccaaactacgacggcagaatccaaaggcgaacatcgatgtcgaaaagctgaagaagcggcatacaactttgacatcacaaggcacgtgtcatcgttgccaacctttgccgcccagcgacccagagctccgactccacggcgatcataacatcattggaggcacc

SEQ ID NO: 1169 - DNA, 1501 bp, Oryza sativa
actcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgaaaccatgtgtcttctagggacttaagtacatctgttaaagcagtgtgcgcatggcgtatgcccaatactttggaaatttctttattcacaatatgcaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgtatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 1170 - DNA, 1501 bp, Oryza sativa
gtttcagcacgaaaaggaaaagggaatttaatttacttttccaattaaattaatcactaaaataatgcttgaattgttaaaaatacttccaattctcgaataatttcaagaaaaattcagaaagtacttgaacactataagtatttaaaaaattatgaacagaccatttaatgattaatttaatatttaaataattgctgaattgctctttgtattattaaaattagtaattgagctctgaaaaatccgagaaaattccagagagtataattaaccacagagaatttaataaaaattaaattcagcaaagctttatatttaggaaattttatttcccaaatttaacttcacttgtaaattaatgaataattaatataaattctaataacaatttataaatcctaaaacgaaaatcaggatgtgacactgttactctggattctcttcaaatggccaagttatgactataactggacttcgactaacggtgtagcgattctcccactacttatgcaatttgttaagtacaaccatacacctggtcttcgcctagtgtgcttgttgtgtcatcatctacgtcaatttctgtaagtgtttatatgtacaatatttgtccgttgatcctcttttcttacatcgcctcgtcttgaagtcagtcctattgttcctttacgctgttctgacagagcctccgagaaacctaaggggatttcggctagggacgcccagagttgataaggctttgttagatgctgcagagccaaacgaccatgtcagagtgctcactggatgtgtattaactaagccgtgtaatcgagaattggttttcccaacttcacggctgggggctaggatttgccatcctcagcttggttcgttataagatttaagttgcctttgtggaaaatggtttttccaaaaaagcagctgggggctaggagtactgtcgcaccctgaagttcccctccttgctttaaaatccttaaaatgaatcctccgaagaaatgatttaatttaacctagagttgaatctttaattaataaatgcatttaataaacggaatcgacatgtggaatttttcttggattctacatgtcaaaatatgctaacaggatttttagtggaattttcagagccttggaaataattttaacccattagaataatcaaagtgcaatatttaatccctgggaattcctttttttttctttttctttttctctcttgttgggccgtcggcccatcacctcccgcgcccccttccttaccgggccggcccgttttccctcctcctcccgaaggccaggccgactccccctctctccctcgggcgctgacaggtggggccacctgtcagccccttccccaacctccagccgctccccaagccggcgaccgccgcgccgcccactttctccgccttccccgcgcccccactcccgcacaccccgcctttaccgcacccacgcccccactcccgctcgcgcccacgttgcaaga

SEQ ID NO: 1171 - DNA, 1501 bp, Oryza sativa
tgcttgggattctatttaggaattcctgggcgtgacaagtaccgaactccgtttgctgaggacaagtctggcgagaatactcttttattgccacacgcagattcaatttattctcaaattttccatacatattataccatgatacccttgatcgttcgctcgggggctatttctgtttaatattttgttctattgatttcaggaaaattccattcaacgttgtcgaggactctaggtctctatgatcttacatcaggatcgactaaagcgagttcagcaaatgttttgagtattgatttcaggaaagtcggacattagaacagtcaagtcaaatttcagggctttgtcgcacactttacgactactcgattactcaaggacggttgatggagctcgacaaggaatatggaaagaagcgatggtgtacccgctgagataaaatttcttgacttcaatccaaattctcgattacgataagacaggagacttagtcgcatgctccataccttttcagttgacatcgtgattaacctagacaaaaccagtatggcgctgttgatggctgttaagtaccaaattaacgccgtcaatacctgcataaaaccataaaagtaaaacattcaatgtagtggtagggtttatttctaaccatttccacgagtgttggtgtatatttggatgcaggtgacgaaccaccaaagttgagacaaaaaatacatagaggaggatgtgaattaaacatccatattccagcctatggagctttggacccaaaaacctaatgaaacacattcaaatgggccaattgcaagtacatttgggctaaggggttatccaccaaagcctatgagaaaattcggagcaaaatgggctagaaagggtttggccgaaccaagtggttcggccgaacccctagctgcgccgttcggccccaaacttcacaggccggcagttaccgacttgccacgacagtttctaccgactttacttgaataaccgtcatctgctggacacatggcactaggaggataaagatgctcattggatgcttggaggatctccactctctcaagtcacctccacactataaatacccttctcctctccctcattcacacacaccaaagcacgagctgaattacaagaggctctagtgtactttattgtatattagaatagggagagagaaaggtagaaggaatcggaggaatcccggagttgtctgttatctcctcttacttttgtatcttgttaattactctgctttaatagaaacattattctgagcaattaaggtttgcttagtgagaattacttcttggttagttaattgcgtagacgcggtgtctgggtaattaatctccagtggttgctgcatatcctacagtacgtttgaggtgggtatagaggtggtgacagccctcaagagcacttaagtcctccctgtccgggtacatagtagagcgacatctgggaacagcgggttgccagtgcctaaagt

SEQ ID NO: 1172 - DNA, 1501 bp, Oryza sativa
tgttgcatgacgggtgtgttttctccttaaaacacttgcatacgcatatttcaccaacactagtggaaatgattagtaataatccctaccactgagttggataccatattttatttcattatatgcaagcattgatggtccaatattatgatttaagaactgtcaatagtggttttcatacaaaatccttgcatacatatatttcaccgatacttgtgaaaatgattagtaatagccactaccactaggtttgatgttttatttcaattgcttatatgtaggaattgatggtcggatttggtatttaaggaccatcaacagggttcatctctccctccttaccatgcacagggctgtggttccctctgacgggtgtggcaatggcctctcccctccctagcgctgcagtgaccagcactacctaagccagcgccacccctcaagctcggaagtgatgagcactgccgactgccaacgttgatgcctctcaccaaagctaggcggcggcaatagagtaggcgaggaatactacaccatgacataaaattaccggcagatgtgtattagcaaaaatatagaattatctactaactacctgttggtaaaaggtttgaatggaccatatgtcagcaatgctacaatataggagtaggaatctatttctgtcagcaattctatataacttcaggtcaaagtatatgtcggtaatactaactttaaagtcagactatgtgttggtaaaacttgccaatccatcatgtgccaccaaagtttcatccgtgtgtcacgcccgtgataaattcatcccgaaataaaaatcattctctaaatggaataatagaattaattaaaattcgaaaagaaattggcaaatactaaaatacgtacaagaaaaattcgaatgttgtccggagattttttgttaaattctccgtggtctaaaaagagccctcaaattttacttgaattttcagagcaccgaaaatattattaagcaacaaaaacaattatcagagtttattaaaaagaaaaacctaaaattaatccccctcctccctttgggccaagtctggtccaaagtcctcccactctctcccggcccgcggccaaagtcctcccttcctccctctctttctctccctctccttctctccctccttctcttgggcctccccttcccctcccggcccactccctcctctcctcctccttctgggccgcccctcccctccctccttccctctcggcccagacgcccggcccaaatcaggccgagccgaaccagccgcgtgcacgcgcgccgattgcgaccgcgtgggtcccacccccggtcgtcgtcaacctccagccgcccggcctccttcctctctctctctcccgtgcaaacatagctccttcctccccccaaatccgcctcaatccaatgcctacattcaaattaaattaggggaatggaaaccccattactccctcttcaattcccctaatttttccccttgaa

SEQ ID NO: 1173 - DNA, 1501 bp, Oryza sativa
ggagaaagaacacgaaggacaactcaacggtcatttctgtgcatcaaagatgggaggagaaccggtgaaatgaaactgtagcactatggcagtatattcgctactgacatgagcccaaattgatgactccaaattaacatcaccagcaatcaccatgaccagctttgcagctagaaaatgctagtgtccacaccgtggttgttagctccattgggctagaaactctcacttcccaaaagaagaaatatttgtaagaaattcctcgattgcccccaattgagcttgttgataacttgagcacttccatgagctgcattcaaaatcacaaacaagtgcaaccaggttgtcttcactggattcccctttcttgatgggagccgttccataagaagaaaaacaaatagctctaaccaaaggtcttcatcaaccatcatgtttgtcggagaagaaagcgaagaagaactcgacgaccatttgtgcgcagcaaagataggaggagaaccatgtcccactgggcgtgccattttgtttggagaggaaaaaaaatttaatttttttctctccaaacatgcagctagccacagtggtgactgtaacttaggattggtttggtttaatttgtagcctaaatagactttaccaaattttgtcagtgctaaattttggtaagttttggcattaactaattttgataaggcaaagttgtgtttggattgaagtcaaaatagcctaagttcactattgaaatggcctattttcttaggcatgccgaaatttggcttcaaaccaaatagacactaaacactattaaaattgccaaatattggtaagcctaatttaggtctcaaaccaaaccagctcttaaggactgcactcgtttcaggctatccattttgatgatgaacattcattttgatgaaaaactgaccaatggccagtttgtattgtttgctccaaaaccacaagatactactcactttcctccatctgtgggagtaattgatggtcaaccactcttggatagtgacattgatgatttgcttctcatgatgaaattgcagctctgtggcatattctgtgcaggtatatatatgaaaattctagagacttcccaatcctaagctagtaagttgcaaattgtcttaaggaaataaagatggatgtatatgaggatgctcctagcgttgcatgttttgtgtgacaagagtgaagtgcttatgtgtagaaggccctcgagctatttgtgaagttggctgtttgtttacgtagtttatatatggtcacgtatcttaattattacatatatactagttattccctccgtttcacaatgaaagtcattctagcattttccacatttatattggtgctaatgaatctagacatacatatctatctagattcattagcaccaatatgaatgtgggaaatgttagaatgacttatattgttaaacggaggaagtataaatgtaggccattttacattcgtgtgccatgat

SEQ ID NO: 1174 - DNA, 1501 bp, Oryza sativa
tgctgccccgttgtggctctatatctgggacatgggtttgcatacatggctagatggtgctgatgctaattattatggtagtgcgcccctagctggatatcgaacggtggtggcagtcgatgaaataaatttgacaggaataagagatggcgaattgatgaggcataggtggaaaggagcacatggccttgggagaaataatcctacaagtcggtgtagatcgtgcttcaaacaagagtgcactttaaattcaatttaattttaattggcaggtgcacatgttgttacagtcatgcaacatgagagctacaggtgagaggatgtccttgggcaagcgctgatggagatttggagggtgtgcttgacactggtggagaaaccatctttggtcggtcgaccagatttcacaatagtctcggttgtattaaaaattgggactataaatatctttagtcccggtttaaaaactccaggggtactttccaatctttaagtaccggttggtgttaccaaccgggactaaagatctatttgtagtcccggttgataacaccaaccgggaaaaaagatcgccatacgctttactcccggttggtaaccgggactaaaaatctatttgtagtcccggttggtgttaccaaccgggaaaaaagatcaacgcggagatcggagaggcgtgccgatcagatcgaggtatctcctcctctcctttaactcctctctcctcctctcctcaaccttatctgttcctctccttatctattcctctccttctcctctccttctcctctctactgcagtggtggggcgaggatgccaggccggagtgaagcggcagggcgaggatgccaggccggcgcgagggcagcggggcgtggagggccggccagcgcggcagcggcgcggcgcgcggcgaggcggcgcctactttggcggttttttttttgggagaatctgatattgttgtgtgatgtatttgattggatctgagattgttgtgtgatgtatttgatttgtatgcgatgtggatttgtgatgaattttgtagaagttgtgatgtaatttttttaagattttgtgatgtatttgatatgatcgatttgtgtatttggaggcaattcggggatgattgattaatgaaatcattgtcatgattaatatatttgtgatgaacaattggctgtgcagatgatttaatcaatgaattggtttgagaatttatgtgaatgttggtgtgagtgcgtgtgactaatgtgggtcaggttgtgatatctgtgcccaggaacggttgttttgtctgattgtgtgcaggtgacttgaggtcagccttggtcaatagtgaggaccgggactatgctcagggaggagtagaggtctagtgctgtcgaggaatgatcctctctagcgggtgacagtgagatcccccttttgtgagtttggccgggggaaaaggcacgcttgacgaaatcgtttatctgccctgagtgcttcgagatcgtgc

SEQ ID NO: 1175 - DNA, 1501 bp, Oryza sativa
aaaaaaaatacacgtgtaggtgtgactttacaatattttttacatgctaaaaaggtgaaatgagctacattggttaggacatacgtatatactaaaactttggaaaatcaaatgcacccaatcatcttgatgaaagttgatgaaatatactttttcccatatcctatcttactataaagttatgacccactaaccctaaagctcaacatgcaaacatgccacctcatcatccactagcaataaatacatgcaaaacttatgcaagcatgcaacatcatctataatttattgaattatacaaatcaacatccaatcatcttccttcacattatttttcacaatatttttaacatttatattcattcatataatcaaagtgtgggatatcatatttcatctacaatctcatacatatcatatttctctctgaacatagtttgacaaaccatttttatttgttgctaataactaatataaattttacttttagatcgattattaaaaaaaatattaaaagttacttagaaatttcggcagcaaagcgcggggaatcacctagtatcttatataaataacatatattcaaaaccatgctcgcatatagctccacaacaatattttggagtacacatgtatgccttattttaacaccagcctattacaaaaaactaaccacagaaaattaattattcgctcgctcaaacgtggcgtgatctcttttaagagataattatttagaggttcataattctcatgtgacccaacacaagagtatgcatgcctcttacttagagttggatgccactcttatattcagagccagcagtgaagctttcggggatgacatcatcgacgacgcggtagccgccattcttgacaaggaagcggacagagaaggggcccttgagcggcgcctcacttttgatcgtccaggtgttagatgatgactccttgagcgccacccagtccttgccacccttctccttgatctccacctcagagatggcgacgttggtgacaagctctagactactggcgctagagccctcagcgaccttgaaggtgagctcagtggcacatgagccaacaaccaacagtgctgccaccgccacggcaagccggaaagaggacaacgaggccattggctagctagtttatttgttggtgtaatcttccttgtttcttgactggtagagggatggatcgatatgtttggtgatacatgttacagttgggtgcgtatttatggtggagggagggtaagcaaactaggcatagatgcacggtgcagcgtggagatcgttggtagactttttcattgaggggttcttatacaattgctataaacagatgctagttgggtggtcccggttgtttcgctagcctagggcatgcaggcctcccaaaaatcagctatgtggtcccatttcttctctacttattttttttaaaacttagaataatgataattaatcacctcctcatgatctgttcatggagc

SEQ ID NO: 1176 - DNA, 1501 bp, Oryza sativa
aactgtttttacaattgtaattttagttataaatcactgtaagttttatactttttggatttattacatgttgtatcaactgaacttacaaatgtaattttagatataaagcactgtaatttttggccataatatttaggtcaaattatgattgttagcctagaatggttttgcatatatttttaaaatttttgtatttaggcacatatgtgattgtatttatgtgtgtttggtattgagtggcaagtgaatggagtggtatatatgtgattattatatttggctatgtagttgaagtttttgaaattgtgagatgttttgtacttgaataagtagtgtagtgtttcaataccttttttctccatggatccaaccttgactggttcagtaaatttcattcttgcaaaattcatggaataaattagtatacatgtccactgaaaccatcttactagaatgttaagtattacatatttatttacatagcttattcacaaaaattacagtgaagttacacgcaatataaattgtttttacaactgtaatttctaattttaattttaatttcaaatcactgtaatttctacttccagtgtttgattttgcatatgtatggcagcatggatagtgctatttaagattgggtgctatgttaatgtgttttgagtgtttaacccttttctagttttgataacaatggtgtgaaagtagtagtgtttaacccttaatgtattttttaatattttgcatccttcaccctgcagctgaacattttcctgtgatttttttttcaaagttgtactatgatattttttaaaatttctacatgatgttcagatcaacatagtatgtgatttttttaaaagaaaatacctaattgtagtttttccttgtttgtctccctagattccttgttctgcctgatgctaattttgacaggatctgcatatgacttcatttctgcaaaattttattgaatgtattagaatacagcaatacatcatagagtaatacattataacttacacaacaaatgtataaaaattacagtacacttacatacacaatgacctgaattttcaaatgtaattttagttatgtaggactgtaatttttgtattccatgtgtatcatctagttatgttgatctaatgaatctatcctgatctagagatatagatttgatgtgcataaatgattctcaatgatgatgtaactgttgtataatgcatatatacttgtagttgtattagtgaaataagtactaaaatattgtggatcgggctctgcatgtactaagattgtttatatggcagatcgagtcatcacacatttccaagatattgagtaccctagattgtttactatgatgttcttggactgatattcttttaatcctagatttgatttgaatggattattggagggtcctactcctatataattcctgaatgttctgtatgagaatattaaatgtgatctatggtctatattctaagcc

SEQ ID NO: 1177 - DNA, 1501 bp, Oryza sativa
cgcgccgcgccgctgccgcgctggccggccctccacgccccgctgccctcgcgccggcctggcatcctcgccctgccgcttcactccggcctggcatcctcgccccaccactgcagtagagaggagaaggagaggagaaggagaggaatagataaggagaggaacagataaggttgaggagaggaggagagaggagttaaaggagaggaggagatacctcgatctgatcggcacgcctctccgatctccgcgttgatcttttttcccggttggtaacaccaaccgggactacaaatagatttttagtcccggttaccaaccgggagtaaagcgtatggcgatcttttttcccggttggtgttatcaaccgggactacaaatagatctttagtcccggttggtaacaccaaccggtacttaaagattggaaagtacccctggagtttttaaaccgggactaaagatatttatagtcccaatttttaatacaaccgagactattgtgaaatctggtcgaccgaccaaagatggtttctccaccagtgtcaagcacaccctccaaatctccatcagcgcttgcccaaggacatcctctcacctgtagctctcatgttgcatgactgtaacaacatgtgcacctgccaattaaaattaaattgaatttaaagtgcactcttgtttgaagcacgatctacaccgacttgtaggattatttctcccaaggccatgtgctcctttccacctatgcctcatcaattcgccatctcttattcctgtcaaatttatttcatcgactgccaccaccgttcgatatccagctaggggcgcactaccataataattagcatcagcaccatctagccatgtatgcaaacccatgtcccagatatagagccacaacggggcagcacctgggaccctccatcaccgccatggtgccatcaacattgaactgttgattgcccctctgccaagaatactatatatgcatgccacacggtgcccctcagtgccttgctcatcattcctaaccattttctcggccacccatctatcttccactggcatatccacccccctcccaatttgatcatgcatgggtccacatgctcaatgaacggatcatgaggaggtgactaattctcattatctataagttaaaatggctgctttttgggaggcctgcatgccctacgctagcgaaacaaccgggactaccaaccttgcatctatttaaagcaattgtataagagtccttcaacgaaaatggctgccaacgatctccatgctgcaccacacattttcttaccaccccctcccccctccaccataaatatgcacccagctgcaacatggatcaccgaacacatcgatccatccctctaccaagcaagaaacaagaaacattacaccaaaaaactagctagctagccaatggcctccatgtcctccttccgacttgccgtggcggtggctgcactattggtcattggctcacatg

SEQ ID NO: 1178 - DNA, 1501 bp, Oryza sativa
gaacctctaaataattatgtcttaaaagagatcgctccatgttcgagcgaaccattaattaattttctattaattaattttctgtggttatttttttgtaatgggctagtggcaaaataaggcatacatgtgtactccaaaatattgctgtggagctatatgcaaagcatggttttgaatatatgttatttatataagatatatgggaaaaagtatatttggtcaactttcattaagatgattgggtgcattatttgattttccaaagttttagtacataggtatgtccaaaccaatgtgttcctttcaccattttagcgtgtcaaaaatattgtagagtgacatctatacttgtttttttttttcctttctgaaaacaaattgttgattctcagccatactatgaactgaaactataagcactagccatcaacccatactatctaattatatcatcataaatattaatactttagttgcaaatgaatatttgttttttgtaattacaatagctcttatgttaaattaaaataagattttatatgaattatatataccttgttaattagtgattcctaattaatagaatacttagtggataaaattcatgatttttaattcgttttgactatgacttccaatggcatgttttcttaatacaatgtcccaatatattattgtttgtattataaataaaacaattttagtcatttttatccctcaacattggtaaaagaaaagtaatttcactgaatttgttggaggaatcatgtattttctgaagcaacgactattaatagaaacataagttattgaactgggtgaagcatatgcaacagataatatattatagtaataggataacacacctatacttatcgtgaaaacctgacataaaggatcaaaatcaaataacatataaacattataacatatagtgagaggacaccatgcactagtaggtatgaatggattcttctaggagccaaatcaagaactcttctatactgtcctatcctaatgcatatgaaatcagttattatgattcttaacattacttgttttggcccataataaaaatatcgcttataaattttaaaataatagaaaaaactgtaggatacattagtttttcctttgatcaccattggggaattgcaataatcatctattaatttggaaaatctattattttaaacaaaaaatatataatcattctctcttccatgatctagggaaataggaacaaaaataagccatgtctcgccacataccatttggaaaataatctattagtttggaaaaatcattataaacaaaatatttataatgattctctcttgcatgcatatatgtatgtatattactcctacttcactaaagccacgcatgcatcattagtggaaaaacctgctagatgcatgcatatttattgatttttttccttgccccagaccatgcatgaccgcctttataatgcaaattttccagtgcataaact

SEQ ID NO: 1179 - DNA, 1501 bp, Oryza sativa
tcatcaagatgattgggtgcatttgattttccaaagttttagtatatacgtatgtcctaaccaatgtagctcatttcacctttttagcatgtaaaaaatattgtaaagtcacacctacacgtgtattttttttcttttctgaaaacagattgttgtatcaaccatactatgacctgaaactataagcataaagcatcggtacatcgtttagtatattcagatatcagaacaaactgcaagtcacattaatctcacatatccaacacgaatgagtgataatcggagtagaatggaaatgaggtcagctttgagaggagcaaaattaagcttcatatcatatagttgggccaggcccagagctatactcaacaacaaagtttatatactactatgagaataccaatctattggaaagaatctaaaataaatatgccattagttccaaactttaaatcatttttttttacattaccagtgtgttacaaaggatctaaaaaacataccgtttaattccaaacattcaacataaagaacaaataaatctttcactcctaaaaaatgtagtggtggtttatgatctgtcctccatcatgtatgcctaacctcacgcccatgccctctcgagcaactcccgcacgcatgatgtccctttaccctatgccaatggaaacagacccccaacccccaccaccagatcaaattatacttcctacgtgcttgaccatggacctccactcacctgtaggctgtagctctcatgctgcatggatgtaacaacatgtgcatcccgaactaacttgtgcattaaatcgtcgtctaggaaagtaggaattagctgaggtatacaaactgacaatttaactatatagtaccaagaaaactaaagcaattaatacttacaaaagaggctattagtcctcaccacgaagacaattgcagcgaaaaaagaaaaaactactgaagctttgtttaggtgatgattggattcactattattttatgttttgattattattctgtgatgaacaattggcatatgtgattattggttttgatatttggagattatcgtcgaagtggttttggagataatcaatttttaggtgatgattggattcactattattttatgtgaccggtccgaccgggctgtgtatgccggtcagaccggcggtgatcgagcagtcagaccggacggcccgcggtctgaccggccgacagtgtatcggtttcggtttcgggttgttccataggatatccgtgattgtttcatagctatggcttttagatggatactataaatatgtaatactggtgtttgctaacaatgagtcgagttggggatagtttggtctcggaatatggtttttttgtttgtttcatgtgtaggtgactcgatgcctcgggagagtatttgcagtgatggactgggagtcggcttggtggtaagacgatgtccgtggtggtcagatatcatgcgggatactaaggctagagttga

SEQ ID NO: 1180 - DNA, 1501 bp, Oryza sativa
acagataaaacatgggctgcaattggcccaaacaacaaattagaaaaataaatcaaacaaagaacagatctgagaggcccaaagaagtaaagtcaaccctgtccaaaagtatgaacttagctgccaagaaagctaaaagaaaaaggacaaacacaaatccaaactaacacaccagatccaaaaaagcaacagcacgcacaccatagagaacgagtaggagagaaagaagagaaaaaaggttgaaccaaagcaaaattcttcaaatcaaagtgaaatcacaggggagaaacaagaaataaggaataaatccaaactaggtatgttccataaacctatgctcatcctcaaaattgactacaaatcttagatcatagcaccatacgtgcccccatcccatatgcataaggagtgttttgaacaaaatacagggcacagttcatacactgaaagtaaaacttacagtgcatttgcactaaaattacatttgtaaaaacagtatatataacatgtaagtgcactgtaagtttagtacaaatgcactgtaaaattatcaatcaatcaaacaagtagaccatacagaacaacttctgttgtttactacctaaaaactgaatacatctattcaaacatgaactcaggagttccagcaccaaatacatcatatattccaaaacatatctgtatcagttgggcagcacaaaaaagaaaataaaaccacaatagtaagtagtatggtgatatgggttagagacaactaacctgcatgatggctgccgggtttggtcttgatgctggataggatagttgagatccatggagtcagaactaaactaaaattaagagaacacaagcatgaattaggacatgttccacagtaaacttcagttacaaaccaattggtatagcgcacaatccatatgaaaaacaaatatatgcacaagggataaataatgaaaaacaagttcagaaactaaaaaacaacccaccaaaccaatttcacattgatatatgctcaaaagtagaaatttacattgcatttgcactaaaattacatttgtaaaaacagtacatatggcatgtaagtgcactgtaattttagtacaattgcactgtaaatttgggtaacataaatttttgcattattgaagtgtaattgataaaatgatgcttgattagtaatctgtcatacagaacacctgcatatttcactcctcaatactaggtattcactcatttaagacaaatggctggataaaattttagtgatttccaatttggaactagcaaaacagattcatagttctctatatatttggcttagaatatagaccatagatcacatttaatattctcatacagaacattcaggaattatataggagtaggaccctccaataatccattcaaatcaaatctaggattaaaagaatatcagtccaagaacatcatagtaaacaatctagggtactcaatatcttggaaatgtgtgatgactcgatct

SEQ ID NO: 1181 - DNA, 1501 bp, Oryza sativa
atgcgtcatgtcaatgtcacgtgagacaaaaacctaatcaaaagagccacgtatgtgtcatgtcaatcaaatctggagacaatattgttgagggacctcgtttgcattggttttgtaaagttgggggatacattgtatgcggttttgcggtccagggacaaatttcagactcaacgataatttgaggaacccatagtgaacttattccttcattttttatttgtttgggcccggtccatgaaaagcccatagaaacatgactccacggacaagaagccactcgtcgttaacccccctgccagtgagccaccgcgccggcgcgccgtcctccgcagtctgcaccgcaccgctcgaggggagagcgccaccgggacgagagacagcgtgaccatcctggattctaacttctgaggggtggatacaccactctagctcatggcagcgcggtgtggtgcgacgcggcgggccggcggctcgccgcgcatcgacctagcggcggcgggaatggtgcggcgcagacgggacctcgctgtccatcgagtccaaccctctctgctccaaccacagcgccggaccgccagtgccgccctgtccttctccaactctacggactggaaggggcaaggtctctggcggtgaacaattggagcttgaacaaccatggtgggttgtcaagcaatgcacccaaccccagcgctctccgaaaggtagcctccccttcgtttccagcctactgttaccttgggaaaacctggccttgctagatcgtgcactagttaattggtactgcattttgttatcatgttggaaaccatcatatgattttcccttctaaaaataaaaaacagcaggagctctgcctattcaattaagaagaacagaaagaaacatacacagtcatagaggttcttagttacaatttggaagaaatagatgcaacaactaagaaaaataacagctagaaatattcgttcctagttttattccccctagctaatctcctccctaataataatatgttgttgaaacattattcgagccctttctttctatacattctgtcaggtcctaattagttatccatggattaatcttctatcttctttggattgctcccttaccggtgcataccaccaatctttgttggacagattgtgccaattggatctttctatccaggccaaattatgagaatacgatttgccgtctattgatgaagaattgacacgctttggctaaatggatcatagtctcatcctccatgataccacaaagcgagcaagatgaactactggccatcccatgatggtaatgcttcagttttatcagtgaattgaattagtgggggtgtggcttcttctgccttagatgttcaatttattcaaattctaacaactatttttttgtctactgtcttacccttaatatggctttatgtttgtttaattgtagacaatacttcagttcatattttggtcaatgaactgggaagatacttgta

SEQ ID NO: 1182 - DNA, 1501 bp, Oryza sativa
ctcgggcctgttgtttaatggacagacgatttgcgtcctactgtacaatcccgtttactaatatataaaaagtgctccatttcaactagtatggtggtgtttgaatcttacgaagataaagacgaagataaaaattaagtgtttcacgtaaaacgaggtggtaataacatataattaattgagttttaattattataaacttgaaaaatggattaatctgatattatagaacaactttcatatagaaaattttcgcacgaaacacactgtttatcagtttgaaaagcgtaccacgaaaatccaaaactttatccactgcttgtagtggaaacgaacttataagagcaggtacaatagcatactattagccatattttaatgagataaaagatgagagagaaggcagtgggctatagatttgtagccagctgcagcacggactccaagacgcagtgtgtgtatgacaggtgggaccatatattaatagtatagtaagtaactattgtattaattggctattacattggctatagatgaattggagctaatagtgggctatactattaaacttactctaaggctgtgttcagaatactcttctactccctcgttttgtgtgcgtgttttcccaattgctaagaggtggaataatatgtttttttaaaaaaggtctatagaaaagatgctttgaaaaatcatattgattcatttttatttttaacttatacgtaactagttaccctctccgtttaaaaaaaaaacaaaccttgaacaggatgtgacacatcctaccactagaatactccctgcattctataatataagacacaactacttttaaaaattgttttcataatataagacatgcatgcatgcatgtcattaactagcacacattttccactaaaatattattatttaaatcctccaccatcaagatctctaattttattaggtgcatgcgttctatttattaggtaatctaaacgatgaggtgataataattatttcttgatctttaggttaagggtggttatgtcttatattttgaaatagaggaagtatgtcacaacatgttctagttttagttttgtttttcatgagacggaggaagtatatgctgattatttttttaaaaaaatacataattttttaaaataagatggatggccaaacgttagataaaaacccaaaaaataaaatctttatgggaagaaaggagtaattaggctgcgttcaggaggaggggctgggaacccctcctctttggcacgcaaaacgatgttcacattaacacgtgattaattaagtattagctatttttttttaaaaaaagatcaatataattttttaagcaactttcgtatagaaacttttttgtaaaataaaatttgaaaagcgtgcatgcagaaaacgatggtggggagttgggagttcccagcaaagaacgcagccaaaagttatcttgttctctatgcgggatgaatgtgttaggttcaca

SEQ ID NO: 1183 - DNA, 1501 bp, Oryza sativa
gccggtccagcattgtagctagtatatttgcaaattaagtacatggttgatgcgtacagctgcagcttcgtcccgatgaggacaaacaaataccgtcagtgatatatatagtacatgtgctgttgatgccgacctttgccaaacttaatccatctcgacgtaattcactctctccgacttatattaaagaatctttaacttttctctaagtcagcttttttaaaaaaaaattaacataatttataatatttctaacacaaaataaacttactacgaaaatacattcaatgctaaaaactaattcagggttatatgttgctattttttatgtaagttttatcaaattttaaaatgttatatatatgtcttatattgctaaactgatcgatggagtatttctcctgtgtggctatatatacttgcctcctactagcactctacatctcctttactgatattttgtgtagccgtctgagccgtctgagccatgcatgcatataaaaatgtaggaatagtaaaaacataagaatattataggaatgtatgtgtaaaatagagaaataaaaaatatacgaatttcttgttcttcgtgcgaagaattcttacaacaaagagggtagatcgagtggactatttttatgtgaaaatatgggcaaccctttgaaatgaatgcatctacaagatctaattcaaaggaatcatcaatcctctatttttctatttttccttcacatttcctcccttcggaatgagcccttacggcttgtttggttggagggagtttttagaagggattgggagtttagagggatgaggctataagtgttttgtttggttgggagacatgtgaattttggtgggatggggatggggaattgaggaaggaactccctccttttcaatacctgggtaggggcaggtaattgggagagaattcctcatttactttttctaagcaaatctcagccatccgtttttattaatgacctaatctccaactaaactccctatcaatttctatcacctctccaaacaagatattaggattaaaaatcaaattcccatcttaatctcatcatcaattccctcgtgtaaactcccgatccctttccctcgagttaccaaacaagccgttagtaggcagtagtaggagtagaagaacagccagttacccccactagctagtaggagtacgtcttgtacgtcgtatgcatgcatctgatcggccgaattgagaaggatggatgtgtttgggtggagggggtggagaaaattaagaaggatacctaaaacaagataagtcatagcatgttattaattaagtattaataatttagaacttaaaaggaacatattaatataattttttaaacaactttaatatagatgtacttctttaatctttataaaaaacactataatctcctgtatcacgggaggcccatcgatcgtaggatgtggtgtcatgtatagtagccaacccggccggccagtgcgtgca

SEQ ID NO: 1184 - DNA, 1501 bp, Oryza sativa
caggatagcaaatcagcaagtaatgtgattctctgtgttagggatctttcaagactacttgcataaaagcgagggtagaagcagtattccatcttttatgatgcattaataaaatgggtactggtcttctaaaaataatcacgggcttatgagttgagcaatagtgaggtttaaccattccagaccccacccccaccccattcccaaaaccacaaacacaaacacaaaaggtaagatagtgtggtcaagtcttgaatctcaagtaaggaaactttggtgttgcatctatctcattttatattatcagctgtagcatttcttctaactcatagaaagtagttaagcaaaggctgtatgggatgacagtaaaaattaatggaaggcaacctaccaaaaaatagaatcggtaactctgacagatatcgactataatcacagttttaatgtgattgttttcaataaattaaattcaatagataaacattgtccatcaaataaatggcataagtggtaacatgacagattgaattcaatccaatcaaaagaaaaaataacaagcaagtttaatggataaaaagaataatgcaaaaacattaaagtagagtgcaggctaacagtagctatgctttttagtgcaatgcagtcggttcttctatcataacggaacctgcaagagaaaacaaatccattaaaactgacaaaataactagatatcattactgaaacaactagataaatagttatatcatgtaaacttacactttgataaccagcacaccaacaatattaagttctttgcgccaggtttctatcaccgtgactgggcaaatgatcattgcgttgtgtatgacatctgcctggagcaaaccacgaagaaaagcagctacctggaacataaacaaaataaaatgcatttatatagctaattttggggcgtgtggtgcctaatgttggataagtctttgtggtccttggtcgtgattcttctttttgcttttggatagtttcacctttttcaggacagcatctaccctttagcatatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatgtatccaacctccctcgggtaggtatggcttttgtgtttagtgaatgaagaaaaccagaaaattgccccatctcgagtgccatcctcttctcaatgagagtaaccattgaaattctaacatctggtatcagagccatactttcctgtagactaaacatctcttgttccaccccctcccaagctcggttgagctcttagccagcagcagcaacagcaccggttgctcctccttcccctttcccttccccctctccacgcagcagccccccggaggtgcgcca

SEQ ID NO: 1185 - DNA, 1501 bp, Oryza sativa
cctccactctcagatgcagcagtacggcggcggcgaccgcctaatggatccatcacggcacaacaccgggtctaccggtagattggttggatcttggggggacggtgagggttccggcggctcctcctgggatgggagaaggggaattggggaattctgtgttgcgggggcacatgccacgggggtgatttttatttattttggtcctgtttggctaatgggaaatcatttcccatccactaaaagacatctttaaatcttaatcattcattctcccttttccatttaattctaacccttcattcatttctcaatcccaattccactccacattttccattatccaaacacaccctaaggtttgcccccacaggcccacatgtcaaacgcgacattcgcggcccgtcaagcacatgaaaagaaaaggtagggggggggggttaagttcactataggtccctcaatttgtcccaactttcaaaggaaaaagtacacccaaggtccctcaacttgtcatcgagttacaaaatcgtcccacaaccgcaaaaccagatatatgatatctctcaacttacaaaaccgttcactttaggtccctcggtggttttgaccgcggttttgtctgacgtgacggctgaatcagcgtggaacccatgtgggccccacatgccaggattccacgtcatcaccctatctctttcccctcctctcccttcctcctctctctctttctctctctctctcacttttctcctcttgggcaggccggccggtgggtggggaggtggtcgccgacagcgggatgcagtggctgcggcgcgtacctggccgtgccgccgggggcgcggtcggtgcgatgcgcgctctgccatgccgtgacgcgcgtccctcggccgcgccagccacagcgagcttagcgctcggagccacgagaagtagtcgttgatgacgagcagcgcccgcgccgcctgcctcgtggttaggatccgatgcatctgctgcctcagcagatcagcctacacaaaaatatcatcgcatcacgccatggtaataagcaatttagttcgccattgatgtttgaccgaagcttgaggaagttctccagcgtggtgagcatggccatggcgatggccatctgtcccatgtagttggtgacgttgtcggcgcctacaccgccgacgaccacggtggcggccgccgatgccagtgtgtctcctagcgtctgctgcagagcctccatcccctgtgacagcgcgtcctcggcctgctgcgacgactgctgcaggttgcagatgcccatcaactgctgattcgtcagcggctcaagatggctctcaagtacctgcacaaacaacatcatcatcatcattcaacaatagcagtcaatggtagcttcagattctttgcttgttactgaattgggtgggtgatcactcgtgtcaaaccttgaggagctcagagcaacagaagccgccgagccacatgaagaagcgctcagcgt

SEQ ID NO: 1186 - DNA, 1501 bp, Oryza sativa
gagtttatcgtcctgttaatcttcttttttataatttttagaagtcccatcaaacgtttccattatactcctctacaaccgtccactgcataccttatcatcctcgtgtttctaattttatagtttttaaaagtcacaccggttgctaccccttgcttctgttatattattctttattagcttgctcgatctaccactgtttctattcattctccttggaacgtttcaaaattggatctaaaaacttatagtttttagagtttattgtcaagttaggcttcttttttataactctagaagtcccatcaaacgctaccattatactcctctagaaccgtccactgcatcttctctttattgttattgctatttgaaaaatcgaacataattatcgtttaggtttatttttttactttcttgaagttccgccaaaacgtcagagactttgtcactgtactcctctacagctcgcccgctgccgcccttctttattgtcattgagattttaaaatcaaacatgattatcattgaggtttatttttttttactttttagaagcccgaacctttaaaaattgaatcttatagttttagagtttattgtctcgttgggtttctttttttatataatttttagaaatcccgtcaaacgctaccactatactcctctacgacccgtccgccacatactctttattatcactgggattataaaaatctaacataactaccgttggaattcatttttactttctagaagacccaccaaccatcggcggctctgccattgtattcctatacgaccttcccgctgcctctcttttttattgtaattgagattttaaaaatcaaatatgattatcattggggtttatttttttacttcctaaaagtctcgccaatcgccttgaccgatttgctacacgacctgccccgtcgtcattccttttaatcgtcattaggattgtatttggtgttttattaatactttttagatgtctcatcaaccgccaccactttgctcctctataggcctgttacttaaataatctcgtcatgtgttttagatggtcttttctttcagtagtcttattttttttatcaccaattgtagttatttataaattgtattcctagttgaaatcttatttttctctttctaatttcagaattaattttatttttcttattgtgttcttttgatatttgtattttttttgttttcaatttcagttgtttcaaaattgtattcctactctaactctcttttcaatttgtctaatttctgattttattttattttatttttttattccgcattttaattaatctactattgggttcttatatgtactcttatttaaatattgcttatatttaatttcaaatttaagttaattttaaattgtattcctacctgaactcttcttttcttttcttttttctaattttgattttttattctgaattttaattaatcttgtattggattcttttatgga

SEQ ID NO: 1187 - DNA, 1501 bp, Oryza sativa
tgacttgctaaatcaaatggatagctggctatatagatgtttggagagtctattttagagagactgttggagatgctctaacaacccaaagatgaggtcccgcatcttgtggatgagccacgctgagcgcttcttcatgtggctcggcggcttctgttgctctgagctcctcaaggtttgacacgagtgatcacccacccaattcagtaacaagcaaagaatctgaagctaccattgactgctattgttgaatgatgatgatgatgttgtttgtgcaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggtcaaacatcaatggcgaactaaattgcttattaccatggcgtgatgcgatgatatttttgtgtaggctgatctgctgaggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttgagagatatcatatatctggttttgcggttgtgggacgattttgtaactcgatgacaagttgagggaccttgggtgtactttttcctttgaaagttgggacaaattgagggacctatagtgaacttaaccccccccccctaccttttcttttcatgtgcttgacgggccgcgaatgtcgcgtttgacatgtgggcctgtgggggcaaaccttagggtgtgtttggataatggaaaatgtggagtggaattgggattgagaaatgaatgaagggttagaattaaatggaaaagggagaatgaatgattaagatttaaagatgtcttttagtggatgggaaatgatttcccattagccaaacaggaccaaaataaataaaaatcacccccgtggcatgtgcccccgcaacacagaattccccaattccccttctcccatcccaggaggagc

SEQ ID NO: 1188 - DNA, 1501 bp, Oryza sativa
agttgtacttactttataattttaattttaataaaaatggattacagcttggatcaagttttgttatcagagcttttttttgaattatctttttaccttggaccaattaactttatatttatttttcaatttaagatcattatctatcagaatttaaatcgtagtgacaaggtttcaatataatttgagtaaatttcataaaactacaggtattttgaccaaattttcacaaaactacagatttaaggagttgtatcacaaaactacatatttagcactaaatttatcacaaaactacagattttagattaagtatcataaaaatgcatatttaatattgagcttatcacaaaaataccacttttggagtttaaatccctagcaccattgttatggtggagctataaacatcattactttgtgattaaattgattctaaacatgtagttttgtgataatttagttactaatatgtagttttgtggcacttcatcttaaatgtgtagttttgtgataaatttggtgttaaatgtgtagttttgtgatacaccgagttaaatctgtagttttatgataatttggtcatagtatctgtagttttgtgaaatttactcatataattttaatgggacacgctgatcccgttcgtcaccataagcttgtctcatagacgtatccacgcgtatacgggtgttcgcggatcatctccatctcatatactccatctgtcaaaaaaaaaaaaaaagccaacctagtagattcaaacaccactatagactaggatgtgccatatcttagtgctaagttggctttttttttcaaccgagggagtgcatgtcttacaagacaaatttgtgcatatgtgagcgtggtgtgatgtgtcgtgggtttaagggacaaataagaaaagaagatgcttttcataatgttctaaaaaaagagatggttttcagaagcatcgcacgcaaggggcaatgtggctattagaacagtcactctccacccttagctacagctactacaagttgagacgacgttgatgttgatctcgtcgtcacaagtgagaccgggactagtactcggaccagagaagacaaacactacgacatgatagatgcggcctcctcctcccttcgtgcgcctcgaaccctccgcgaagccgccaacccccacccctctccccctttaaatcgctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcgg

SEQ ID NO: 1189 - DNA, 1501 bp, Oryza sativa
tgcagcgtaaataataaagaaaaaaaataattatttgtttgcagtttcgtgtgatcatttggcaaggactattcagtttgcatggtcattttcccagtttattcattgaattatgtaattggattatttgtgctacacttccttgtctttggattatttaaacatattatttgcgcttctcaaaatatttttctattttaagatatttgttaaatttatttcttaaataatttattctctctataatcaaaacgataatctgttcaatattctaatcaaataaaactttaaggccccctttgattgaaaggaaattcataggaattttagaggattttattcctatagaaatttttcctacaaagcattttgaattaaaggaatgaaccctatgaaattcctatgaaatgcctctttccatacaagttttagaggaattttaacaagagatagaatctcatggaagaaatcctttgagtcttttatctctcctcaaatttctgtgtttttcctgtggtccaatcaaacggtcattctttttcctgcgttttgcaatcctttgttttacactttcattcctgtcagaatcctatgtttttcatattcctccgttttttcattactgtgatttaaaaaggccctaaagctttgaggttaccgtagtgaggtgagtgtagctcaattagaaacagcgagatttgtcggtttcgttatccagttattcggatatgctatagataatgtgtgtgtatgcatatggagatgagtatgtgcgttgttacttatgaacgtatacatatttgtaccatgttcataaaatggttattgtatagacgtacagtacaacttcagtgtgtgtacaccattgtgactattatatgttggtgtactaatcgggtttttagttcccattatcttttccatggagatgtttttgttcgaattttggtcggctcagaagaagctaaagattcgaccacctaagaggcggaagctagatctagaccggtatatttttggatttttgatgtttcatacgtgctagaaaaatatttcaacttggggtaaaatggtgttgcatttgtttgaaacatgtagattttcacgattttttttaatgtttcaatcaatgtatctttgttgtttaccgcatgattgaaaaatgtttcaagtaaatttagacgatattgtaattgtttaaaacacttttttaagtctagtgatgaaacaacttctgcatttttcatgcggccgatttgtagttgcttcgttttggttagtctaaaaaaattgtgactattatacgtagtgactggagtattatacggcggctctacatataaatacccagtgatttgcctccggctgcggatccactcgatgacgtgtcactctgccatggcggctctcaccgttgggcacgcggcgatcgtccatgccaccacgcgtctcgaggacgcccggtccaccggccgtcggcggcggcggcgggggatgatca

SEQ ID NO: 1190 - DNA, 1501 bp, Oryza sativa
acgccccaactcggcgcagatatttttaaccccgcctctttctgtcgtggaggccgggggtgttttcgggatttcctcccggtcggtgtcggctgctcctgctgggctcaggttaggcccacatactttgcttcatgggccaagaaagcccaactaccatgcattttttttaccttttcccccttttttaactttccgcaacactctacgagaagccatcatcatggttaaaacaaaaaagagacagtactatacagaacaacacaaagggtggttccagatagacagaagattttccactcatgtttggaaaactaggtaaatactgtatatctctacggggacaaggataagatgttatagttggcaaagacctgaaaactgcaaacccaaacatacaaatgttacattccgaatctaatcaacaacactaaaacaacaacgctaatatcctgtgcgacgacatcatcaatgaagttatacgcttccaagctgctgcgcaattatattccttgtatgataatagcacctgcgaatgttctgcctctttcactcataaatcaactccttttgtttttgttaactgtacaccggtaacagaaacacgatcatgtgacgagatcatcaacctcagaattgaatacaaaactgggaaatgtggttgttatgtccctgaaaaatgcaagcaacaatgtttagaaatgatgttatctgcagcatgtcaaatgttcatggaaagtgcaagaatgtttgtaagtagtctagcaatctaccacactgaaaccaaatatctacagagatttacatagttgatctctttttgcaagttttagatgactgaaatagaaatataggtcaaacaatttattactgcgataaataaatgtctcatggcaactatatagcactatttaacatgagtcacatttagaagttgatgaattatgcataccttacccaatttacgccccacccaaccctcctctaattccacacatgcctagattgtgaaagttctttgtctatcttatctttttttagctagcataggctaaagtctttggtaatcggagtggcaccaataatttctatagtattggagataaacatagcagcagtaaaacacatacatatttctattttctgtcatactcgcttgaggaacgaaagagtcatagatcgcgaaagttcatttgtctatcttatcttagatggcacagacctcagtcaagctttggaaattagaatgacaccattaacttctttgaatatgggagataaagatagtagcagtaaaccgcttccatataagtattctctgcaatactcacttgaggtgtgagtgtcgtagcttacaaaagttcagtctatcttatcttttcttagatggcataggcctaagctttggaaattggaacagcaccactaatttcttagagcatggaagataaacatagtagcagtaaaatgtgtccatatttctattctctgttatactcac

SEQ ID NO: 1191 - DNA, 1501 bp, Oryza sativa
tgatggatcataaacatgctcttaactagttgcaacagctaatttcacaacaatgacaaattctctagcaggcagcagcaaatgaaatatataagttcagtcccacacctgaaatggtagtggccaagtccatgcttgacacccctcttgaattccccaatgtagcggctgccatcctcgcaggtgtgcacgccatacccatggctctgcccattggaccattctccggcgtacacatccccggtgtagaacctgtatacgccgtgcccgtgcctaagcccttgccggtactggcccctgtaccggcttcccctggcccaggtctcgacgccatagccgtcgtacttgccgtcgatccagtccccctcgtacctgccactcatgtagtagtagtagacgccgctgccggtgcagcggccgcggttgaactggccctcgtagacatcgccgttgctgtagacctggacgaaatggccggtggtgggggcggaggcggaggcggagggcgaggagccgatggaccagaggatgggggatcggcgcgggcggcggagcgggagggggaaggggagcgggaaggggaggcgcgggagggagaggcagaggaggaggaggagcgcgcaggagaaggcggcggcggagaggaagtcggcgaggagggagcgcgggaggatggccggggatggggagaggaagtagagggtcgggagggagaggaggaggaggaggcggaggcggaggtggaggcagcggaggaggtgcctcgccgccgccgccgccgcggcgggcgcgggcgacgccgcggcgggggcgaccttccggcggtgccgcggcggcgcgaacggcgacggcgacggggacggcctggtcggggtggacgaggccgaggaggaggtcatgacggggcgcttgtgaggggtggaggggagcgcatggtgggggctggaggggatgtggatgcggagggcgggagggggcccgaggtggttgggatccgaggaggggggagggtcggcggcggccgcgtccggtgatgcggcggcgggggcgacgacggggaggtggtggtggtggtgcatctaattgggatcaattcggccgggattgggggttgcttcgccggcgagggagaaggcgacatggggtgggggtgcgtggcgaggcggaggcgtgggtgggggtgggggcagccgcctcgcgcttttctctcttttctgcaccgatttttccgggtctctctctctctctctctttttttctttttttttcctctcttgtttgttctcctcctccctgagttcccgctggttctttttcccctcttgttcgatgttttttaaacgaatttattcaaattcaattctcctctgaaaactacgaattgattgtgattttttccccctttgttctagcttttaacataattcaaattgaatttgaatttgaatttcccacaacaagttgattctgtttaaacctgtgatagaaaatgattatttta

SEQ ID NO: 1192 - DNA, 1501 bp, Oryza sativa
ttatgaaatggaggaagtaggacgttacactaccaagtacgacagatcgatgtgtggttaaccgacaggagcgtgcgtgattctcatgggtggatgccgatcgatccgtgtacgacggctgattcgcccatctcgacgagaaatgcagacaccgcagtgagtcacccaagtttggattttagccgacaagtcgcaaaccctccacaccgaccacgcaccaaacaccaactaccccggaagatgataccaccacagtaaattaaattcctcgcatttttactgcatttttgtccaactccaaattccgacggaccaaacccagcaacaagcggagaccacacaaatttcttgtggagtctcgatctagaaaacgctactagcacacacatgtcatgtcaccaacatcagccatggcccaccagcagcctcacaagcgcactgtcctccatggcaatgcttgccacgtcagcacctcacgttggtccatcctcgctgacgtgccgtccacatatccgttccgtttacacgccccgtttcacccgtaagacttatccgttctcccttctctctcttcgcagccaagtgtaaaagcgtacgcgtacgtgtactgaatcttcttccactgcacccctttgatttgaccgctacgttgtcgccgtctcacccagctcgatccatctggctaactacgtggattagtagagattatcgccttagtttgattctataattacccacctatctagaagtagcttgtaattgaacaggtgtcacttgacagtactcagtacaacagagcaatggaagcgtatacaacactcaacgatcagctgcttgtgcctgctcaaaacgacgaaaaattaattgaaatctttattactttttagttccaaaaataatggataaggccattgctgctgatctaatcctcccccataatctccaaccaggaagcatgcacactagagagaaaaaaatatatacaaaaatcacatgcatactgatgcaatgctactacttgctttacttgtgagagtgccagaggaggaaagattattagtttagctttacaatcctaatcagcattgatcacttggttaagtgacgataagcacgtcgccatcacacgcatagttgagatttcctctatatatacccgcagcgactcttccctcccaaattcatttcattctcttcaaatccaagcaagaaagaaatcaaagcttctcttcttgaattcaattcaattcaattcctcatctccgatcgaatcaatcttggttagttgttaagcacctcttatctacttaattatcttcctctccggagaagctcgagctcgagatcaagtccatggcgttgacgctgcgttcatccacgtcgttcctgtcgccgctcgacccgtcctccaagcgcgaggacgcgccgccgtgctgcgtcgtccccatgccggcgccggggagcggcggcaggctgcggctcgccagggcggcgccggtgg

SEQ ID NO: 1193 - DNA, 1501 bp, Oryza sativa
ttatctcccatattcaaagaagttaatggtgtcattctaatttccaaagcttgactgaggtctgtgccatctaagataagatagacaaatgaactttcgcgatctatgactctttcgttcctcaagcgagtatgacagaaaatagaaatatgtatgtgttttactgctgctatgtttatctccaatactatagaaattattggtgccactccgattaccaaagactttagcctatgctagctaaaaaaagataagatagacaaagaactttcacaatctaggcatgtgtggaattagaggagggttgggtggggcgtaaattgggtaaggtatgcataattcatcaacttctaaatgtgactcatgttaaatagtgctatatagttgccatgagacatttatttatcgcagtaataaattgtttgacctatatttctatttcagtcatctaaaacttgcaaaaagagatcaactatgtaaatctctgtagatatttggtttcagtgtggtagattgctagactacttacaaacattcttgcactttccatgaacatttgacatgctgcagataacatcatttctaaacattgttgcttgcatttttcagggacataacaaccacatttcccagttttgtattcaattctgaggttgatgatctcgtcacatgatcgtgtttctgttaccggtgtacagttaacaaaaacaaaaggagttgatttatgagtgaaagaggcagaacattcgcaggtgctattatcatacaaggaatataattgcgcagcagcttggaagcgtataacttcattgatgatgtcgtcgcacaggatattagcgttgttgttttagtgttgttgattagattcggaatgtaacatttgtatgtttgggtttgcagttttcaggtctttgccaactataacatcttatccttgtccccgtagagatatacagtatttacctagttttccaaacatgagtggaaaatcttctgtctatctggaaccaccctttgtgttgttctgtatagtactgtctcttttttgttttaaccatgatgatggcttctcgtagagtgttgcggaaagttaaaaaagggggaaaaggtaaaaaaaatgcatggtagttgggctttcttggcccatgaagcaaagtatgtgggcctaacctgagcccagcaggagcagccgacaccgaccgggaggaaatcccgaaaacacccccggcctccacgacagaaagaggcggggttaaaaatatctgcgccgagttggggcgtcatttttgcgggaaacccccgggctcttttcgtaattacagcggccgcccacccacctcacgcacgcacacgggctccctctctcgctctcgctgtcctcctcttccccgcctcgtcaccactccgatctcttcacctcgatcctgcgccaaaccctagccccgcccgcgagcgccgccctcgccggctcgccctcagggggttgcgagagagcggaggc

SEQ ID NO: 1194 - DNA, 1501 bp, Oryza sativa
ggatcaactacttgggaaaagtggtcaaggacccacttttctagggtctaattctaactctggccattagtccttggttttccttgttgctgcacagagagagagagagagagagagagagagagagagagagagattagacagacagatccaaggtaagcagagccgcaagcgaagcacacggaaataggaggggaggcggctgcttgcaacttgtagctgcctgtcgtcgtcctcgtctacttccgatccttgtgctggtcctctccgcacaccactcttcatgcactgcttatgtatctataaaccacaagcaaaaagaaaaaaaaagttctaacaatactttgttagctgctgagtgccattattagagtgttaaaacatactattactaactgtggaatggtgggcgcccaagattgctagtgtgtgccttatcctcttggtcgttccttttgattataaaaaaaatgtacatatttcaggactgttcgatatgttgccaaaatcaaccttgttaaaacgccaaattttgatatatgttgacgttacatttttttttgcagtgttggatgtgttggtttatagcttcgtcatattttaatagagtagcatgggtagtatgtttagtttattatcctatatacccacctctctcatctttcaatgtttattgactccaagcatttggtctctctctcaaggttatattaccttgtttatgcaagcaaaagtaaataaattactagttaacttagttatatcttcatttgatcctattttaatgcttatgaacgttaaagctataaaactacacgagcaaaataataaatttgctcattaatcagcaaaaacaacaaatgacattaaattagagctaagggcgacaactacaactacaagtggagcaagacaaagacatttaaacaagaaaaaaacatttaattttcctagtcacccttatttaaataacttcaagaagacgacatgtcgtatagtgctactctacacaaatgattgttccaatttaaataatcattttcttttttagggtaaaataatcattttctatcacaggtttaaacagaatcaacttgttgtgggaaattcaaattcaaattcaatttgaattatgttaaaagctagaacaaagggggaaaaaatcacaatcaattcgtagttttcagaggagaattgaatttgaataaattcgtttaaaaaacatcgaacaagaggggaaaaagaaccagcgggaactcagggaggaggagaacaaacaagagaggaaaaaaaaagaaaaaaagagagagagagagagagacccggaaaaatcggtgcagaaaagagagaaaagcgcgaggcggctgcccccacccccacccacgcctccgcctcgccacgcacccccaccccatgtcgccttctccctcgccggcgaagcaacccccaatcccggccgaattgatcccaattagatgcaccaccaccaccacctccccgt

SEQ ID NO: 1195 - DNA, 1501 bp, Oryza sativa
attgccggtcggcacctatggtttttttaccgaaagagttttccacgtaaaattcatgtctccgttgtacatctatttttataacactccgagtccaagaaattaagaacaaaaaaaatggaggaaattagtttaggaggtgaggttgggtaggcttacttgcaggagtcgccgacgttgccgccgcactggtggaaggacatgaccatctggaggcggaggccggcgcgctccaccatgcggacgagctcgccgtagccctcccagtcgtaccgccggggcccctcccgctccaccaccccccaccacacgtccaccatcaccccctccaccccgccgctccgcagcgccgccaggctcgccgccagcgcccgcgcccgcgccaccttcccccccgcccccaccgtctccagcggcagcatcacgtacaccgccgtccccttcccccgccgctgcccctgcccgcccccgcccccgtggtgcagcagcgtcgccgcctccggtgacgccatctcctccatcgtcgcgtgctccaccggcgccgccctggcgagccgcagcctgccgccgctccccggcgccggcatggggacgacgcagcacggcggcgcgtcctcgcgcttggaggacgggtcgagcggcgacaggaacgacgtggatgaacgcagcgtcaacgccatggacttgatctcgagctcgagcttctccggagaggaagataattaagtagataagaggtgcttaacaactaaccaagattgattcgatcggagatgaggaattgaattgaattgaattcaagaagagaagctttgatttctttcttgcttggatttgaagagaatgaaatgaatttgggagggaagagtcgctgcgggtatatatagaggaaatctcaactatgcgtgtgatggcgacgtgcttatcgtcacttaaccaagtgatcaatgctgattaggattgtaaagctaaactaataatctttcctcctctggcactctcacaagtaaagcaagtagtagcattgcatcagtatgcatgtgatttttgtatatatttttttctctctagtgtgcatgcttcctggttggagattatgggggaggattagatcagcagcaatggccttatccattatttttggaactaaaaagtaataaagatttcaattaatttttcgtcgttttgagcaggcacaagcagctgatcgttgagtgttgtatacgcttccattgctctgttgtactgagtactgtcaagtgacacctgttcaattacaagctacttctagataggtgggtaattatagaatcaaactaaggcgataatctctactaatccacgtagttagccagatggatcgagctgggtgagacggcgacaacgtagcggtcaaatcaaaggggtgcagtggaagaagattcagtacacgtacgcgtacgcttttacacttggctgcgaagagagagaagggagaacggataagtcttacgggtgaaac

SEQ ID NO: 1196 - DNA, 1501 bp, Oryza sativa
taatatgttgtcctttctttttctttaatattcatataagtttgatataagacaggaccgatgaaactaaaacattgccggtctaaaattatatgtacttttatgaaacaaaggggtaataaactgtatacatttaaaatcgtggatagaaggctaaaaaacatcgacaaacaaagtatcgtatatacctataaagttcatatctactaaatatagttaatactaattatctttttatttcatgaaaccacatcacctcaattattttttaacctttgaatgatttatcaagaatgtaaattgcatttttttctccaaaaatcacaccatacaacacagtcatttgaaacatttgaataattgatcaaattacaaaatatataaatacatgaaagaaaattgtatagtaagtaataatctttttttttacaactcatgtaggagtatgggggtgtttagattcatgggtgtaaagttttggcgtgtcacatcgagtattatatagggtgtcgtatggggtgttcgggcactaataaaaaaactaattacataatcccttacggcctgtttggttggagggagtttttagcagggattgggagtttagagagatgatgctattaagtgtttttgtttggatgggaggcatgagaattttagtgggatggggatggagaattgaggaaggaactccctccttttcaatacttgagtagggacaggtaattgggagggaattcctcctttacgttgtttaaacgaatctcagccatcctttttttattaatgacctaatctcctaaactccctattaatttccatcacctttaccaaacaagatattgggattaaaaatcaaattcctatcttaatctcatcatcaattccctcgtgtaaactcccaatccccttccctcgagttaccaaacaagccgtttagtaaactgcgagagaaatttattaagcctaattaatccgtcattagcaaacgtttactatagcacaatattgtcaaatcatggagccattagtcttaaaaattcatctcgcaaattagtcgcactatgtgtaattagttattttttagcgtttatatttaatactactttatatagatgttcaaacattcgatatgacatgctgaaaaattttaaggtgggattacacgattctcaccgtatcaacgacaacgatcgggtgcactggagcctggaggagcctaccgctgctccgctctacgggcacagacaaacgttcccactcgttaggcggtggcgcgcgtacatacgttcccacttatcatctctaccctccaaacaatttcaaattccaaccacggggcgtccaaaatagcaagggaaaaaaaaatttcaggcgagtagatttgcattcttctcccccacctcgacgccggcgagagccccccggtctcgcttccgccgcccgatccggcgccgggcccgcccgcccgccgccgcgtgacaaggggaaggcgaaggga

SEQ ID NO: 1197 - DNA, 1501 bp, Oryza sativa
caatcatgcgtgcgtgcaatgcattggccctaataaatgtcactcatggactcgtggcggtggtgacaccaaaccggcatgctgtcgggggactctaccttgcctgatgatgacaccatgatgattataattagtactcctcctcctactcttaaccttcacactatcacaagtgtgccacacttatacttatctagtagtgctaagctagctagctgcatatacacgtgaaagtgtccacgtcatccgtgcttggggcccacacgtcactagcacgtaaccccaaagccccgacaatccggcctcctagctcgtcatgccactgctgctaactcatctctccttaatcatttttcttttcttactggagtagtacttggagtagtttgaacagctgctggcatcatccacttacacgcagctcaagctatgtttttttttcctaagtggtttagttaaacctgatgtgtccaaattattggtcagatatgatcatctcatcacctggagctgatcgagttgaacaaggctacatggatgtacagctgaagaccacatgtccaagtttgctaatactaacagaacatgctaagtacagcaaataccttactctataaatatggttcgtaacaataataatagtactagcaaaacactatgggatacgacgaccacctgctaaccctttactctcagaggtagtttaaatattatcacctccatcccaaaatatacattaacagcttttaattataaatctgaataagtgtttatctaaattcataattaaaacttgctatattttgggacggaagaaatactaagtttatagccatcatagtcacaacggtaacatggagtctatgccggaaatttgtctcaactcttaaatttatagagtagtcatcacaatactaagataagaaagtaagaggaatttcctatcctttcgatgtatatgtataaactatcacaaagcaatactgtagaagtgtactactgtactttctgctggtccaacctacaaaatgaccttcttgatactcctactctaaacccttcaaaatttatctcagagatggtctatgaaaatgctgcaaaactgctgctttacaagaacattaccgcagtatctacagtattagagattaaggaggccatcaccaaggcaaaaacatgtacatcatcagccttcgagtgccgtatccatgtgaagttagagaagttacctagcacaatcactcaatcagtcccttgcttctgccttccaacttgtaattgcacataacagagcatggttgggaaccaaatccttgttaggaagccgcgattttgtaatcggtgacttgtcattctcgcacaaccacatctcaatagcgacccggtcgtacgagtacccgtcagatgcaatgcatgggtcctgcattatcctctacagggaggaaaaaaagcaaaatgaagtttcacctcagacccttcgaaaaaaatggatacaacaagg

SEQ ID NO: 1198 - DNA, 1501 bp, Oryza sativa
ggtgtcaaacattttgaaacggagggagtattctcgaccatacgttatgcctatgccatcatcgatcgatacattcaagggctagctagcaatgcaagatatttccaatgtgatgagagatatttatgcccacatatatatgcaaccatgagctaataattcattcatcgatcgacgagatatatagtaatgctgaacagaaacgaatgaacgtacctgcgtacgtacgaatgtacgatctgaatatctgaatctgttgttcatcgatcaacacgtggaatattcgaagctgcaggcaaattgcaacccaactggcaaacagttatttctttctttttttgtcgcaattgcaatgttctttctgtccagtgtggctacccaggcaatgacacaatgatgccctgaaaaaaaaaaagaagagaagattctgagttactgacactatacatgtacacgtagccaggttcagtctctgatcgttgccaagaaattgacgcgaaaactcctgccaacaattagatttagttcgatatgctaccacaggcacaaccaaggagatctttttttctctgagcatttcaagaagattttagacgtaagtaccgacgtcactggaagacagggaaatgagagggatggcatctcttccctttagccttgggcatgccagagatgaggtcaacgagtcctgtagttgcagggaaaccatctgattcgtcaattaacaatttaatactccctccgttttatagtgctagttattttgactactttaaatttaactaatttatataaaaatttagtaatatttttcaacacaaaacaaacataataacaggtagaagtgaaatgattgtgttcctctaattttgtgtatttctaaatgttagtgctgtgagaaagggaaaaatacacacacgttttttttttcatatttccaaaagtgtttttttcaatcgtaggtgacataccatatgtacaagatgcgctcacgtggatagtttgataatcaaatgatttacttaactcatattagtaatctaaatgtgtattttgaaagtagaatgatatacacgacacacataaacaagttaaatgaccctccatatattttactgcataataaatgttagttttaatgaaactaattttgtgttgtagaaattgctaaacttttctataaaattgataaagttaaaagaaatttgactagtaaaataagtcaaaactgagggagtaccaacaaaaggactaaaattttcgtccttttttgctgttaaaataatttaattttttattattattcttttcaaatacatatgcattttataagaaaaataaaccccctctataaataaacagagaagaggagtgggagcagtagtctcctccaaaccgtcgagagcccaacaataataatccccccttttcatcgcggcgacgatacccgccattttcatctcattctcaccaccaaaagcgaccacgcagcgaccggcca

SEQ ID NO: 1199 - DNA, 1501 bp, Oryza sativa
catcgatcggcatctatcgtaatcacctggcagcgatccaccaccagagacagcacagcacaagccagagaagcaagtcttgcgcatgtctacgccgcaccacaatgagacaaacaccctgaaatcaatcgttctaaccgtagcctttatcggcgatagatcaattatgtcacccatggatacatacctgcaagttaaacagatgaaaatagcaataaatatttggctttgtgtcgaatttaccaaatgaacatggtaatctatggtggaaaccgtgaaatttggaaattgcattactgtaacattaacaagcaaagagagtaatctaggattaaccaaccccactttgggggagtgagatttttacctccgctcccggaggagctgcatggagtggtcccagacggcggcgcggaggtcggaagcgtcggcgaccctgaacttggggcagctcccgaggacgacggcgtggtggtcgagcaccgggggcacgacgagggtgcggttgagcagcgcggcggcgacggcggcattccggagctcgcccacctggttgctgaacccgctgtgcggcgcgtaccaaagaaacctctccccttccagctccggcgaccgcccacatcttctgccccctcctccgccaccgcctccgaagccggagaaggggaggatggagcggagcagcgaggagtaggccgaggagaggaggagggaggccgggatgaggagcacgaggacggccacgaggaggggcgcgtgcgaccgggcgctccgcttccgccaccgcccgcggctcgccggcaaatccatctcgccgccgccgccgccgacgccggcgaatcggatcggatcggtaagcaaagccgctcctccccatggcccacctgccagatatcacgcacactcccacgtgggcccaatatgtcagcccgctagttcaggatgggccacattaagctggcacccacctgtctgtccagagtcaacagcatgggccatgttaacttgggctttatcacgtgcagcagcaacacaaaggacaaaaaaagaagaagcccataacctacggagccaccgacatgtggggcccacttaaaacaagatattatcgcgctctcatgtgggcctaacctgtcagtcagcatgggccaccccgcccatctagacttacgtactctaagttgggcttgttaggcatgtgcagcccagaacgtaccccggggggtgggtcgctgacaggtggggcccggagaactgccgaaggcgtcagggtccagaagctcgtgacgcgtgcggcggcttgcccatgtcggcatccgccaacccctcctcgccttcttcttctccagtaataaatccacgcaaaagcctcgccgcgcaccaccacccagctctctccactccactctcgcgttcttgtggagtcgtgctccactccgggaaggaaggagtgggtgggtaggtgagtggagttggtcgatggcgattggggcgttcgtgg

SEQ ID NO: 1200 - DNA, 1501 bp, Oryza sativa
tattgtatatttccattagaactgtagtcagatcatcccttgtcacttagttttttccttttgaagaaagaaacatgactgaaacatgagttaaggttcccagaactgtcaccattctatagagctaggtttagcagtttttttcagaaagaaacatgagtgataaacttgagctaaggttccctgaactgtcaccactctataggtctaggttttctgttgatgattttatacttgtctgctacttaaaagaaatcaaaaacagtttgtcgacttgactgggaacatttttatggtctttgcatgctgcaggtaccagcgacgacaacatcttgtagatgtaacagaaatatttaatcatcttggccgggagaagaaacgccgcctttttaagatagttggtctcattattctcctattcttgtccttgttttggtaaacaagcaacaaacaaccatttgatatttactgcaagtcagcaacaaacagagtagattataactaccaattgtttgcatgttttgccttcaggatgatctggactgtattattggaggaggatgagtagaatgaaaaaaaaaacactatggtagctcatattggcgttccaagttccaaccattagttaggtattactacaacattatcctcattgcatgctgaacaccctgttgcagtcctattaatcgataccaaaattgttttcgtcaaatgcaggtcatctggagaagcaagacaagtgaaaaacattgtgccccaaaagtattgttggcttgtggagctgttttttctccgatttatagtgaagctcctattattgtcgcatgtaacatgtaaattaggagctactgggcatcagttctcgtgggggcaaagggattaacttcgtcgttgtgcgtgcgttgtcttgccttgcactgcagaacggccttgattttatgttgattttgtgtggtttgatttttgtttagcaagatcatttcctctaaacttgatgttctcatcttttgttgtcggtctgaaatgcaaacacgaagggaaatgccaggtgctatcagccccagagctgagcatgtgtccaatgctcttatccgaacttgctcctgaaattttgtgtgaacttcgtgctatcccctttccgattgagtgctggatcctgacccttagtggtacgacttctttttttgccaaattttgatcaaatttactgcttcaaatttgtattcttgaaaactaggatctgcttcaaaattcactcgggatctacttccatcccacgtcaaaacctcaaaatttcacagtttttgatcgatttttgtcgaaaacttgaaccctgaagctatctatccactacatcaacagattagccttttcattactaaacggtgatctctcggtgctataaaaccaaaaataatctcactctcagcttggcaacaccaattccatttcacttccaactctgagcttcacagcacaagtcagcacaacgaattcaact

SEQ ID NO: 1201 - DNA, 1501 bp, Oryza sativa
catgatcatgcaagtgtagtatatacttatcaaacactcgaacaggaatagggtaatggtgccatttactttaattttagctgtgaatggtgtgtttagttcacgttaaaattagatgtttggttaaaatttaatttcagcattcacagggtaatggtgccattcactttaattatattacatttcgtggaggggacgcgatctgtgaatgctgaatgctcaaacagtcttaacatataagagaaacgatgaatgcagaatgcgtgtaaaacgtctgaaactctcaatatagtttcctggaaacaagaacattcagtgaacggcaagaaaaaacaccactccaggcttccagcttatccaattccatttgacagagtcaaccaaacagcccaccttgccactgattggcagattcgatcatactaaggttcatgttacacaaaaaaattatgtattacagctcgcctctatttagttcaggtactagtattgtcaccgttttccaccaaaaacttgctaacattgcttaatgttaggtgctaaaaatctttgccgcatcttgacaaatttaagagaatttttgttacactttgctgagttgttgacaaatcttcacttgatttagcttatcaaccatacgtaaaattagggtaaatcattagcacataaataattaagtattaattattacaaactttaaaaataggtttatttgacttttgaaaataacttgtatatagaaagtatttaaagaaacgtaccgccatttaacattttaaaatgtatgataataatgaaaaatgcgtaagttgtagtttgaagttaaaagaaaagaaatttgcatactccctccgtatcgtaataaagcaatctattactatgaatctggacatgctccctatatagatttatagtattatgatacgttttatttggtattaggttactactccctccgtttcgttttatttgacgtcgttgactttttatcacacgtttgaccgttcgtcttattcaaaaacttttgtaaaatatgtaaaactatacgtatgcataaaagtatatttaacaatgaatcaaatgataggaaaagaattaataattatttaaattttttgaataagacgagcggtcaaacatgtgctaaaaagtcaacggtgtcaaataaaacaaaacggagagagtatattataagatggatggagtacttattagacgtggtaaactgtggctgcaagccaaaagagaccctaagagaatcagagccgtttattttgtgacaagcttctaagagaatctgcatcttgtgggccgcgtccatcgcactggtccactcgcctctcccctcccccctccattccgctccgatttaccgcctcgccggccgccgcagtaggcggcgctacggttatttcggttagggttccggcgaggccaacgcccaccccccacctccacctccacctcccccagagcgagccgccgccgcctgtggagggcc

SEQ ID NO: 1202 - DNA, 1501 bp, Oryza sativa
accttaactcatgtttcagtcatgtttctttcttcaaaaggaaaaaactaagtgacaagggatgatctgactacagttctaatggaaatatacaatacactgacaaagttcaagcccttgaaatttgcacttttgtgatacagccatatctcgctatagtgctgatactctgacaccagcatgttcacatctgttccattaatagcgcatgctgtttacatccgatattgaacatgataacatatatgttgattggttggaattaaagatttgcattcctggataatcaaataatagttaacaacaaaagttgagcaatatgctgccttctaaaaccatatttacccattaccttctaagtgattctaacttctaagacctcaattcaaaaccaacctaaaatcaggcaagaatctttaaccatgatgtcacatactacaccaatatgcttacaggaaaattacaatatttagtttctcagtagctccctgacatggttaaatctgactgtatgctattagatccaccctagttctctcagtcccatgttgttgttttttatcacgaacacaccaataacagtcaaatttcgtgatttcatcactacatcatcaaccacaagcaacaccatagcatggaaaacatgcaacgaacatgggtccgggtgggtgggaaggaattaattcatctgggacaaacattaaacagcacgagactgaataatctcaccatactagtacatggggtcccaagcatcaatatacaggtcgtctaagaatttagcatagcatctgctttgtaaattccctcttcttctttgttttttttttttgtaaataactttcttttatctaatctaatatatatagcacagtaggagcctctgcctctcctgctgtttttcgtcaaagaggaaaagggttggctaagaaaagatattcacaaagttaggaagggtatatagattgtgctttctataggactatgaaatatgatggttttgcagatgtttgtaggaactacttttcagttttcaggcattcttgtagatactgcatgcaggagccagcattatcccttcatttgttcaaatataagatataagaagttatacacctatattatcgatcataagaccacttaccctataaaacttagtacaacaagaggcacaaaaaagctacatagaaattcagagttatcaaataaagtaaaatcatggtccaaaacaagcatgcctgacacacatatcagaacttagtgcttcctgaatgcagataagaaaatacagtaagatattagaaggatgtctagtaagttacactaataaagatccagacgtgtgcagtattaaggtatatcaaaagtcagaaatcagggcaatgcaaaagtaggtcatataccatattatgtgtaaagtacaaaacttgttttctgaaggagaccaagaacttcactgaccattttaatctaaaattttctgaacaaacagcctaaacag

SEQ ID NO: 1203 - DNA, 550 bp, Oryza sativa
tggcaaccccagttccagtatgtttggcgcgaaatttaagccccccccccccaacgtcaccaaacggcggtcaccgaagaaacgggccgtccggtactcagccccaatccggtcggcgctagggtgttcaagttaagcgccatcgaccctggcgttaaggtcggggtccagatctggtgatagtttttgccagggaccaaatttacaaatagttttcaaaaagggtcaaattgtcaaattttcgggactaatttgtagctgcacgctacacaggttcccacgcgctataatcggcatgcaactagtactagcgatagaaaacactttcagcgggccggtgtcacgcccagaaatttccgaatagaatttcaagcagaatgtgcattaaattccccgtccaggaccagccggggtacacaagcgacaatgttgacattcagatccacgtcttacaaacatcataaaagtttacacaaatgcagcagaagagaagaaaggcaacaggagctaagccttgactaaaactgcagcgggaacaccactccacagg

SEQ ID NO: 1204 - DNA, 1501 bp, Oryza sativa
gcccatgcatatatacttgtcaagctcctaggtggtccaatggctgtcctagttttcaccgctagtgttaacactattgaagacggaaaacccttaaatataaataactacggtctaaggagtagtaggaaattttcagcctcatcttttggcttatgctagcttatacttatacttataagccaaattttaaattttcaatcttaaatttgaagttaattttggagtttttttcatcgtagcttatttttcagcttttgcttttagattgccaagaacacatatataaaatttttatttataaattattttctatttgtaaatatgttgtttcgcttatttcgatggagtccttttttgatggttcaatcactgtatgctaccttttactataaaagctagtagttcataaatatgcagatagtgaacactggtgttaatgtacaatagtgacatgtactaatagtatcctagtttgaaatttcaagctcacttgggtcaaaaagaattttggtagctgacaaattacgcatgttaaacgctcctattacatattcaactgttcaagaaaaggctcttaaaggttattcctaacaactccactatttctttggctcctaagcatgtgtaaagattaaccatcaagcaaacctctggaagaaacatcttggatggtagtatggtacgacctgtagcttttctcaggatgtttttctgtctctcacctgcttccttaattaactcctttccgtcctttgtacttgttgtaatggagtaccctagtttatgcatttacgcaccttctcgaaggatttgccttgcacaaacaggccgggtaggtaaaagaagagtaaattttataaaactatatggtttatggttaaagttgtataacgtcatatattttaatacttgtcatttaactatattttggtactaaaatttcacaaaactacattattaacaaatggatccacccattagatgacgtggttctttccctacatatatttaggatgcaggcatgaaatggtgaatgtttcacttaggataaagctcctgtgtctacattctaggtgaaatatccatatcattttgcggtggacccgttcgttgataatatagttttataaaatttcctaaaactgtaattaattaaatgctaagtttcaaagtgtgtatatttaattttaacttagatcataagatataaagttttgtgaaaaattgactttctttttttaaaagaaaaaagacttgcgagtccagccgagccgagccgagctgaaatccatagtagccaccctccgtggtatatatccacgtctcccttaaacgcaacccctcacccacccatcacacacgcaaaaccaccgtcgtatctattgctgtatcaaagcggagacgccaagccagagtcgacgattcgattaaacaaggaagaggaagaggagagagagagagagattggagtggcattagcgcgagggggaggcgggca

SEQ ID NO: 1205 - DNA, 1501 bp, Oryza sativa
aggtgatataacctgacgaaaattccatcacggacgccgtgcgatggccgtggttccgtccaaacaccggagccccaaaacgtcaaaacctgcgtctgattgccatgacccggaagccttttaattttctgtactctcgtcggccaacgcagccagttagacccacgtcagcgccattcaagtccattcctccgtcaccatgtttgcacctgctagctgagattaacaaacgtgaaacgtgtacagtgtactcgagtctatggcaaatcgtgcacaattttttaaggtgagtgatgcatgcgtcgtcagttttaatttgagcatttgaaacacaagctgctgacctgatccctaaacctgaatactcaactctcaacttttcagtgaacagattattcggcgatgatgactcctggtatttgtctgaccacgtgcataatgcattagtaattcggaacgtcactaatactttgaccaccaattctagatgtcatccagttctgataatgcacgcgcgaaccatccaggtaatatcaaatgtgataacacaagacttttccaagtagtttcagctgaccattagtcacaaacaaagtgaaattaaacaagcaagagaatctttccatcgttcaaactaccactaattcaagctactgcgttctagtcttctagacgttcaacgtacaccacatccctttcccgttaacttgggccatgcagcgatgcagtagacggcgccgtgggcgagacaacgaccaccacgccacagcgcgaactcgcttacgtgcccttctccacgacgcgacgcgacacgagcgaacgaatccccacctcgtcgcgctcgtctcgttactgcgcgctcctactccccaccaaccacgcccccactcctctccgctgcataaaaaccaagcccgcctcgccgtttcaccaaccaaacccaaaaacccaaaccaaacgcgcgacgcctcagctttctcctgctcctcctgccactcaccaacccaacgcaaagcatcgcggccgcgaggtcgtcgacctcgtcgtcgtcgtcgatggaggtggaggcgttcccgatacggttcacgaggggaatacggtcgcactgggggaggcgcaagtaccagcggctggaggcggcgaacggcggcgggaagacgagggcgacgcagcagctgggcggcgcgcgccgcggcggtgcggggtgggggctgcggctgcggcggctgctccgcgtccgcgtgcgcgtggcgagggcgtggctgtcgtccccggcgcggctgctggcgcggatccgcgacgcgtacgtgggcggcatgctcgccgtgtcgaggaaggcgtcgggcatgtcgctgccgaacgcgcccgaggggctgtggcccaggcgcgtgccgcgccggaagcagctcccggcggcgcggccaggccagctcaccgacttcgagcagaggctcgtcgtcgagatatacaagtccatcgtcgcctccaaggagctcaccac

SEQ ID NO: 1206 - DNA, 1501 bp, Oryza sativa
cgggtacagagagacaaggcaaggatgttgcttacagttgcgatagaagctaacgcgcaccatggctgacgccgcccccgcccccgccgctcgccgccggtctcggccgccgccgccgccgcggcgagatggattgtggggttagggaggcagtggaggcggacgagagttgggggcggagtcctttataaagcaggcgctaaaccctaaccctagagcttttgccttggtgggcctatcttttgtggccttttagatgatatagtgggctgtcttatgggcctatggttgaacacctctcgctttgttttctcctctatcttttttttttctttatctcttctactctttacgtgtggtaaaggaattccaaattcttctaaagaagaagctatatgcataaaaaagaatcattacaaatattttactaacactggtgtagtataatacattgaatcttggttttatatgacctccaattaattaatcctagtatgctatcaactgtgataagaagcacttaattttccgtgctcttgcaacaattaaacggtactgatccgatgatccattaaacctaagaattgtgataatgtcttgaagttctttgtaacactgtaaagtttattcaacttgttatgtagtttcataatgtttgaaaaaagaaataccaggttggcaaattgaggtttaaatcttaagatatgctgtaggataaataccttcagaatctaatcctttaggaagtacagtagtagagtccaaatatgcaaatcttataaaaggagcatggtcagtcgaactgtccataagtacataaaaggttttgattgaagttattgaaataatttgtgttgaaaagacagctgagagtgtgggagcaagagcgagagggatggattctcattgatcaaagcgtacaaaatatataatgtgaagcggtggcaaaatatcactcagttgtcgagaggagcaccgaggggggagagaggagcgatctcccccatctctgccagttagtttcttaatgatttggatttttgagttttgtggatgggtataatgacgttataacaacgttttcaaaatagttgtttttaatggaattttgcactgtaacgtagtttgactagttaggttggaaatagtccactcgggtttaagtcttaaacttgatacgagggcttgcatttatgactaattcttttttccagcggtggatgatgcacccgacaacgatgtgcctgtgatgacttcgttaatgtcaacgtatgtcggatgagttttccgaatgtacgttcatagaggtggttgtgcgcgcttctgtgagcatcaatatttggattggctttctgaaaagaattttttttaccaaactaaatgtatttaggagggcttatgataagatgggtatcaaattgcagaggatttcttagttgattgctacctatactccggaacaggagagcctctctgcgcgcatttcaccgaacacacacca

SEQ ID NO: 1207 - DNA, 1501 bp, Oryza sativa
aagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacacaaaaaaaattgtggagagagagtgattgtggacctgctgtttactgaaagcaatccgcctttcgaattcttggagaagaatgtcatcttcccgctgtgagatatcccatatgctaccatcctgtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatgcagcaaaaaattgttatggcaggaagatatgcaaaaatgacaaatagactgacagtagcattaggagttttggagtgctgccataataccgagactatgagagtttatgtttta

SEQ ID NO: 1208 - DNA, 1501 bp, Oryza sativa
tgccagacgtccgatttgtccatttaaaaccagaggcaatatctatcatggatgcagaaaagggaataacatactacctccgtttttttaatagatgacgccgttgactttttctcacatgtttgaccatttgtcttattcaaaaaatttacgtaattgtaatttattttgttatgagttgttttattactcataatactttaagtgtgatttatattttatatatttacataaaattttttgaataagacgaatagtcaaatatggaagaaaaagtcaacggcgtcgtctattaaaaaatagagggagtatctagtagcagctatatatacctggacatatcgacgcggagatagaaatgatcgagggcgtcctcggcgtcgaagacggcgtcgcgcgtctgcagcagccacaccttgttgacctcgtcggagacggcgcgtcgcttggcgtcggcctcccggaggaaggcctgcagccacatcagcctgtcccggagcctcacgatgtcgtcgttcaccgacaccagcgcccgagcctgccccaccgccatctcctgcagcctccacaccagcggcccgatgatcgcctccgccattgtcgatcgatttactctctctctctctctctctaattgatttgtttgagttttcctttctgcagacaatctttaatttgcttatacattgacttaattcgttacatatatatgtatatagagagagagagaggggacgacatgcttgtacgtgagctagctagcttattaggtagctgctcagctgtgttacgtttgagtcgctgctcggggaggaatagattttgattcctcctctgctgactttgcgtacccatatcgctctgacttggttgttctttgtttaattgtgtcatgtgtgcttaattaaggtatatgcttgctttcatgcttttttttccagaaaagaagttaggaatcatgaaagggaataataagccgttgggttgtcaactaattcacgtcttttagaaagggttgtctgggcattctgttctttgttttttttttttcactgagtcttcctgtcccaagttgtgggaaagagctgtagcatcacgggcatatgcaactcgatcagggcatttacaatgcaaaactgtgcaagcggctttaccgagttacctcggaatcagggtttcccaaaccgccgggaccggggttaccgtgccctggcggtaagcacggttaccgcgcattaaccgtggtaaccgtgaaaaaccgtacgaaaccgtacaaaatttatcaaaaattcaaattattttttaaatttatttaaatttaagtaggttaccgcggtttttctattaccatacccccgcggtaaggccggtaacggcagtaaccgcatagttaccgacggtaatataaaccctgcctcgaatacaatatggctactatctatgctgagactacatgtgcaaatgtaaaacaaaatcaatggcctcatggagttatagatgg

SEQ ID NO: 1209 - DNA, 1501 bp, Oryza sativa; identical to SEQ ID NO: 1207

SEQ ID NO: 1210 - DNA, 1501 bp, Oryza sativa
atttgaaatatagtagattaggaattagatctatatgtgaagaatggatttagaaaccattagatcaagcaagttaaactttatcactagtattttgtacaaccatatgcatgtgcttgaatttttcatcgaatatttgttttgatagatcacacgttactacacactagtcaccaatatatgtaaagcagaggttattattgtgaatattataaatattaaaaaataataatacaccaaatattggttatttgaattttgttaatatatatattttttttcaaagttctaagtattttttatttatagttcaaaagaaattagttgcaatatgatatataaggtccatcctaaataagaaatcttatgttattttccattttcttaagttgagaattttaagtttctattcagtattgtattaatctttactcgtataaaaggactccaatggatagccatatataaccattgtaacttttagatattaagctatgaactttctaatattagataacaactaatcggatagccatatataaaattaaatcaagatgagtcttctctatatgaaaatgtgaataacataagtcttctctacacgaaaatgtgaataacataagtcctatctatatgagaatgtgaataacatatttcatgaaaaatatgcttttatttattttagaaaataatatggtattttttttccttttacctatagcaaagcatgggtatttagctagtttaacagagattcagaattgataagcatcaaactgcatatgttaagagatttcaattgtagatttttcacgatttaaaataattcaagactttataaataacttatatcaacttatactttgttttgagtctctatatatcatttttatgattagaattatgaaattagaaattgataaggaagatgtttatcaatttatagccccaattatatcttttcagtaatctaataagaaattagaattaagcaatattgaatcgtacatggtttgggagcctcgattataacttatacatgattctactcagtttttgagagttatagctttttcatgatttaataattttaaaagttcacagttaattaatatcgagttgtgttcgctttggagtcttaattatagcgtgcttttccataagtttgattgactgccatgataattcaatccaccccacccaatcaccatttttttcctagttaagatcaaagctctctcaaagtctccaattaaaacaagtatagacagatttagttaacttcttattttgcaatacaaggatacaactggtgtttgtctttgtattgctacaatgctatactagagttcatgatgcttgcttgtactgaactaaacacaggtcgagcagttcgtacttgccttgaccgttttttttttttcaaataattagtagctcgattgttcattgtcaatggagaccagtcacttacgctctaggaaattaatggaacattttc

SEQ ID NO: 1211 - DNA, 1501 bp, Oryza sativa
tagtaaatgtgatggttaatataactgtgtgagtgtgggttggttatgtataatattttatccatgctttttttttagggaatccatgctcttttttttttggcattgcacaggtgcaaatatcataataaaaaggaaaataaatcagttcgggtggtatggtgatttggagagagagagcaatgtgctggaaagatggtgagtcaccagtcaaatgtcatatgtggctgtgtcatatgagattgaagcttgcccattgcatgatgagctaagaattaaaatttcctgcgagaaacatcctgagagagaacacctgtcacccggaaagattagtttagatcgcccccatttgcatagtactagtatatagtactatgagccaaaattagtaggtcacgatggaaaacgttacaatatttcagagaaacaacctaactaaagttttacttgtttctcttgccttcttctcagatcgatcaatctattatatctatttaccagagtgttgcacaccggctgaccgatttgctgtgtaattatctatggtactatgcgccacgtggataaattaaatgctgtcgaatttaagctgcaaatcctaacaagttagtggtggcagttgagctctcatccatgcctagaaaatccaggtgtacaactttagcggacagagatttgatagcaggggacgaaagaagaagaagaagaagaacaagttgcaatttgcatcatgcatgtaatcatcatacgtgtgcctgaattttgaacgagatgatgatcgagcttgaagaaccagcctaaaattaaatgaaacctatgcaggattaaccaaataatccaagtggcgagagctagctagcttagggcggaggtggagtggagtatgggagggccgatcgaggggctgcccacgaatccggtcaaacaaaattttgtagccatatcttacttattttcaccatatatacaccctctcaatacaaacttatacatccacatctgcttaaatttgatctaaagtaaattaagcaagtgttactctctatttcgttctagctccgcccttaaatttacagcgcgccaaatctaatggtccaacaataattaactaattaagctggctgatctcggccgtatcatatgtgtgttttgctgggtaaatcatcgatgcatgcgcgcgactgcatatatatgcagggatttggagaaaacaaaaaggaaatgtccagctcgatataaagtgtgcaatttaattgtcctgctctattctatcataaatatttgacaatcagaataaattttgataaatagtttctcaaatgcttagtgtaaaacacaaacaaaatagtatacctacatttgcattgaaaaataatattatatatcatgaacttattggattttataaacttatactgatatataaaattaatggtcaaaaatttgaaaaaaatggatcagacattgcttaaatatttataactgggtaaagtatctgttt

SEQ ID NO: 1212 - DNA, 1501 bp, Oryza sativa
aaattaaacaaggtgtccgtgcatttctagttcgtattaataattgaaaccactcagtgctagaaaatcagtgcaatcggcaccaacgatcatcatagtcggaaagtcagtggcccttaaaaaccgggcactgacgaagtgtcctaagctattgaccttattttattttatttatttattttcaaaaacgtgataataaaaagaaaggatcatatcacagattcacagctactgctggcgcaggtatttccacattagttcggcaaatagtctagtgcagtcgtgcagacataatatgatgtgcacttgcaccttcttcaggtacaaacgtagttcaatgtaccatcagaatgtgcagtggcgaatgtacaacgtgatgaaaatattattggggctttatattaaagtcataatacataataattataatatactttttcaaaatcctacgcggatagggaaaaaaagaggattaaagactgaagtgaactgaaaaagattgaaattaataggtataagagcactgctacacatactagttttttcttactaaatctttactaataatcatctcaaccgtttgatttaggtagatggaagttatgaaaaatctagatgaactcgtagcatgacacttcagtgttagaatttagtaagaaaaagttagtacctatagtcttttccatgtataaaggccatgagctgcacactgcaacagctactagctagaacacaagagtaaaaataatctacaatataattaatgatcacaattcacaaatgatccagctagtaataaacagcctaatgttttttcatgcacatcatttctttcaccctgaacgtctccagccaactagccatcactgcttggccgtatgctggttgctgtgcaaattttgctggcactatgaactcactacgcaacagatatatgggattagattcctgccaaccagagagctggggctagagccccaaccaataacatgttcaatatgtaatttggtgttaaatctgtacggaatttctcaaaatatattttgtttcatgaaatttactcaattatatatatactccctccgtttcgaaatgtttgacactgttgactttttagcacatgtttgaccgttcgtcttattcaaaaacttttgtgaaagatgtaaaattatatgcctacataaaaatatatttaacaatgaatcaaatgataggaaaagaattaataattacttaaattttttgaataagacgaacggtcaaacatgttttcaaaagtcaacggcgtcaaatatttcgaaacagagagagtagtactgtacggtgactagggttgactagtccctctcgtccaatcctaaagttggcatagctttggacagccgctgccgtctttgtgtgcacaacaataggctataaatgtagctagctttggcgtcctccgatcctatggttgtgtttagatctaaagtttgcatccaaacttcagtccttttccatc

SEQ ID NO: 1213 - DNA, 1501 bp, Oryza sativa
catagcaagaggagatgaaatatgctatttggatgcttgagtatgccacttgtcatgaggagagcaaagatgctcataggatgcttggagcatctccacactcccagagcacctctccacctataaatacccctcctctcattcattccctcacacacctcaagaaaaagatctagagctctctcaagtttagtttagtagttctagtgctagtggagtagaaaatagaatagtcttcatagtcctcgagtcttcaggagattgctggtatggctccagtagctttcctctcttcttttgtaagacatattgaattaatagaatattcttctttatacattttcggtattttattccattcatattacttgagtgccgactttacttcatacttgaatcaatatagccatgcaactagctttccagataggtgtattggtgtgggtttagtgtctgagtattcggttgctctatgtcggttgcaaggatgtagagtagtatttagtaatataagcacggtgcttagtttattagataccattaattggggtaatatacagtggttcagaggctggccgctgatggtgacggctcagtatgggtgtcctctgcatgtgtatattattctaagtgcaatttcctggggagggtactcctccgtatttagccccggttggatggccaggacaggttgtcgtaaggaactcagcaaccaggggtagtctcttgaaacaccaggaggacactaggtacggggtattggttgcatgactgtataatagcaagtatagactaaagatgtatgtatactagaagtacaggaatgatacttttcttattctttctccatttattttagactatattttagtgagagtatcttagttttttcttctgtgtgtcaccctaccctttgaactgaattaacctctgcataaactttcatgtatataagtaatatatgaattgttagtaaagttctctcttatcatatctttcattgggatcaaataaatacgacaccttggaatactcccgggtgaaatgctacaatggtatatccgtgcacttgcggatcacatatgtaaccataatataccaggattatttctagtgctattgctgggaattatatttctagtagtgtcgctaagaaataccaacaatactctccatggctccaaatcaggtattgtgttcttgtagtctaatttgaaatttgggatttagaaatttagtgatgagctttgctttaagaaattatgtcaatagcaacttataatttgtttaattgttcatcattcattaggaccctaaaaatggcacctagaaaaagaggtactaaagcaacagcagctgctgaaactagcatggttgcctcatcactagctccaactgaaggggtagaaaggtcatcaactgtgggcagtggcaaccaacactattgttgttgttcatgtggataacaatggtgcagatggggattgagaccatgaaacta

SEQ ID NO: 1214 - DNA, 1501 bp, Oryza sativa
gggatagaaaccaaagaaaacacgaaacatgccttcccgagcaataaaacccgagacccgacgaaaacagactcggacacggaccctgccggtctgaccgcccacatacctgcggtcagaccggccctactagccggtcagaccgcccacacacctgtggtctgaccggccctgtgaagaaaacccgtcactttctaaactttggtaattttcccctatttcgtccataggtgccaaatttgtgtgtaaacaatattatccatatatactatttccattcaaccgtttaaattcatgtttgttttccatgtcttcacatcatatcatacgttctaaaaactgacctaaaattattgacaattgtctaagtatgcttctaaaattatttcaaatatttgagtggttttatagagtatcattgaagtttgggtattacttatagggtgtttgcatgtttcaattgttttaaaaaatattattgtgcatacatgaaagatcgagggtgcatggtcaacagcggcggcaccagctggagggcacggcggtgatatgaggcgagagggaggagaggtgagcttttttccgagaagatatgtaatggaaacactatctctagtgcaaacatagaaaccacacttggatgcaaaacgtaggttccagatatgtccacgtcaccacagaatgaaatgttcaaaaaacaccccgcctaattccaaactttagcatctcagcccccaaattgtcccacagcacatcttctccgattcagaagggatccatccccaaatccatccccaaactcaactctctgctgcggcacgacggtggggttgggggaggggtggtgcggcggcggcacggcggtggggtggggtggggcaccggcggtggtcggcagcagcgccacctttccacgtgattcacggcaacacgaatcaacccccatgctgctccggtgacgtcgaggcatctgcgaacggcggcctcgattcgccgattgctcctccagcatccactgaattaaggtcattctctcttcttgatccctgctatagttcgtgtatgttcttccgtggaatgtgcttggtttgaacaatttgggggctgagatgaactagggttttgatgccaccaacactgacaactgcagatgaactagagttagtattccgtcggtgttcttgtagagacagctacagcttcctcttcttgttgttcttcttgtccttccctccacttgggcctggcccctcatcgattggccaacaaaaggtagtaatggtgtccctccattactgctgttctgtaaggttatgatgagctacccactgatgtggagcaaccggcggcgtctgcagctgttactgttgtgttattcatcgatgggaggatcgtgcgtagaattgatgttgctgctgccggcctgccgtcgtgctttatgttctccattatcttgcatattgcattagaatgatggtgagatgtgggtctggggtctggg

SEQ ID NO: 1215 - DNA, 1501 bp, Oryza sativa
gtgcaccggcgccagaaacccattgttccttcacagcgtacagtgtgacgtgtgtattaaagcctcctagctactctctccgtcctaaaatataacaacttttagcccttagaatttatcttaaaatataactacttctccacaaatatttctcttcctaaccaatcacaactattcaccattcatttttcccacctgtctccactacccatccaatcacgacccttcaccacttatttctaccctacttttttaataatcgtgtccaactctaaaacctcttatattctgagacggagtgagtagtgtatataggctgtgtttagttggatccaaagtttggattttggttaaaattgaagataatgtgactgaaaagttgtgtatatatgacaggttgatgtgatggaaaaggactgaagtttggatgcaaactttagatctaaacacaaccataggatcggaggacgccaaagctagctacatttatagcctattgttgtgcacacaaagacggcagcggctgtccaaagctatgccaactttaggattggacgagagggactagtcaaccctagtcaccgtacagtactactctctctgtttcgaaatatttgacgccgttgacttttgaaaacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcattaattatattgtagattatttttactcttgtgttctagctagtagctgttgcagtgtgcagctcatggcctttatacatggaaaagactataggtactaactttttcttactaaattctaacactgaagtgtcatgctacgagttcatctagatttttcataacttccatctacctaaatcaaacggttgagatgattattagtaaagatttagtaagaaaaaactagtatgtgtagcagtgctcttatacctattaatttcaatctttttcagttcacttcagtctttaatcctctttttttccctatccgcgtaggattttgaaaaagtatattataattattatgtattatgactt

SEQ ID NO: 1216 - DNA, 1501 bp, Oryza sativa
atcgtccaatcagagacgggaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtggatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcagtcaatacacttttttttattgccaaatgtcttgattttatttaattctacacatgtgcactaatatttaattctgcgccgttaaccaggcaggtacctacttgtcgactccggatttcctaccaggatgggattccttgcaccgtacccacatgtacggtaccacagggatcaacttgcggtcgagggagccccaccacccgtaggacgggaagagactttcaaccatcgacactccacgttgcgagggatcgtggaaagacaatttgtcatcgcaaaaaagatgtggaaaatattgaaagaaatcccttattaccgagatgaggacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttacccataatgcttgtcgtatgttcagtacttcaattttcaagattgtatggtttaccatttatttttataacgttaacaacaaatttgatgcaccgaatcttgtgttatttgtttcacaattcatttttttcttaattcttgcgttattatttcagacaaaaaattaatcaatgttattgcaaaatttatgtccgaatcttcacatattatgaaaattattatggtaagaaatactgcgtcattacgaaatggttttctgctactgcatagcacaattgcgaaattcaatctacatacaatctattatttcaaacgaaactacatgaaattgaatccatatgaaattactactgtaatgcaattcccatttcttctcaattttttcaaatcggggtgtgttttcttgtgtgcatctaccaattcctcccacgcatttacaccccctgcagcgcatccggcggcaacggcagccattgtcacgcccagaaattcccgaatagaattccaagcagaa

SEQ ID NO: 1217 - DNA, 1501 bp, Oryza sativa
tgtctaactcaattgaatttatagagctgaaaacggaaggttggcatttgtcatttggccctaggccatcatgaatcatccaccttaacaactaaacttttggttactaaccccccaatatgaaggctgaccaaatacttctattgcttaatgtgccaccttcctaacttgctctaacaactcaatagacccaaagtttttatatgttgaaatcaaagtatccttgacaacgtagaccaagaacaactatatctttgttatcataccatgcatctggcaagccttataccatagacttccgagagcaagcaagcaagatatacacgaacccacaccatatcacgaaacatattgatgaacaaacattccatgccattctacactgccatggagataaccacacctgaaaccatgtgttgcactagtccctatctacaaatgccttgaacatgtcagaaaagatgccaggcatagttgcataacagatcaggaagggagcacggtggggcagggaggggagggttgcggactgcccaacttggggatcctagggcatcaggcaaagtaggcttggagtagggtagagtctccagtgacgctgatgacagcaatgaacaatgtagccgggcttcttttctaagatggtgtagcaagatgctagtgtagggcaggcctcaggcggagcgggagcaggtgtcgcagtcacgcgggatcaattcagcacaggcacgagaccagaatattcctctttcacgtagaagctatcgatgggggttatagtttagagctccgggattaagggatatgagttgagatttgggtggccttcctattttttaaagggttctctagcaggggcattgttagacctttttttacatcagtcaaaaatatttatgggttatgtttagaggccttgtgtcacaccccgaagttttcctcccaagccaaaattttaatttttaaaacgaccctaagaaaatgcaggtgaaatcaagagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttccttttctttttctttttcctctctttttcctcctttttttcgaatgggccgtcggcccattccctccttcctccccctcctccttgctgggccggccgcaggccgaggcccagccaggccgcccgccgccctcctctcccggggtcgccgacaggtggggcccacctgtcgggtccttcccccacctcccgccgctcccggcgcgccgccgcgcccacgtctccgcctcctccgggccatgtcgaccacgcccgcgcgtgcgccgcgtctcccacgcccattcccctctctctcccgcccacgcccgcgcccgcgcccgaga

SEQ ID NO: 1218 - DNA, 1501 bp, Oryza sativa
atattaaaaaataatttcaccaaaaaatatgtcactatttcttaatttcgccaaagaaaataaggggtagaaagaaattccttcaaatgggaggcatccctagtatttgaaccagggtttcaagcttgacagacatagcctcatacctactatttttatatataatctggtaaattcttgccgcttccgatggaatattcaatatctttagcgttaatgtgatatttatatataacctggcaaattcatgtcatcttcgatgaaacgccaacgtcaaagatgttaaaaaggatatactccctccgctcctaaatatttgacaccgctgactttttaaaacatgttttaccgttcgtcttattaaaaaaacaagtaattattaattcttttcatatcatttgatttattgttaaatatatttttatgtatacatatagttttacatatttcacaaaagttttaaacaagacaaacggtcaaacatgttaaaaaaaaaatcaacggcgtcattgttaacctcgatggctctaagcgcatgattagtttttagcacgatttattttttagataagttttctgaaagggttaatttgtcaaattttcgggctttagtgaaaagcttgagataaaaggcggtgtacacgggtgtctcccccttggccgcttccctaggcttggcgtaaaagaaaatctccccgtctcgtcgtctcctccgctccttgcgccatctcgcggctgaacaggggaggggcggcgatctccatccggcgagcggagcaggggaggggaggggatcttggtgagcatccatctgcattctctttctgattcatctatctctctcttccaccgggattgcacctccgtggaatttgcttgcgttaaccctagcttctcttatagatctggaagaggttcttctatttgatttcagagccttaaccttaatacaagtaacagtttgtttgttccccccaatagtttgggggttcaactgaacccccacgtcccaagttggatccgcccctgattcgcgtggttggagtgttttggttagaattttttttttgtcgggatatctttgttagttcttcaacttaataataattgaactgtaaaaaaagagtcggagaggttatcatgaatagaccaaacaatttttattttttctcgttagatcttttatagtaatctagttggtaggatcgaaagatgacttttgttcattgtggtatgggattgatttgttcatgtggattcgtttaacgcttggccatgataaacatgccatcatgcagccatacaagtgtaaggattattaatatgtgctgtcattacgaatttgacagggtgattcgtgtgattatagttgattttatttggtaaatgagaatttcaggagggtttgatgtgaataatcttagaatagcttccttcttgcgcgttattttagtttccatttatttgacccaatattctctactgtgttgaccgttctttc

SEQ ID NO: 1219 - DNA, 1501 bp, Oryza sativa
aggaatgacgaatagagttctatatgtaaactataaggactacttggattgtatccatattgatctctctagttttacatggacaatgggacacctatggtataaatatatcccataggaggagggaaaaaaagatcaatacacgacacaacaacagatcaacacacgccaagacaagccgctagatatcgacatcagagataagcctagacaaacccaatatgatgtatgcggaggccaataagagagatctagcgctatctctgatctcgtcgagtgcgaattcgaggaggaagactaccccgttgttggctacgtgatggtattttcgggcgccaagtcgataacggctagataggtatatcccaaatattgtactggtctaattataatgaataagagcaacatcggcttcgcccaacatgagtagggctattacctgtcagataaggggcctgagcctgtataaaatttcttgtctccatatcttttacttcaatctcgcatataccttggtaccaacgatccccatactatgcaaaataccgtagtcgcggtatcacccatcgacaatatctattttatagttaatctttaactaaaacactaaatatatataattcttaagagaacactaagctcgaactaaagcaaatgctggtgtcctcgggagctttttatttcttttaaattcctaaaatccttatattattggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaagttttctggaagggtcagtttgtagagagatctatgctgcgcacaggcacaacctttaggcagccacacgctggtctcctcgaactcgaaccctagccttttgctgctccctccggcctccacacgcgcgagatcccttcccctctcctcccctcccggcgagatgtcgtcgtcgg

SEQ ID NO: 1220 - DNA, 884 bp, Oryza sativa
  unsure (1)..(884): unsure at all n locations
taaaataaaaaaataaatgttcaaaaacaaaagaggtatttttacctttattaaacaaaaaaaatagatccaaaaaatttaattaaaaagtaaaaaataattactttgaaaacctggaaaaatagactatcaaccnttggattgcagattataaatttgcaaaaaaatcgttggataaaacaaagtagcttttttcatgggttaagggcatattaatccatagtagcacttgaataaaaatttttaaacgtcttgctttttgtatggaacttaaaaatatgtataagtatattaaaaaaaaatgtttaggtatcaaaaaaataatcttaaaaatatttgttcgatatattaaaagccttatgttaggataaatcaaaaaaaatttttataagaaaaggtaaaaaaagtcaaaatatttaatatgcaaggaaaaaaaaaaccataacgaaaaggaaaaataatatacaaaaaatgggttaaaggtgtaaaagtgaaaaaaaaccaagataagagataatccaatgaaatttgtatataaaaaatagaagaacaaggcaaaaaatggaaaaaaatttaatatacaataaaacccgccgctgctgccgtctcacgtggccggcgtgcgctacggccaccaacaacaacaacaacaacaacaatacgtacgtgaaaatcaaggaattttttcttacatcatccaatcaaaaccctagctgacgatgatattggtatttatatgtgcaggttggaaatggagcagcagcgcgaacaagagatcaccatttcactccgtattattacggctcatcgccactgcagaagcagcagcattacactactactcctaatgatgctttgaccaggcacgtgcctagcttaatttt

SEQ ID NO: 1221 - DNA, 591 bp, Oryza sativa
cctcccccggggtagatgggccgagagagattcggcccatcgaccccgggggaggcaaaatagacttttgcggaggaatttgatttggaaggatttggattcgggattgaactcgacgatagatcggggatttgagatcttgagatggcacggacactagacaataagcaaagaaacaaatttcgcaattagggtttttaagagataattttcccgctaggcgccacgacggaacgggcgctacagttaatcctatatcctatatatctataaatatcatccccactaagtatagttaatgctaattttctctactctcatgaagccacatcacttcagttacttttaaccttcagatcattcatcaagggtgcaaatttcatctcttgtccaaaaaccacaccatatataaccgaatcattataacctttggataattgatcaagttacaaaatatataagcacattaaagaaaattgtattttaattatgagataaaattttacaacgcatatttactatttttttcacataatttcctccgccgcaaagcgcagtctatactttctataaagttataacatgcaacca

SEQ ID NO: 1222 - DNA, 1501 bp, Oryza sativa
gctaactaatagatgggtacctgcgcgttgcggccaagccctgctcgatgttggcatatatggtgccgtggggttttggcaccagtggctggaaggtgtcggcccaatcaatctccttaacttgcttctagaaaaaaaaaatctatactaccaatcatgtatatactatgacagcacacgtgcttttgtttcacatcctatcgaataattaaatgttagcttgtttgagttgtggcttataaattgaaatcagttttgaatggtagaacataattttaggattagcttagggattttcttttgtcactgtgtcttattattttctatgttaaaagtagatctagaaaatgtaaaattttaccctaaaattattttgaattccaccagtcacatgtttttagctcataaaccgtacggggaaaaaacatccagctagaccctagatcgtcctagacctgccgaatatatatagctagcatccccgacaaatatttccattttatatcaacaagctatttatatatgtatatattttaataacatattagcgagatgtatgataaaataattatgtatgaataaaaacagtacaagaatattacagttgacttgtctacaaaatttactagagaaattttacacagtgtagttctaggaaaagcatttctcacggagagagtgtgcgcttctatacgcacaattgcacgagtcgcaagtcgcaacacgatttttttctgttattatacctgccaagtaacaagccaccttttcaatcttagaacacataaattttataagttctttatagggattagttcgatttccctaaaaattcttcacggtttctccatttcaaaggaggctggttccctgaagtgtagtgtgactgcaacataagcaatcacaggctacaactattcgatttgaatttaagggtaaggatttgctatagatgagctattatagcgcaatagatctgaattcttcgtgcaaaaaaatggatggacaagatcaactgcagttacgactgtagctgatctcaatccatgggagctcctgtgacaccaaaataatctaatggcatgggagctcctgcgtcacattggaggcccccagttggtgtggtgttctctgtggcgatgttccaaccagaccggcttcaatggttagagcgatggcaagatctaggcgaatgactgaattacgtcccagttaatctgcaacgttatctttctttgtggttcttatggtcaatgatgtgagtgagattcaatctgtaatgatcatctcatgtttttagagattatgtttctttgtttgagaagatcataattaaatataacttgcaagctattgggaaacaacggttatatacacagattctcaatagcagttttacctctgtctttaggttgatagttcaagcagttttctcgttttaatttaagttgtgattttgtaattcatagttatttgaccagtaatctgtgtaataataatt

SEQ ID NO: 1223 - DNA, 1501 bp, Oryza sativa
aattaaattttagaattgaaattttagcttaattgtaagcataaatgaaaagaggtagttgatcatatgttctaatattataatactcactctgtttctaaatatttgacatcgttgattttttattacatgtttgaccgttcgtcttattcaaaaacttttgtgaaatatgtaaaactatatgtatacgtataagtatatttaacaatgaattaaatgataggaaaagaattaaaaattacttaaattttttgaataagacgaacggtcaaacatatttaaaaaagttaacggcgttaaatatttagaaacggagagagtattataagtgtcattgataactagtgacacgacagtaagtggttgtacacgtacattttcctaggctgaaaaaaaaaagaagcagccttgtagttgtacttgttcatcgtcctagcaattaaatatgcagtgcaagtgtgcaactagatgtcctgaacagcacactaacacaaccatcaataattaatatagacaagcaggagcatgcaccggcaatcactattatgagacgagaaacagtagaaaaatacaaaagagttaatcaaggccctatttagaatggtgaaaaacgttctgttgatcttaatctacacggagaaaatggactgatttatgtgcaattcagcatttttaatcaaatcgctgagaaaccaaatcggttcacacaaatcggctaacctgcaataacaaagcaatgttttcaggaagctctagatcactatcatttcaattagtagtagggacaaccgtaaaaattattcatcaattattaattgttagacaataatggcagtaatagactaacaacagtggcatgaagtaaaagatagtaattatattgaggcttattcttgcatgcgtttgagaaacagccaagaagaagaccattcaatttcttcccggatatattccagttacgccgaaacggtaagcagaaataaaagcatgaccgacatttaatcatataagctgtggccagcttcaattcctaatctcgccaagagttacgtatgtaatttatcaatcatgaccgacaattaatcatataaaaaatgtattaaaacgtgtcacaaactaagctagtagctactagctgtagctataattaatgacatgcaaattaaagaatccaaagctatatatatagttgttgtcttgtttacattccttcaaatttaagccaaattaaaggcatcacgaatatgaagatatatagagcgttccgcgttgtttggaaataaatttgaaaatacactgttgttgactcgtttttttctcacaaatatttggaatgtaaatttattagcataaatatatcgtcgatctcgcacaacagttccgcgaaagtgacgtggatgtgacgacgcaaacggtctcgcacaatgacagcgcgagaccgcacgatgtcacgtggtggtagcgtgagaccgcacggtctcgcacgatgaaactacgacac

SEQ ID NO: 1224 - DNA, 1501 bp, Oryza sativa
taaaatttactctaataaaaatataccatgtaagttcacgtggcatgccacgtatgcaagatcattgtcaaacaagactgtgaatcgaagtgatataataaatcaagtttagagacatcgatacgcgtttgcaaatttgtggacataggtgaaacctctttttcaaatttaaggaaatttaagtactaatcgtgcaatttactcaaatataaatataggtaaattgcacttctgactaaagtttcactttatattattcttatagtattttttttcattttgaactagttattgtttccacatgttaccctttagatagggtggcctatataagtgaattatgtacaataaaggtaattagtctcattgatatgtgggtcaaccagtttaaagtgcaacatttggcaataatacgcccaaagtaaaaaaaaacactttgaggatagattaaagtaaaattttgataaaaatatgtggcccaaaatgtaatttactctataaatatcagttgtgtgttttgtttatagagaaattggcacgtcaaattatttggtttagttcaatgtcaaaatgtaattttggcattgaagtccttcccaattcatggagaaaatattaacaatggccaatttggcaaggctaagaattgcaataaaccaaaacaagtcctaaatttgtgtagctctaaaagtttgggggaatactcgtatttctaactggtttgtaaattaagaatgaaaatcaaatcgaagtaaaagaagtcatttctcaagctggtaaaaaaaatactattttaagaaaaatcaaaccaaaatatatgtgaaatgctcatgctgtggctactcgaaatgaattgtatttcaaaagaaaagttatggaattacaaaatcacctttgaagacaaaacctacaaatggttaaaattatattgacatgaaaagtttaagtacatttgcaaaactaaaaatacttgaccaaaccatcgtaaagctaccaatttaagacgtttattaccaaaatatagttttagcacctactttatcatggatgagactacatatttaaagcagagtatcatgaaattacaatagtagtgaagttatcataaaaccaaaatttgcagtttagatcatgacggtattattatttttgagttataaatattctagttgtgttataaaaaatgttactatagtttttcaacagtttgagcaaagtatcaaacgatcaaactgtcagggttatggataccacatacctaatagtagttgactaaatctagacaggacccaccacataccatgtcttatacggaaacaaccttcgaatataggagaagttccgcataaggaaggatgaatagagttctacatggaaacgacaagaactactcggattgtatccatattagtttctctagttctacttggacaaggggatatctgtgggtataaatacaaggccccctaggaggagaggggacacggaacaatagatcaac

SEQ ID NO: 1225 - DNA, 604 bp, Oryza sativa
cgcctgcaaatgggcggcgggggggggcatggaaatttgcaggcggcccccttgccgccctccgctagggcgattttgtactgtgcggggggccgcctgcaaatgggcggcgagggggcatggaattttgcaggcggcccccttgccgccctgggggagggcgatttttgggcccccccctataaagcccagcccctcctctgttaaatttcattatattcactaaaaatccagaaaaaacgaaagagagagaggggagggcagcagaagcggagcggcgaagccctgctggttcgctcacttcatcacaggtatgctcccatacatcttttgcatttgtactaatatgttatgattgagtatatatgttgcgttttagttttagttccatatattttagcacatatgtgtagatccagagcatagaatataatagtatgaattgagacatagacagtagtgttaattgtaagatgtagtttagtttgatctggagaatgtaacgtacttttagaaatttagaggacaatattgtagagaatgtaacttaaggcgtagtacagaaatgcgaggttaacgcagttaatgttttcatcaggcacaa

SEQ ID NO: 1226 - DNA, 1501 bp, Oryza sativa
gatcagcatgcaatatagacttattccaatcatatgagacatggttcaaagagatgacaactcaactaagacttctctcaggagcaacggcaccatatttcttctctctaaactaagcacgcaagcaagggtacgtgatcaaggatacgagatggagctgcttgccgttgtcactgcgatagtgaatctggcgagcaagatcgacaaggcggagcagagggctcaccggaacaacaagaagcgctgccatgcatgagctcgcccagcacgcgaagcaagtcgcccaagccgtgaagggctacgagcaggatgacgacgaggacccaacgctgcaggcaaggacgaacattctcaacaaggccctcgaccaagtgctcgagctcgtcgagtcgtgccgccgcgacacgcaggagacagcattgcacaccctgcatcgggaggccgcggccgaggtgataaggtgcagagtacttcagaactcagaacatgcctatgtgtgtgtttttttgcaaggagtcgatgataagtctaaaattacggaacgaaatttcaaacccccccccccccaccacacccgctataggatattatttcggtcttttttttttccttttcttatgaatttggtaatattttttttcattttttttcatctaatttttttcatcttgctcgttgtagaggattcgtaaaaggttctgaagacactaagaggtagcattaaggtacttactacaaataactagaggaacataaaagagattaaaggtagtataacaggtaatagaagtggtccgaaagcaataaaggttgggcgaagctgacagtggcgaacctagaacaaaaattacttggcgtccactacatagtagttatctacttattcactagtatactaatcaaaatagcataaattagttagaatttaacaattttacccggtgccctttgacaccggtaagttgtatgtgggcacgccactggcagttgatcgccattaacatcctttaaatgcttctaagccgccaagtgatactctataaacgcttctaagtcgtcaagtgtcattcttgtaaataagagaaattcgagattgtggtagctttgcttacactgatcatgtggcttggctgagcaccttttccggcccattccattgtggccttcgcatcaaggttgcacgcctttgcaatatctttagagcaattacactaaatttttttgtacattctcaaacaccgtagaattactcacatcttttaagtgcctgtggggagggtttctcctgaccattgagcagattgaattttttttaaggacttgttgaagtatcactgagcgggtggcgagcttttccttgagggccttggttctaatagccatatgctttcatcgattcatggttatttgcttgctttgctgccaaaatctgtaacattgccggccttttctttgccgacttatgcagattctgaggataagtcagagaaattaaagttca

SEQ ID NO: 1227 - DNA, 1501 bp, Oryza sativa
cctccgcctcttggcggcttgcgcgcggagtggcgggggccgggggatgacgacggcgatgacggtgggatggtttggagcggcgcgacgacacgggcgacaggcgcgggctggcgcggcagagggtgacggcggcggcgaccagacggtcggccactcggcttgcgcgcggcttgcaacgggcggcgtccgcgcgggcgcgcgcacgcgaacacggcgcgtgggaagcggttttgcgagcgggaagctcgcgcgaggggaggggcgctcggcgcgggcgactcccgcgcacgcgcgcgcggcgcgcgggcggagcggaggggagcggaaaaagaggcgctcggcgcggctctcgcacgcgcgagcagcgagcgggcgagactgagcggggggggggaggagcgcgccggggggagagagagagagagggagagagagagagagagagagatgggccgaggaagggagagatgggccgagcgagattcggcccatcgaccttgggggaggcaaaatagacttttgcggaggaatttgattggaaggatttggattcggaattgaactcgacgatagatcggggattgagatcttgagatggcacggacactagacaacaagcaaggaaacaaatttcgcaattagggtttttaagagataattttcccgctaggcgccacgacggaacgggcgctacaatatgtaaattacttttagactttactaaatttacttttatatgtctaagaagtaacttggtgaaatctaaaaataatttagacatatcataaaagtaatttgtgattttttattaaaatataatcatgtgagatcttgttgtaaagatttaattattacaaacacaacggtgtaatcggattgtaaatcagatgagtaatttaagagaaaattttatttgaagcatagatgataggaatatttcccccacttgctcaatggattaatagcaaccaaaactcctaaagtactagcacgtggatgtctctggttaagactaattggagaggcctcttcaattagatttaccgtttgatattggtacaattttttgtctggatgcatgcatatgcatgtgtcggcgacatgggaccgggagtatcatgactagaggcttgggcagccgcgatcacccacgtggcctgaccccctcgggggggtcgggcccgagggtgatgtggccgcccctccctttgtctccccgaggggtcggaccgctcccgtttcggccccgagggccggggcgccccgaccccctgtgggtttggcgccacgtggatgggttaggtgagcacagcggggctcacctaaccgcatttattgcgggttggacgagcgcgtcacgccgcatgtaatgcagcgcagcgcgctcgcttatccggtccgtgaccgggcgcagtgtgtgaccggtcacagatcggtcagatcgcgggttaggtggtggcaggcggcctgttacacgcctcgccccgtcccgtcgaat

SEQ ID NO: 1228 - DNA, 1501 bp, Oryza sativa
tattattgttcagtgtatagtaccgaggagatgaaggataatactttgcaattcagtgtttgaagaagcacatattttgatattggacgtaactacacagctaggataaatcagctaccacttcatctataagagacaccatccacctatacttcaaatacaatcttctcttaaactactaatccgatctacgatccgattacaccgttgtgttcgtaacaattaaatctttacaacgagatctcacataattatattttgatgaaaaatcacaaattacttttatgatatgtctaaattacttttagatttcactaagttacttcttagatatataaaagtaaattcagtaaaacctaaaagtaatttatatatattatagaagtaacttagaacaaaacgaagataactttagcatgtcatttgaagtaaatccgttgtaaagataaaaacataactttatctagaaattaaattaatcagcacaaattatggaattaactaaaaaaaattaataaaagtaatcgcttcagagcattatgaatgtataggaagtattttaatcaaatttaaaagtaactcttatatatatatatatatttatagataatttgttcaatgaaaaaaggcattaattaaagttattttcttcttttataagttacttctataatatatgtgtcacgccccgaactagttccgaccggaacaagcccgtgacgctccaaataaacctgttaatcgataccagtcccaggagacagtgctggtatcacagggagacagaatatcacagcaacagaggtctctttattatagagtagaattacagtcatgttgggctgcggacagatcccgagctcacaactgcattacaaaaagaaagcggaagccaggacttggaccaatcatcacaggcgcgacttgggaactaggccgaaaccctaaaactcatcatagccagcttgctcctggaagaacacctcatcagcaggatccgcttcatcttcttcagcaactggggggggattatttaaatagagcaagggtgagtacgggagtactcagcaagccaggggaaataagtgtttaatgcaggcttcaaggaaagactgttgttttcgtaattgaatttatttgaactcttttctgaaaacaactaagtgagtgcttctcaaacgacacggatgagacagtgcgtctcgtccagtcggagtatgtgcaatgcatcagtctttagatcttgaaacagggttggcactcggccaacagctttttaaacggcctcccgggccaacaactcttcaaacggccacccgggcctagctgatcccgtcagctactgatttttcaaacatcgaaccccttttcacaacagcaatttcacaagcagtagacaaacaaaactacgctaggaatcacctcacatccgcccatgaccgtgggcacggctgttcgaacagtttgttaacctctgcagagggggtacactttacccaca

SEQ ID NO: 1229 - DNA, 1501 bp, Oryza sativa
aaatcaacaaaacagtacaaaaacaagcataaacagtacatgtggatatttttaacatgtagatcttgattttagaaaaatttagcaacttgaaccacctgaaacggatctacggttatttagttatgattttccgaagatttaatctattagaaaaacgagaaaaagaaaaaccgatgacgtcatgctgacatcacccatggccgaaccaagatggcgacctcgccggagatagagcggctggctgcggatttggagggcatgtacacgtagaggacgacgagacgaacccgatggtgctcaccgaagtgccgaacgacgacggatgacggccggcgacgaagaagcgacggcggcggcggcttgcacggtggcgacggctccacgggtcacgggagaggacgggagagggggcaaacgaaagaggaggactagggggtcctatttatagccttggattgaagagatcggactcctcccgcaagaaatcgctccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgtaaggtggcagctcgggctctgtccagagctggaagatgaacagtagcagagggaggaaaagtagacttttccggctgggcttcatttcctcggcccgattgaaggagggaggcaaaacagactttgacagagagagaggagggggcggctgctgggccgattgggccggttcggccgcgcggagagagaaagagttgggccgaaatcggcccaacgacttagggaaggatttaaaaactttttccaattaaaataatcactgaaatgatctttgaattgttaaaaatacttccaatactcaaataatttcaagaaaaatcctgaaaatacttggacactcaaagtacttaacaaaattataatcagaccatttaatgattaatttaatatttaaataattgctgaacttctctttgtatgattaaaattaataattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacataattaaaatccgcttttccttttcgggccgaaataggaaaagttcacctttagtcctcggcccgttcttccttctattcggccggccttatccccccgaattctagtttgcatccctccatctatcaggctgtgcaatagaagcccagccaaaagtctgttttgcatcccctcgctacagt

SEQ ID NO: 1230 - DNA, 985 bp, Oryza sativa
ttcctgcagccctatccgggggcaacgaaatttcagagatctcagaaattttggaaaggaaatattttaaatttaaacaaacttgacccatttttttagaaaatgactaaattcattaaaactgagattttaatttccgatctcagaaattttggaaaggaaatattttaaatttaaacaaaccttgacccatttttttagaaaatgacgaaattcattaaaactgatattttaatttccgggggagatagtttcgtgtctgcaatttctttgaagcatcgaatgtttggtcacaattcatacacaaagatctgaaacctggtttattatttacccctccgtactagaatataagtattttcggatttccacacaggctttgagatgctattttgaccaacaatatctataaaaataaaatattttaaataaaaagagttgcatttatgatagtttgattaatgataaatctaataacatcaattttacatgattattttttttattttttctattaatagttaaattttaaaatggttgacttggcactacgctaaaaatgcttatattttaggacggagcaagtatttactttgcacattcttgtttcatcaggttttccctggatcaggggcggggccagggcgtgggaactccggcgccggcgaggcttgagcgtaaggagaggagaggagaggacacaggacacgtgtgatgatctcctcgatcgtcgctgtgtccatgaccaaaactccaaccccttctaggatacctgcagctgttggatcggacctgtgcggcccagatatgagttaagaataactaattgaggtaaagaaaacacgtgtaataaattcttgggctgagcaggaaggccgggttgaagtctggcttgatctcggccagtcgcgcacacacgggccatctacacttggccggagaagactgaagatcactgcagctgaagacagacgtcaatcgttga

SEQ ID NO: 1231 - DNA, 1501 bp, Oryza sativa
cttttgtcaaaagggttgggagttttcttctccaaaaccccctttccccctcatgcatgcgcctctccggagcaccgccgcatgctttcagcccctcatctacggcggctgtaaccaaacgaacaccctaccacgaggccacctcctctctacttctttagcacacgagaagaggaagcacctgtttggcatggtgaccccagccgtcggcgactgataacgaaatcgctagttagtgactagtcgcgcgcccttcttcccgcgcggatggacgcgtggcgcgcgtagaagggaagggggcgcggcggccgcgcttagtgggggtccacattggtttttttcgccgttttttgtggggtttcatacggttccttttttatgttttttcttttttttccgtactttcagttttcagttttctttttttttctgtttttcctttctatgtttttttagtttttttaaggaaaaagtacgaattacccccccccccccccggaactattccggtagtacgatttacctcctaaactacaataccggacatttgacaccccaaacacttaaaaccggataaattacaaccctaactcgattcgaacggttttcagcctacgtggcacacacgtggcggtacagtcagcaaaaaaaaacaaataaaacaggtggggcccacctgtcagcatttttttttcactcctctctgaccctctctctcggagaacacagcaagcggagggcgggcgaggagccgaccgacgacgccgacgggcggtcggcggcggggatggcggcggccggcgggcgagcgaggatccgacgccgacgggcggccaacggcggggatgactgcgggcggcaggcgagcaaggagccgacgccgacgggcggtcggcggcatggatggctgcgggcgggcgaggagccgacgccgacgttcggccggcaacggaatggccgaaaaattttggggggggccccccttttttgggccccccccgggagggggggggtttttttgggacgaccccccggggggggggggccccccttaaaagggccgaaagggggaaaagcccccgaacccgaattagaccggggccggccgaccggtggggatggctgcggacggcgggcgggcgagaagccgacgccgacgtgcggccggcggctgcgggcggcggacgaggagacgaggccggaggcgggcgggcgcggagggggctgtgagcaccggtagatgaggttggcgctcgatgaggttgcggcggtagagctcgaggatgctggccatggcggcctcccgctcctcggtctcctcgtcgttcgtgtcgagctccttcaccgcgaacgttgtcctgtgcatgttcctccccatcacgatctccctcgtagtcgaagacccctcccctccgtcctcccccgtatgcccaagcgagcagtcgtcctcgcccctgtccgccgtcgtcgccgcatgccacgctccgctggctctgtgtct

SEQ ID NO: 1232 - DNA, 562 bp, Oryza sativa
attcctgcagccccgccgccgcatcctagctgtcccctgcggcatgcacatgaacataccaacacccaagtgatcactgactctgttttatagaatgcttgatagcattatcggttcagtgttaaataatctggccgcgaatgcttgatgaatatacggtttgtggagatgccaaaggaggtcggagttttgaattccgatcccagttggcatcatggcatttgtgagatccgctagcatgcaaaccaagcaacgctgcaacgtgatcgatcgagtaacctgctgcttgctaatactggaactggagtactagtagttctcttctccgaccccccccccccccccccggtccacttacttatagggccggcccatactaccgcaattctggcccatacggaggcacgtcaaccgcgaccccgtttcggcctagcgattcgtctccactagagcagcaaaatccctcgacgatgacgaggccgcggaggcggcgtcggcagggctgcaggggagcaatcgggcagatagtgcaaacagtctcacgccacaacacgcccggcca

SEQ ID NO: 1233 - DNA, 1501 bp, Oryza sativa
aaaaagaagataaatgttttacacgtgcatgatcgttttggaattgtcacttatgactgatcgtgtaaattcctttgtcggccacccattcgcaacaatgtttggcctgggctggcatgttattttttctgtttgtcttttctttattttctaaatggtatataagggtacaatggtcatttcatttgtactgctgcatgcgaggatgacttagcatgctcacgtgatatttttatgggtctaaggaatatattataccaaataattaatttgaatgatttatttggacaatttaaaacatcaagaactaactaagcccaaaacataacttcaaggaccggaccgtattagctattcacctatatttttaagtataggtagtttcggaggattttccctgaagaaaccaatgcagaattcccgcaaatatcttttagtaacttttttactgacacgaatcactcccacatccatccgttcagcgatcattttactaaccacgtataacttcggtattcatcgtctagttattattttaccaacatgtataacttctgtaaccatcatttaataatcttttgttataaaaacgacacgtatagtatttgtttgggttggacaaaaatagatcaaccgtaaactttttgactgcactttgacatgtgaattgcaattttgttaccacatatagttaatgggaaggagcctcgtctaggagaatgcaacactcaaccctcaccttagagcaagtacaacataaacaataagtactactggagaagataagagaggagagagaaaagaagcgggctataaatttgtagtcagttataacacgaactccacaacactatgtatatatgataggtgggaccagatattaatggtgtaatatatatttataggtaactattatataaattaactattagattggctaaaaatgatttggagctaatagttgtattggctatactattaaacttgcactaacagagtaattttttcactatccaagagcttccactctctatctaaaggatgcaaataaaagaattactcctcacatattggtcaatccatccattaaaaaaaaaacctccgagaatattggtcaatcaatccagcaaaaaaaaaaaaaaaactcctcgcgtattggtcaatcaatccataaaaaaaaactccccgcatattggtcaatcaattaatccatataagggaaagtgcgggctccttgaggtggtaaaaaaattaccatttaattaactaaattgtatacagggtgggtgtagtagtttcctatagacagacacacacgagcgtgcacccgcatgcatacatgttattacgtgagataaaaaaaatataatgatactagctgcacaatgcaggccataatgctagttaagtactccctctgtttccaaatatttgacaccgttaactttttagcatatgtttgaccgttcgtcttattcaaaaattttgtgaaatatgtaaa

SEQ ID NO: 1234 - DNA, 1501 bp, Oryza sativa
aagatattgcatgtgggttataaatacttgtgtgcatggatgcatgcatcaatgtccatttactccaatgcacaaataacgaatagactctaataaatgaacacaaatatgtagatcatttaggaataacctcaaaaaaactatatgtagatcaatttggaatggagtattatagaaattaaagttgtttccgctagaattatgatacgtcatccgtatttgaatcgattttagttttatgtttctatcaaatcatttccttaattttttcttatgttagagtgtccctcttatccgagacgtgcatgaattaattgggcccgcaccttttcacgcgctccttgccgcaggcaacaatcaggcccgtgcccgagtctgttttccacacgcgcctttgcgcgccgccgcgattgggcctgcaacgccctcgcgcacgcgattttccgtatacccgatagtgcccgattgggactgcgtcgtcctcgtccatgacttaaaaattgaagatgtttttgtcaaaactatggtatgttgtccgtatcggattcccgtcacgcctaacattcattgcaaggtcatgactcatgagcgaactacgaaagagagtccgtgtgatgcggataccaagcgaatgaaactcgcatagtccatgtggatatcacgtacatagttgcctagatcatctaattctattcatattatgcggcacaattcctaggacatgttagcatgatttcaagtcagtttccacacatgctcatacgtactatcccactatcagggatatcgttacaataatccataataatcattatttacttttgaaaagaaaatgccaaccgaaataaaggatgaacgaatcatcaattcctgcctaagttgagataaaattggacgacaaatcaagctcatgtttaaaggcctcattgtttggcttatgcttattcttataagccaattttaaattttagaacttaattttaaatttgactttttggcttttttatcgtactttattttatagtatttgctttcgagtcgttaagaacatgcataaaaaatatttgcacacaaaatagtctttacttagttataaatgattcggacaagaataaacaaaacagtagattgtaattatttatccaccgacacatatgtacaaattaaattgactttacccgttacaacgcacaagcatcttttctagtagaaataaaatataagttagctagatgagataactttatatacttatataattttcatctttgatgattaaaagttataattgtatttataataatttaagtcatatatagattgatcattcaattcaaaacaaaactaaaactaaggtgatatggcttaatgcaagaaaaaaatagattaattatctgaggacaaaaaaataattaaggtgtcgtgacttaataaaaaataattaattaagtatactcaatggggataatcttttatagaaataattaattacgatgatgtg

SEQ ID NO: 1235 - DNA, 491 bp, Oryza sativa
gggggcatggaattttgcagggggcccccttgccgccctgggggagggcgatttttgggcccccccctataaagcccagcccctcctctgttaaatttcattatattcactaaaaatccagaaaaaacgaaagagagagaggggagggcagcagaagcggagcggcgaagccctgctggttcgctcacttcatcacaggtatgctcccatacatcttttgcatttgtactaatatgttatgattgagtatatatgttgcgttttagttttagttccatatattttagcacatatgtgtagatccagagcatagaatataatagtatgaattgagacatagacagtagtgttaattgtaagatgtagtttagtttgatctggagaatgtaacgtacttttagaaatttagaggacaatattgtagagaatgtaacttaaggcgtagtacagaaatgcgaggttaacgcagttaatgttttcatcaggcacaa

SEQ ID NO: 1236 - DNA, 1501 bp, Oryza sativa
acgtgacttataatatactccctccatctacttttgatagtcatatttcatcttggcacacagatcaagaataagtgattctacttatcatccatttaaacatgctactagtcattcctcgtaaacaaacgatttattaatatttacatttctcgataccaatgtaactaatcttgtgtggaagaatagagagtcacgcattaaatccaagaaagacattaagatgataagttattggattgaaatatacttatcaaaaataaaatttttagatttgaaaatatgactatcaaaagtagatggagggagtaaaatattataaaacggagggagtacacattttatacgtaatatcatcgttcatctgtaaactgatcgagacgacaacaatatagtagagaaggttacttcacgattagaaataatcgaaactattacttacttttactgatcgtaatactctctccatctacttttgatagtcatattcccaaatctgaaaattttatttttaataagcatatttcaatccaacaacttatcatcttaatggctttcttaaatttaatgcgtgcctctccattcttccacacaagattggctatataggcatcgagaaatgtaaatattaatgaatcgcttgtttacgagaaatgactagtagcacgtttaaatagatgataagtagaatcacttgtccttgatccgtgtgacaagatgaaatatgactagtcgcttaccagccttcgaccttgtcagaactcgtagcgatatataggatatagtatagctagctctcccgagcactaaacagatggatgagatctcgtttgcctttgcttctggcaaagcttacaggcagccagcacgggctgcacggtatttattcttgcacgcatagcatacgcctgaaaaacgccaaagcagtccgtgtcgtgcatgtctgttctccgaatgaatcacatatctataaaagattatccctactgagtatacttaattaattactatgcgtttttattaagtcacatcatcgtaattaattatttctataaaagattatccccattgagtatacttaattaattattttttattaagtcacgacaccttaattatttttttgtcctcagataattaatctatttttttcttgcattaagccatatcaccttagttttagttttgttttgaattgaatgatcaatctatatatgacttaaattattataaatacaattataacttttaatcatcaaagatgaaaattatataagtatataaagttatctcatctagctaacttatattttatttctactagaaaagatgcttgtgcgttgtaacgggtaaagtcaatttaatttgtacatatgtgtcggtggataaataattacaatctactgttttgtttattcttgtccgaatcatttataactaagtaaagactattttgtgtgcaaatattttttatgcatgttcttaacgactcgaaagcaaa

SEQ ID NO: 1237 - DNA, 1501 bp, Oryza sativa
tactcgatgtatttacgacacggcgccggagctctcgccgaggctgagacaatctggtccatgttcgaatcgtcgtgttattcatcatggagatggagaaagaggaacacgctcggctcgatgcggattcgacgagtacgtggcgtccgtcttcagctgcagatggcgacgatcgaggtacgtgatcttcagtcttgtccggccaagtgcagatggcccgtttgtgcgcgactggccgagatcagccagacttcaaggccttccttcttgctcagccccagaatttattatacgtgtgtttgacctcaaacagttattcttagagacaatttcctttttcctcactatctctaatattgatttttctcctatttccacttttttaaccgaaagatacttttacccctattttaaatgtaggagttaacagtgttaaataggacatatataccatttcccatatttatttattaattatgtttttcccccattagccggaacagaaagttcagaattctcatgtggacctagaaataacaagagttcaccagaaagctaaaacgtctatataatgcaacgttgtacattagcagtaaatttgacatccacggaacaatgtaaacaactagctgagtggcccgcgcaattgcgcggctagcacccaaacaaaatcatatatttttttatgattttacttaaaatttattaaataactatctcattgtcttaagaccttgaaagaccaaaccttatcatctttgtgtttctaattatatagtttataaaagtcacacctgttgctacccattatgtcatctccttctttatttgcttgctcgatctaccactatttctattcattcttcttggaacctttaaaaattaaattttatagtttttaaagtttattatcacgttggatttcatttttataatttctagatgtcccgtcaaaggttgccattatactcctctatggcccgtccactgtgtcttctctttattgtcattgagattttaaaaatcgaacataattatcgttcgggttcatttttactttctagaagtcccgccaaactgtcagcggctttgctagtgcactcctctacggctcgcctgctgcctcccttctttattgtcattgagattttaaaatcgaatatgattatcattgtttttttttactttttagtagttccgaacctttaaaaattggacatgtagttttattttttataatttttagaagtcccatcaaacgatgccattatgccctctacagctcgtccaccgcctactctttattgtcattgtgattctaaaagtcgaacataactatcgtcggaattcattttttattttctagaagtcccgtcaaccgtcggcggctctgcaactatactcttatacaccccgcccgctgcttctcctttttattgtcattgagattttaaaaatcaaatatgattatcaatagggtttgttttatttactttataga

SEQ ID NO: 1238 - DNA, 1501 bp, Oryza sativa
aaacaaatagttctggagagagttcaaaccattacactcattaataatagtcatgtcctatgttctacaaatcataagatgaagttattatacacaataatgtggaaaccatcttaaatgcgaatacaattatctcatcattattcatgtccttgtgaatttgtgaaaaatataaaaataatttgtctaagcgactcgtaggatatgagttataaggatggaaaaaactagaggatgtatagtcttgtactagtggcacgaaagctgggacgaacaattgtagaacgtgagtaattattatgaatattatatacaaatcatttgcttatacgataggagctaatgcaatttcatatcaaaaatggtggatgcaatctctaataataaagaccggaaaaaccgaagactacaaatcaatcagataaagtttattaaatttcataaaataaggctttatctgtgacagtaacacgatatgtattttcatcccttaagaatatccccgttttcacattgtcattcaaataatcactaaacaatgtgaatttttttaacaagatagattaatatatgatatatcactctacaaatacgcaatttcaattcaatatatacaaattgtaacagaaataactatgaatattctctgcaaatagaggaggctttctcttgctatgctatgattatttagctctcatgctcatgctcacacattctcatagcatggcaagagaaagcctcctttatttataggcctacctagccattggatctttgacaaggattaagacacttatcctaatctagagttttcacttcttgctaaaaatacacatgtgcatccactattattaaaaatatatatttactaaaagtgtttctgataattttattttactattgtagaccatttgtgaagaaacatctagtccgtaaacattttggaatattcaagaagatttgggttgtctgcttttactccctataattaaatctaactagtgtgaaaatttagaccctctttggagaaagaaagaagttctcaaattctaccatgatttaatttatgggaaaaaatcaattcataatgaattgaaaaacaaaccatctaataggttaatgcatatgttaacttggtaagaactggttggtggatctaagatgaaaacaatcacggaaatttgccaattgattaatatggtcaattttcgactgaaatttctaaagatatgctaccagtcccgaccatttttatccctagatctatctatattttcatgaaaaacacaacatgcaatagctgccaattggggtctgtctatacttgcatgttggaaaagcaagacatgtaaagtcaataacttaaatctaggtagtcaagatccaccaaaaagaacataaccagatgagctaccttgaaagattttttttctcagttgatgtgatcgatcgaagcaactccgtactccttaccaagttaggtgtgaattgtcataccact

SEQ ID NO: 1239 - DNA, 1501 bp, Oryza sativa
aagaccgaagactgagaccgaaatgtttggttagaccgaatgtccacccctacccattgagaaacctgaaatttagaaatatcggaccatgtttcagtgacaatttgagccacctggatctgttattcgtgaatgatttaactagcctctctgcttctccagccaatcaatcatcttttgctggccggtcgctcccgtccaacaacgccttattgtgaatgtgggttggtgctgaagcctcagctgacgactgtcacactgatgtgtgctctaccttatgcataaattcccctgctgctcgcagtcttagccagatctaggttcgtagcgtccagcttctcaggcggtgacaccacaagttggctgttgtaatgtatggaaagcaaaacaaacaatataaagagtattcatttatttaaaacacatcacaaattaagtactattcaatgagattggctctgctggtacctcatcttctgattctgattataagtaaacgccgacgcaatatccaaacaagacggtgaggactataataccaagccaaaccacaacgatcccaacaacattaccgaaaacatggtatcataccacaccgatcctaacaacatcaccgacaacaatcctaacaacatcaccgaaaataccagcgaaaaacaagggtaaaactgtgatgaaggcgaacacgacgaggaaaacgtgaaatccacgtaccaataagagctcatcgcagcaggtgacgcgtgaccaaagtcgtcgagaagaagagataagccatggtgtaggaaaatcacgcaggatatcctccacatggtaaccatcatcatcaacattagtggcgacggtggagtgcggccataaaatcatccaagcaacatataatgtcgggacaagcaatgtcatggagatcaccgccgccgatgagatgatcacggcgcgcgtgtactaaatatatatagttctaaggagagctcaaaccattacatagaacattcaacttttagtaatgttatggtgtgtcctaatgttgtactagtcataagatgaagctagtacacacaatcatgtgcacatcagtttaaatgtaaacacaattgtcttatcattatttatgtctttgtgaatttttgaaaatataaaataattaatctaagctattagtaggatatgagatgaggaaaactaaaggatatatagtcttgtacaagtcacaaaaacaattgcagaacatgagtaatcactgttaatattatatacaaatcatttgattatggaataggagccaatgcaatttcatataaaaataagaatcaaagactgcagatcaataagataaagttttttcaattccataaactaaactaaggctctatctaatacagtaacagcaatatgtattttcatctcttaagaatatctctcgttttcatattgccattcaaatagtcactaagcaacatgaaaaaatttaaactaaattgcgtctacactacataaactt

SEQ ID NO: 1240 - DNA, 1501 bp, Oryza sativa
gatgcggttttgggacggcgcgtgtgttggcgcgaggagcggtacacgggaaggtggctcggtgtattgcggctcggtcacgaggcgaaagtggtgcgacgctgggtgagacatttcgtcgaacaccttgcgtgcgtgagctggctggcctgaggaggaagacaaacagtggctgggctgagctgggccggcctgctaatgggaggagaagagaggagaggatggaggggagttgggccaggaaagaaagagaggaggaggcccaaattgtactgtgatatttcacaattatctcaaggatttggggtttgaaatttggggagatttttgggaggatttgaatttgaatctgccctagggtttcatggaaatttgaaggaaattctaagagaggattgagatctaatttggcacaaaaacaattaagaaccaaactaaactccaaattttaaatgacaaacttttaaataaaagcacataaaatatgggtgctacaaacctacccccttaaagaatctcggaattaaaaataagaaatattaaaagaagagtccatataagaacccaatacgaaattaattaaaattcggaataaaaataaataaatccaaaatcagcaaaagaaaataaaagaagagttcatgtaggaatgcaatttaaaattagctgaaattcggaattaaaaataagcaatattgaaagaagaatccataaaagattaattaaaatttagaataaaaataaaataatgtccaaaattagaaaaattaaaagagagttcaagtaggaatacaattttaaaacaactgaaattgaaaataaaaataaaaacattaaaataacacaatactgtattaactaattttttaaaaaaattctaaaattataaaaagaaaaataagatttcaattaggaataataagtacaatttttgataaaaataaagattattgaaagaaaagaccatctaaaacacatgacgagataaattaagtaacatgcctataaagtagtagagtggtggcggttgatacgacatataaaaattgttaataaaacaccaaatagaatcctaatgacgattaaaaggagggacgtcaggcaggccgtgaatcaaacgagcaaggcggttgccgaggcttctataaagtaaataaaacaaaccctattgataatcatatttgatttttaaaatctcaatgacaataaaaaggagaagcagcgggcggggtgtataagagtatagttgcagagccgccgacggttgacgggacttctagaaaataaaaaatgaattccgacgatagttatgttcgacttttagaatcacaatgacaataaagagtaggcggtggacgagctgtagagggcataatggcatcgtttgatgggacttctaaaaattataaaaaataaaactacatgtccaatttttaaaggttcggaactactaaaaagtaaaaaaaaacaatgataatcatattcgattttaaaatctcaa

SEQ ID NO: 1241 - DNA, 1501 bp, Oryza sativa
ttagttattttttctgaaaatttaatacattttaagttcccataatttattttttttatgttttgcgttcacgaaaaaattttcatgctgttttatggtatttgctaaaatttgaagtgtttttttttttggaacaatccttcgggcctagtaaataaaccagactgggctgatggttgaacccgaaaaaaccagaaccaccatccttgtggggtcggtttgctacaaagactagacatgcaatttgactgctgcgaatcgtgtgaaccgaaccaagcaccgctaccaaccagctagcttgctcatgccaaaaaggggatatatgcattgtcggtgatatgggaccgggagtatcgtgactagaggcttaaggcagacacaatcgcccacgtggcctggcaccttcggggacgtcgggcccgagggtgaggtgtccgccctcctcctgatttccccgagggggggggtagggtgactccagcctcgcccccgagggccgaggcgccccgacccctcgcgttttttactccacgtgtatgggttaggtgagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagtacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaagtgggttggttgattctttccagattcagagcctagaacgagggagaggtcggctcacactttgtagttccttcatacacagatccaccaaaacacaggagtagggtattacgcttttcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagtgtgtgttttctgagctctcgtactcctccgtgtgcgccaagtttttcttgttcagcctaa

SEQ ID NO: 1242 - DNA, 1501 bp, Oryza sativa
cacggcgggcggcggggccgccggagacctggtcgccggcgaggccgcggcggcgactcgtcgtcgcggcgtgggtggaggaaagggaagggggggatggggactggagacgaaggggttatatatggctggaacgtgttcacactgtacccggcccattcccgaggtaccaaaatatgggcctaagtttgggttttctgcgccaaaatatgagacataccaattgattggaataagttcatttgacgtccttaactttacaccgaatccgatttttgtccttaacccaaaaagatacaaccgatccctgaactgtcaaaaccggtgcaaacaagttccctcggcgggttagaaggtaattttgattgacgtggcgccacgtggtaggttggtcgtcatcccacgtggcgtttacgtgacaatttgatcccggaaaaataataaaaatcatagccccacatgtcagttaaaaaataattaaaaatgatgaggcacacatggaccccacatgtcaacctcacctcccttcttccctctcccttctctctctgcttcttcatcctcacttctctcttctaccctcccgcctctcttcatcttctcttcccgcaggtgagcgaggtgggcagtaggaggcgaccttgcgcgccaccaccgcactccaccttcgagccgctgccttcctctccccgccctcaccgccaccggtacctcaccttccaggctcctccctcgctggcccacctcctgcatcctcgtccccctgcgccgcctctgctcctcctccgtcccaccccaacggcggtggggacgacatgatgcgcggcgcggcgacaatccaccgtgaggtccagcagcggcggctcgttcgggttccacacggcggtggacgcggcgcagcatgccatcgccaccgggcacgtggagaccgagggcgcagtgaacggcgtcggcctcaccaagctcatgggccggagagccggccgcattgcgctccacgccacgctcatcagccgcgacgtcgactgttggtggcggatgcagcgcctggccaccatgggcaattgcccgggctccatgcgtacaacaccacaatgctccaatgcatatgcagcatattactcgttaatcatatagttaatcactttgtctcgtaggttataatggagattaattagatgaataaatagaaaacgaggaagcaacgaccaaaccatcaaactgtagctataaagaccaaacaatacaacttactcgcacctatgttcaagataatctaacgaaagtcaaaagacctctagctcataattcgattggacatgtaggttatattcgtactggtttctcatgtggaaccatagaaggaattcaatataaggaaatgagacgactctttcttgaacaatttcataagcagatcttcccctccacaccaatcacgagtttttttttattcctctcgtatatcgtcgtcacgcccttaatgataggttttgaaaaa

SEQ ID NO: 1243 - DNA, 1501 bp, Oryza sativa
taaatgtctttggagaggatccaggtaaccactttcagccatgtacttaatgttctttgggcagttctccaggttcttgagaacctccccagccttctctgcagcaaccggatcatctgaatcattgaatttcattgtggtaagcatcaatatgcttccagaagttgatccgatgttttccaacaatagctccgatttcgaaagctctagcaagaaagagatggctgcatgtctttcatcaggactattactagaaagcagctttattgttcttgtaatggctctggtatttgctatgacttcctgtacgtcatgaaggcatgaagaagaatttcagttttgaacaaacacgcagggtaattgtttcagcatttaaataagtttcacacaaccaggccagcgaaaacattgaacatgataagggtcaaaacgtttcaggcttccttacctttcctgtttcatcctcagccaataagcaaaggagatccagcgaatcacagcgtatcagaccatccttgtgctccaacaaacgagggaggaacttagttatcccgattttgtgcatctgttccctgttctttctccttatcttggccagcagcttcagctcttgtatggcctcaagcaacattgcctctgtggaagccatggagagcgcggttcgtgcaatcctgacccttgtggcttcatttctcataatccattctgcaattgtgctcttcagtggaacattgctcctcagtgccttgctttgcatcgacatctttgtcacagggcataccacaggttcagaaccatcagcaaatttctcaaagtactcctcaatggctttcctatcatatgtcacaccactttctgttgtcactggatcaaccatgaccttgtttgtcaatggacagaagaacgaatcatataatggctcgacatattctgcaacttcagggagcgaattgaatgaatgtgcaccgatatcatgtgattcatggtacattccctgcaggaagtccaccagccttggcatgtcactattgtgcaatgttcttctccggggcctgctgtttgccgggattatcgacatatcggcctcagagtaaccatcgcaggaattctggtcacaataacgcggccgatgtcctgcaatctgaaggtttgcatctgctctgccatctggaaacctgctgctaccaaatgttgaagcaggtatcctgctgagctcatgcccaatgttctttatgacactgtcaaggtcctcggtcatgcccaggaggtcatcgttcttgagctcccgcgcaacggcgctgcacctcatgacgaggtccttggcgaggtcgacattggcagccagatactccatgacgtgcatcacattaaccgtcgaattctgcactctctgcagctccatcgtgaccaggggtgcatggtagaggtggctgcctacatccatgaagttctcatgctcggcatcggctgccgcctctggcggcatgagctcagagatcgc

SEQ ID NO: 1244 - DNA, 1501 bp, Oryza sativa
gccgctacttatttctttctcactcactacttttttctattttcttttgtctatcgaaacagcctaggattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctcttgagctttctttcctcccttatggcggcgcattggggcactagaaatcaaagaaatctgctatgttatgtgttatgagtttgggacccagctgctgatgttagagctcttttcgaaagagcagcttatccaagtagttagtttccagaacagagcgagaaagaagagaaagagaggtacgcactgtgaaagaagcccacgttcccactcttctttcccccgttgatcgggttgttaaaagggttagtcctgttgttaggaagagttagcggtgtttacaccggtgtcatgtgtacggggatacgtgtattaagaaaaaaggcccagaaggcatgttttcgaagcttcccccgaagaatcgtcaccaaagacattcttccatgggttttttacatgggggggggggctcggttttgcacgcaccctcctttcgttattccaccttgagcctagtgtagttggggagaggagacccctggggtcaaggttgaatcaatagatcacagtcttggatcaaagggataagccagatgtcagtgggaaggcggattttgcatttggaggctttcttgcataccttttcgaattctttttgtatagcttagttacttcttcagcgtagcaggcatgcccacgggaggcaccctccaaatcactaaaagcagcactataccaccacaagtagaggcttcgcagtgacaaccttgatcgaatgtgtaggataggtgggaggtggtgacacacaacgaccaatcctgaaagaccactctttcgtctaaggatgcctaaccgccgcaccctggatccattctgacctaattggatgaatgaagaagagggcgagc

SEQ ID NO: 1245 - DNA, 1501 bp, Oryza sativa
tcaattcccctttgagtcaacatacccatcctttagagtttatcaacataccaccaatttcgttcctataaagattcccatccacatatacttccgaatccagttctatactcccacaaatatttcccctttgaaatctcgttcatctaaattatccattcaagatttcaaagtctactatttagcttaggccaatatttccccgattgacccgattctctgttatatcctaataaccatttttatctttggggctaaaccagtataactccctttccgttggaatttattttggatcaacccctatctaaacctatccccaaaaacatttgtctccttttaatcggtccaaaatatcccgtggttaagttcctattttgatccatgcaccaattcgattcctataacttgatcacattcttggcacaaagaataatattatcacaaatatttgaatgattgctcttgtgctaagaaacttatttccaatcccttctactcaaaatccaacttcctttagccacaaataattcaccgagaatccataccacatattttggaggctaaaatcctagttatttacctccatctatttttgccaccatcccaaatttatccaaagttagaaattaaattatttcctttccttcccatttgattaatttaatttttaaagaaaatctttgtgataagttttatatttggttcttattgaattcttttaaaattggagcatcttaatgtttatccttttcaaatttatatctcaaaaataaatatcttgattttattttataagtattttaaactccttttgcttcaaaaaccttatattcaaattccttttataaagtttaagagacccttaaacattcctcttttaaattttatctcctttaaaatttattaatttatttaaaaccctgccttcaaaattcctctagtttaaaattcctttaactctatttaaattccttgtccaaagttcaaaaggttcacaaatatcttcctttagaattttttcccctttgaattctagtcaaattcaaaaagtccacaaacattcttcttatagatttcatctcctttaaattccatttaaaatcctctacacaaaaattcccaaaggttcctattcaaatcgggccgaaattcctttttcttctcccctcggcccatctccctcctcagcccaagccgacccagccccagctaagccggctcctttctcttctctgtgggcgcgcgtggcacaccgccgccaccgtcgccgtggctttgtgctgccgtcgcccgcagctttgcgccgctgccgttgtcttgccgtcgacgcgaaggatctatcaccaacgtcagctgcgacgtcacgccgccgagccgaaccgccatcaccggccaatcaacggacagagccggcgccgtactcctcttccccacgtcgccgttgccgtgcatccttcgctattctccattggaaccgacctactccaccgcctctcct

SEQ ID NO: 1246 - DNA, 1501 bp, Oryza sativa
aagccaaggaataaaattggagcgaggcgagaggacaaaggaatgggtttaaaataagttttaatttgaaaataaaagagaggtgttctacaggttggagattgaataaaatcaaataaagaataattttggataggtggggtctatttggtggattggtttttagtcggtgctagaatagggcagcacgacggctagatatgtggagttggttagccgatgctaaggatgggtagcatagcagctaaatgtttggctcgtctagtcgatgctacagttaagcagcacaacggctagagtcgggaaaatttgtgggggtttgcaagatggaaagtgttactccattgccgtgagtggcagcagagcggctaggatcgcatagagctcggaagctagtgtgctgtggaggtcgagggagaagtgaagctccgaccactatacgcgtcgaggcgtggggtgcgaagagcaacacttcgaccttaggattagattataccgggttttatgaccaacggtttgacgtcggggtttgagaccacacgaacgtctccatggaaggcgtaaagtttccacagcagttttttggtggctaaaggatggtatatgagtggtttaaaaagaagtattttaaataaatcaaaggaatttaaattcaaaaaggggttttaaataaattgaaaaaataaaatttaaaatggtattttaaaagaaataaagaaaaggtaattaaataaataaaagatatttaaagaaattaaaagataatttaatttaaaagtttttttaaataaagcaataaatttaaaattaaagggatttaagataaataaaataggtttaaattaaaaaatatttaaataaataaatttaaataaaattttaaaataggaaatttggtatcaaaagagagggtttgaaattagatgaatttagatcaaaagttttctggaattggatcatcggttggtgagatatggatgtctaaagtttgaaattgaataaaaagaaaaaggattactttataaaaggtgggggccactgtcatagcctcttctccttcttctacctcttcttcttctgttcctgtttttgccgaacaggtagagaggagagggaggaggggcgctagagctccggtggctggggatcggcgacgttggcggcaacgtgtgttcccggacgacgcgcatctggcaaggatggtggccggcagaggtagatgaggagttagccggaacggcgagcacaattgcatgaaccggagagagagagagaaagctccggtgaggctcgattcgaaaggaaaaagaagggggaaaggggtaaaatgggttcaccagagggaggcaaagccgatggtgcaaggaaactaggagggaagctataggggaggagatcgaccgatggcggcgtcggccggacttggcaggagagagagagctcgaggagctcggctatggggaaggaaacggggtctcactggctatatataggcgaggag

SEQ ID NO: 1247 - DNA, 1501 bp, Oryza sativa
tggcacggcggcggcgacgcagccctcgtcagcgccgccggtgcccccaaggtcgaagtatttctgctgcgccagccgatccatcagctcgatccactccggccagggatgcacgagctccacttccctccttagcacctccgccacgctcatcctctccagctcctcctttccggcaacgtccaccgcctcaggttccttcttcaccggctcgccaggttcgggtgccggtcgcggctccgcctccgccggcagcacgtccggaagcgcggcggggcggcgccaggactggatgcggcggagggccgcgtcgcgggcggagtggtcggagaagcgggagcggtcgagggcatcgagttggtcgaacacgaacgagaggcgggcggagagggaagggggcttcgccggtgagagggacgaagggcaatgggaaaaggaggaggaaaggaggcgggggaggagcggggggagggtggggatggtgcagcggcggcggcggcggcggagaagcgatagaacgtaggaagaagccatgatgtgatttcgtggtctccgtggtccgtggtataggtggccaaacaggctgcgcacggcccgccccactcaccactaaaccccgtgaggtggtggaataagtccacttaacctcccttaaccagtggccaaatctaattcttatccctgaactacaaaatattagatatctctaatcctagctattaaaactagtgcaatttgactttctctctctctcaactgttttgaagggtaatttctttaacatggcactttaactaggtccaacctgttgagtcaccctgtgagacccacccgtcagtgttagaataggtgtcgaatatactagtcctaattggttacagttggacttggagttataataggtggtgggggtgaagttagagtcggactctataacccggcaactctcttaaatagagaggaggcaccacaatataaccatggtgactacaatatagcgtaggcacgcagggagatgatggtgcgcggctatagactcgtagcagctatgagctatattgattggggaggcgcgcccataaccagagccccgaggatgtaagcttcggctgaacctcgttaacaaatatcgtgggttcctgtgttgccatctggcatgtcttagctgatcaatgactgaagcgatcgagaaagttagtcgtcgttccgctatattgactaacttttataacaagtggtatcatagcagaagttttcaacattggaccaagaagacatgtggaggaggaaacacaaggtgaggatcgcacatcgacagaagatcgtcagccatggcgatgagatcgatgacgacaacgaggacgtcgcggagacgatgacctcactcacgattagacaggtccaggtgtggctgaaggcgaccagagagattggaggggtagcgctatggacgacgcgcccaacgcacgcggcgatcgcggatccgcgactgatgtgacca

SEQ ID NO: 1248 - DNA, 1501 bp, Oryza sativa
ctatactttgtgtgccgggcctggccttccggcccgaccgtgccgggccagcccagcatgccggtggggaggcccaggcacggcccggcggtcaggccgggccggcatggacccgacccaagtcgagccatgccgtgcttgggccgagccaaaatgccgtgccgtgggccggtccttcgggcctcgggtcttatgtccatctatacttgtcagggaatattctattctttttatttttatttttcatccttcctctcgtcttctttcttctctgtttcgttcttcacaggtagagcagagggaggagaggagcggggcgccggtgctccggtggctgggtggttgcgacgccggcggccaaacgtgttcctgagggtggcgcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggcgacggctgcgtggaggagaaggggacggcgcggcctcggcttccaattggtcggccatggcggcgcgtgtacgtggagactgccctagggttgggcggcggaggaagaggagcacaacacggtgatgccggaggtgcaactcagtgggcggcagtggatgtcacaccccgaagttctcctcccaagccaaatttaatttgtaaacaaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctcttttttccgaatgggccgccggcccattctctcctttcttccccctcctccttgttgggccagccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgccgcgtcgcctccgcctcctccgggccacgtcgaccacgcccgcgcgtgcgccgcgttccccgcgcccactcccctctctctcccgctcgcgcccgcgcccgaga

SEQ ID NO: 1249 - DNA, 1501 bp, Oryza sativa
tcccaatcggtttaaagttccagatttctccaagtttttgggacaagagggcgtgtcaacttatgagcacatcagccgattccttgctcagtggggtgaagcatcggctgtagacgccttgagagtttggttgtttcggttatctctgtccggatcagcttttacttggttttcttctttgccgtatgggtcgatcaatagttgggccgatttggagaagcaattccacagctatttctacagcggggtccatgagatgaagttgtccgacttgacagcgatcaagcagcggcatgatgaacccatgcacgagtatattcaaaggttcagaaagatgaggaacaagtgctttagcttgagtttgaccgatgctcagttagccgatttggctttccagggtatgtccctccaatcagggagaaattctcatccgaagacttcgatagcttatcgcacctgatacagaaggtgaccttgcatgagcataggtcagcggaagtcaggaaaagctctaagaaagttaatcacgtttgtccatatatgtatgggtcggatgacgaagaagatgattctgagatagctgcagccgaatgggtgaggagcaaaaaggttataccatgccaatgggtaaaaagtcctgggaaagaggagaagtatgattttgatatcaccaaagctgacaagattttcgatttgctactccgagaaaagcagattcagcttcctgctggtcatacgatcccatcggctgaggaattaggcaagaagagatattgcaaatggcataattccaggtctcattctaccaatgattgtaaggtctttagacagcaaatccaggttgccattgaggggggaaagattaagtttgatgattccaagaagccgatgaaggtcgatgggaatccttttcccgttaatatggtgcatacagctggtcaagcaaccgatagggaccatgcaaagggttttcaagtaaattcggctaagattatcaacaagtatcagaggaagtatgataagcagcaggagaggcgttatgaggagtacgatgatggttttgatcctcattggggttgcgagttcttcagattctgctggaatgaagggatgaggttgccatctattgaaaactgtcctgggtgcagtgatatcatcgagagctcaagccgaccacgtaatagggatgatcggctgagacagacaagactccctgttcatcaaaggttgggtccgatgaatcaagatcgtggccaagaggatgaggtgatcaggaagaatcaatggtgtccttctggtattttcacgaagaatcagaaaaggagggtccagagattgaggagcagggaacgttttcaggaggttgaagaggaaatcaaccattggctgaggaaaccaaagccaagacaggagtggcgtgtcaagaatcaggttcccgtagccgatgatgctgcagccaatgaagtgaagaagttggcaaaaggaaagagtgttatagcgg

SEQ ID NO: 1250 - DNA, 1501 bp, Oryza sativa
tttcttttctgatttttttttggtgcggctttttttttcttttttttttgcacctttctgcccttttttttctcacttttttttttattttttttaacaaaaactgacttaaggaccttaatgtaagattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcggaaccgtggaattgagggagggggtcagactcggccaaaggggcgagtgggactcggcaaggaggtggagtggatggcagccgaatttggtgtatgggataaaacggaaactgatttttaaccaatccaatctactatatctttccaaaacaaacttgactacttccaaaatcagatatggtaattcaccttcctcctcttgtgcacgacacaggcacggccaaaacaaacacacacaaggatcggcaaactctagatgcaactcaataactccaaaactaaccgacagaaacttctgaaaactacaaaaatagaaccgtggcagcgagccgattccgttttcgtaggtcccgacaacaacagagacacggtggcagcgacgactgtggtacaaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcat

SEQ ID NO: 1251 - DNA, 1501 bp, Oryza sativa
ttttcttttctgatttttttttggtgcggcttttttttcttttttttttgcacctttctgcccttttttttctcacttttttttttattttttttaacaaaaactgacttaaggaccttaatgtaagattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcggaaccgtggaattgagggagggggtcagactcggccaaaggggcgagtgggactcggcaaggaggtggagtggatggcagccgaatttggtgtatgggataaaacggaaactgatttttaaccaatccaatctactatatctttccaaaacaaacttgactacttccaaaatcagatatggtaattcaccttcctcctcttgtgcacgacacaggcacggccaaaacaaacacacacaaggatcggcaaactctagatgcaactcaataactccaaaactaaccgacagaaacttctgaaaactacaaaaatagaaccgtggcagcgagccgattccgttttcgtaggtcccgacaacaacagagacacggtggcagcgacgactgtggtacaaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcat

SEQ ID NO: 1252 - DNA, 1501 bp, Oryza sativa
ggctcgaggcagcgtcggcgtggcagctgcggcaggcggctgacggcacggcgcagcatcggcggcacggggctcggggcggcgtgcgcgcggggcaggggacgcgagggggcacggcagagaagggggtagggctagggacctcgtcgagcacctagagtgcaatgagcagtgtattttcctatttatcccaattttagcctattttccatataaattctattctataaatcctaatttttgcataaatgaggtttactcaatatttatgttattccaaccaatggattcacccaagattaatattacccatattttatttatatatctcacaaataatttctttttatattattggccctaaagtgaacttatatatttttgaagattttgggggtaatattctatttaatataacgttgtgtccttaataatacaatggtagattggtcgagtttatttgtatagcaatacattttacacaaataggtttaatccatttattctataaatagtaaattgagactcggtacattattaatctaattgtttaattaaaactcacataatcttatttatatataaagcttattttatttatatgaccattattttatatgagtgattttcatgttatgaggagctcggcgaaatgttgtaagtatcaatctatatattccggtgaattacttatttataaacacgatcattatagtgggtggtgatcatcatttcatgtgttcttatatttcatgtgagattggattcaaatgaattggatttaatcttactatttctttagctaattgtgacatcaagctatcaatcatggttcgaatatttaatatttgatctgtgatttataatagaaattaatatttgacttatacttggtttggcttgctttcttgtgcactaatatttgtagggttattaataaataacatattctcgtaaattatatctattgcttaaatttagatcttttctttactttctttgtgatattttacggtttggcaagcaatagcaatcataacaaccagcatgatgcaaaagttttaaaaaaattcaaaattttagtgatttttattgttaggaattttcaggacgttacaataggaggcatgccttatccgtaaccttgacagtaacccccggcttcaacttaaatgaattcatgttgtcgtccgcgacttcacctgatagcgtcttgtcgtacccatttgatcgatcccgatgtaaaaccgtagagacatgaggttgtcgacaacgctgaaggaagttcaacggttaagatatgaatttaaatcgaagtcaaacagccacccgcaacgggtctccaaaattttcggcggcaatctctctccttcctcaaaatacgaaccgtcagatagtgtgcctatttaaaggaattctgggattcattttaagtccgtttgcccagaaccctcactgttccttggcttccttgcacctttcacatcccagaatccccaac

SEQ ID NO: 1253 - DNA, 1501 bp, Oryza sativa
tatcttcatctcttcgagcctggaaatactttatgcatgatgtggctgataagaagttatgataggattttgctccattcatcagtctcagtttgctgctgcaaaatttagctcaggaaaatgtgtttgtgcaacatttttctttaccttgttgcacctctagactaaatgatgcgttgccacttatttctatctgttctgaaagctatgtagcaactcgccagcatttcttctttggtcactttaatggtgtgttgaccattttttcctcttttttaatccctgaaaacaacattagatcttccttcttagatttaactaacaataattcgttgatctccttttctttttttttcttttttttcccttctttctttctttatcagccacatcatgtttcatcaggatagctgaatctatcataaatcggaataaatggctaatgccgacataatcattcgtctcctggaagaaaaataaattcaatgtagtttttatcaaaatttaacggcgcaagtagttggttttctcataatgaggctacatttccataagccagcctaaagttgggattagtggtaattccaggagggttgccagtgttatatgggttaaagagcaagtaaaatacgcgttgaattgctagccataagaatgtttatgtaagtttgaattatgaggtgaagagagaactcacagaagtgaggatgagctgctacctctcacaagagacctactagtagattgggagcaaatgaataaaataatattagtgtgatagaggtaatatactatgtatgctgtctcctaattactaatgagagattatgtggataaaattagatatatcaatcacctctacttttattaaccttgctcaccacacaaaaagaatagtacagtacgtagtgattcattattacaacatcttgattgcccaaaaaagtttactgcaacatcttagtactctataattgatgcattgattaaccaataatagatctaccttttgctaccttttctccaacagaactacagaagtgagatatgaactgttgtacgttatgctggtacaaaaacataaggggcaattgcatatttgagaagatacatggatggactaattgggtgttgtgattgatggcatctgtctatgtagttgcttgatgcccttgtgacttgtgactagaatcaattttccaataaaagttgtatttttgttctaaactgtgattaaaaagaacaatatatatggaaggattatgtggtgacatgccaaattcaccaccatcgcaccgtacttctttttctagaggagtttggatattgtccacagttatcgaattatgttgaacaaaaggtactttaatttcatataacaatttgggagtaataataggatgtaacttacaaatcaaactaaagtttgaggggtgaaataatatgtacatgaacgccttataagaccaaaaataaatagataaatagatcagattatctc

SEQ ID NO: 1254 - DNA, 1450 bp, Oryza sativa
cctgcacttattttgggacggaggtagtatattaccaccgtaacaattttatttaagcagcatatctaccaaccaataaagagcttataaaacaaagcactatttcattttcttttcacttttacatattgcatgctaaaacggatccgattcaggtgcagtagccagtgggactgcaaaataagcagtcaaactagcatcgcatgatttaaaatggacgtcccagatatatccgagcactgtagcaaaacactgtagtgatggaaaggtactgttctgattttactgtgccaaatccgttttggccgttagattttgacatagagggctcagattgtgtgcagtagttaccgtgcagtcctagtagctactgcatttgatctcaatcctgctaaaactagaaccttctctaatcacccgtcacatatgaatctgagcacatcagaatattagtttcttccgctttctaagaaaaccgaaggttcttaacaatgactacaggtgagtgataaatcatactaaagtatgacttcgaatatctttttttttcagaggttgtcgaacgtttcccttaggtcatcgatcagttattcgcctgtcttgatcttgacgatgatgtcgtccacatatgcttcgacgtttcgtccaagctgatcgccaagtgctccttggatcccgcgctggtatgtgttgcctgcacttattaatccaaacggcatcttcatataacagaacacactaaagggtgtgatgaacgctgttttctcctcgtcctcctttgccatgctgatctggtggtagccggagtaagcattaggaaaacttaagagctcacaactggcttttgaatctaccgattggtctattcaaggaaagaatgaagtagtccttgggacacgtcttgttgaggtcggtgaagttgacacacaacttccactttctgttggctttgcgtaccattactggagtggtgagccactctggattgatgacttctctgatgaaaccagctttgagaagtttgtcgagttcttctcgtatggcctgtttccgatcgggtgcgaatctccgcaatttgtacttaactgtcttggaggagttaaattacactgatttttcaatagttcgaggagtcgtcctatccccttttttagttgaggggtacgaattagattcggctattagattcggtcaaagtggactttttccatctggttattagttcccatcaagtgcatgtgtgggacccacctgacattgacacgtcatcaagagatcgatgtgaaaaaactcccacgtggggtattcatcaatcgtggcgtgtgggagcccagtcgaaccggccacctctccccccctccaatttttccggcggccgccaccgccgccgacgatccctctctccgcccactgccaactacatcgctgattccggagcagcggaggcggc

SEQ ID NO: 1255 - DNA, 1501 bp, Oryza sativa
atattacgaaatggatttattttaaatagttctctatagaaaatttttttaccaaacatactacttccttgttccaggttataagacgtttttactttggtcaatgtcaaactatttcaaatttaactaagtttataggtaaatatagtaatatttataataccaaattagtttcattaaattgataattgaatatattttcataataaatttgtcatgggctaaaaatgttattattttttttacaaacttagtcaagcttaaaatagtttgattttgatcaaagtcaaaatatcttacaatctactacctccgtcccacgttacttatcgctttgactttttgtttgtaacgtttgaccattcattttatttaaaaaattagagcaaatataaaaaaatgataagtcatacttaaagtacttttgataataaaacaaatcacaaacaaaataaatgataattctaaaaaaattttaaataagacgaataatcaaattttataaataaaaaactgaaagcgaccactaatataggatggagggagtgtttaacaaccaggaaacatgtttataaaaataaaaagagaaaatagcggccccgctgcgtcgatgtgcaccgtgcagtgcaggggcagctcatgctagttggcaaatggcaccaaggcaggctgtcagcaggttcttgtcaccagtttgctaattaatggccaacgcccaacggtagcgttcttgtcaattcaaatcaaatcaattactactaatcttttctgcgagttgggcatcgggtatccgtcggattcacatccccatcaccggactgagaaatttctgtcgttcccatcctcatccccgcacacggggaggggttttcccgtctccggccgtcctcatacgggtacgaggcattcgccaggtgcccatacccgaaattaaacctcaaagggagaaggaggcagcagtaaggtgaaggattaaatcacaataactaagccaattagagggaggatgaatgggtggtatacccaaaaactgaaaacttttggcggaaataaaagttaccctcgaaatcgatggagatcggtctgaccgagattgatctgccggtctgaccgctcgaatgccgctggcctgaccggtatagatcaacaggtccgaccgccgaagtcgcctgctgcgcctgtcgctgccgctggtctgaccgccgcttgccgccggtctgaccgccggttagaccatcgaaacccggtgaaacacaaatcgaagaactcttaaagtggatgacgactttattacttctctctgtgtttacaaagtgcaccaacagcattccttacaaaaatttcgactaaactcgaaaccctaattgaaaaactcaactcaattgctctcaaaagcgatacagggaagcctcacgctctccctctatttatacccgagatagacagcctaaagccacgaaccaaacttatactaaaaattttaaacaccttaggaaaccct

SEQ ID NO: 1256 - DNA, 1501 bp, Oryza sativa
ccatcccacggtcacgaagtgctttatatgtgacttggtaaggaggctacatgacgtgaagtgaaatatcgtgtgttaattatgcttagactcctgccttttgaagcatgtgttaaaagatgcaaggatatgagtgtggtgcttgtgattacattgtgcgttttctatatataacaaagaaaaagaatccgtggtatagtgacttgctatatgaagctactccctctgtttcacaatgtaagtcattctaacattttccacatttatattgatgttaataaatcagtcattctaacacatttcctacattcatattaatgttaatgaatctagacatatatatgaatatgagaaatgttagaatgacttacattgtgaaacagaggaagtagatgatatccaaatccaccgacggaattggaaaaacacataaaacgtaaaaattaaatgtcatgcccatgcattaatattgaatttctacgttgaagaatattaaaaactatcgtaggattgacccatagtataaacaaagggaatttggagtaattggaaagagaaaacatgaggtataaccttgtgcttatttttctttaaaaactttatacggttgtttattttataagattttcgtggaaaagtatatgattcgatcatttgtttcgatgcgtttctaacctgttcactagaatcaaaacacaagaatataaatatcggaaaaataaaacatataaaactataagtgtaagtgattatatttatttaacactactaaataaaacgatttttatgtacgagaacccatataggttttagggggaccatagctggtagcgtctgtaaaaatagacttccattttcgtatacgactcttttaaaggcctgcatgcaaaaaaatctattttcacaaacgaatctcttatggagctgtatgcgaaaataagcctattttcctatgcggcaaatgtattttcgcgggcgaggctcttcaaggtccatctaaaagtctaacttacatcctctttccctcttagcactaaattttcttttcaagttatcattattcattcatcccctctcttcatcatattactcctctctatctcatttctcaccttctctcctctctctctctctctctcactcgacttccctcctgagagccgtgctgacagctgactagctagccagtggcggtgggtgggcttgagcggtggcaggcagcagcgacctcgtgcaacgggcagcgacagtagcgggaggagcacgaccggcggcggtcgcgcggccgcccccaccatcgacgcgcaggggaacattcctcccccacttggcagagaaggcgagggcgatggcggcgaggccacccgtgcgtggatctggtggcggcggcggaccgcacctagctacggttttgattttttttaggatttttatttttgagtgaggatgatataagcatccgcaagcgaaaattagattttcgtgtacgggtgcgccatcc

SEQ ID NO: 1257 - DNA, 1501 bp, Oryza sativa
gctgcaggtgctgaagtgtcgacctatggagatgtctttagctttggagttgttctactagaaatatttttacgaaagaaaccaaccgacgatatgttcaaggatggcctcgacattgtcaagtttgtcgaggtgaactttccagataggttaccgcagattgttgacccagaattactacaagaaacacatgtgggcacaaaagaaagagtcttgtgttgtttaaattcagtactaaacattggactcttctgcacaaagacatccccatatgagcgcatggacatgcgagaagtggctgcaaggcttagtaaaatcaaagaggtgtttctcagtggcaactaaggtatatggccttgttatctatatctccatgattgtttctcatattatatgtgcattgttctttccttagtaaaataacaattaagaaggaaaactgatgctgagcttacattgcagatatcccaaaatcttaagtctgtggactggaccctgtagactctgtacttgtcaatacatctttggcaactgggatgagtgcctgaagctacatcttttatgtctcgctatatatacaactagctctgtactccacgaagttgattacatgcattttatttccctttgtgatgatgaccacaaattattgtacttgattatatttactaaactacttcttccgtctcacaatgtaagactttcttctagcattgcccatattcgtttagatgttaatgaatctagacatatgcatgtgtttgatttattaacatctatatgtatgtgggcaatactagaaaatcttacattgtgaaacagagagagtatcattgtgaaatggagggagtataatttaacggatgtcatgacacatgatttatgtaatttccaccaccgaaataagttgagtaactcatttaagcatcttgtaagagaagtgactaaattacacccacctcgcaagttatagtcttgatgtgttttactgttttttttataaaacaaatcatagtggtagaaaacagagacttatttgctaatatcctaagcggccatgtttgtggggacctaataaaaaataggactacctattaatctttcgatagacttgagcttcaaatcttacagaattttcaaccaatggatatagcttattttgaaagaattaacaaaaagaaagggataaacatttcaaaaatcataaatttagagaaaaaaacatttgtaaaatctaattttggtgcattgtaatagagcgtaagtgcactataactaagttctgtaacttaatataactacaagttgcccagcgaaaaaaatataactacaagttagatctacataaacacaaatcttgatgcaagatcttacggacaagaagaaaaatcgaaagacaggagcccaaaaatctgtagcaaagtgaaatagcaaaaccgataaaaaaaaaagcattcttatatgggcatcagatagactgttcagctctgcggcgagccat

SEQ ID NO: 1258 - DNA, 1501 bp, Oryza sativa
tgatgaaaacggttcagcttccatccatattgcatttgctcaaaggttaagcattgtagtggatgttgcagatgcaatggagtacgtccaccataacaaccaaggaactattgttcattgtgatctcaagcctagcaacattcttttagatgacagcctaacagcacatgttggagactttggccttgcaaggtttaaagttgattgcactatatcatcttccggtgactcaattatttcaagtgcaattaatggaactattggatatgttgctccaggtaaatcctatttttcatggtacactatgtttcgttgggagtgttctcttcctattttaatgtttggacttaactattctcatgtgctatatgctctatgcagagtatgcaacaggtggtgaagtttcaaccttcggagatgtttatagctttggaatagttctcttcgaaatatttttacgaaagagaccaacacacgatatgttcaaggatggtctgaacattgcaacatttgtcgatatgaactttcctgacaggatatcagaagttgttgaccaagaattgttagaataccagaatggtctatcccatgacactcttgtggacatgaaggaaaaagaaatggagtgtctacgttctgtgttaaacattggactttgctgcacaaagccatccccctatgagcgcatggacatgcgagaagtggctgcaaggctgcgtaaaattaaggaggcctacctcagcagcaactaaggtaattaacctaattcaatgatatgcactcgctgtacatatttccaaggtagtttatcataatgtgtgtttgtattatccttttcttagctagtaaaatgcatgtgtaaataaacatagggctgatgctaagcttacattgcagataccctgaaatcatcagcagcatgtggaccctcagaccctgtatactctgtattctacacaatattggcaactgcgatgattggacggaacctacctcatgtgtcttgcattttccattgggtgttaatatggcactataagcttttttttatggcaatgtaacatacattttaccagtatacatttacgttgcagtatttctctttgtgtattgaggagagatataaaagaaatcacctttctgcttctgctttcttgttacgaaccagagatgagatctgaacaatagaggtagagcagaggaaacaggggagacagaacagagttggtagctttaggaggaaggattgtttggttatttcatattcgatgctttctctcctattacacgagtgcttatatggatgcactggttacagctgtcgagccaacccattcaggcccagagatccgaacattcgcctgtctcacacgcttaggacgcgcctgatgacgaaccgggtttgaagacgtagtcgttgtcggatcacaaacagtagccgtaacatttctggatgggtgtatcgtgaaagtctggatggatatcaatgatagtggtacat

SEQ ID NO: 1259 - DNA, 1501 bp, Oryza sativa
gctgctaactaacggctcgtttggcagaggtttaaattctaaatttaactttagaagaagttagatttgaagtgaagttgtatagcaacctaaattcaaactccacctttttagtttattttatgatagcgctccacccaatttcgctcctattttagataaaactaaaactatttagctagatttgagctccagaagagatggagtaggagttagagtcgtgccaaacataccataactttaggtcttgatgccatcgactccaatatatttgctgtaaaattggtgatttaagttagtaattggctgatttgctgttggctagtaattgttgctgctaaagtattatttgtagtgtttggtgctatacggctatgtattgctgttgatggttaaatggttaatcttggttggcttgttgctgcatgtttaatgtgtgttactacttgctccctccgtcctataatatactggctctgtttgaccacttgtcttattcaaaaattttgtgcaaatataaaaaacgaaaagttatgtttaaagtactttggataataaagtaaataaaaaaataataattctaatttttttaataagacgagtggtcaatcggtgtaaacaaaaatttaaaatcccttgtattataggacggagggagtactagtgtattccttatgtaaaatcaaatgtgtttttgattattattctgtgataaacaattggcatcggagattattggttttgttatttggaatttattttcgaagtggttttggagatgattggatttcacaggtgaatctacatgtactgctgtcatttatgtgtccggtcagaccgggcagtggttgccggtcagaccggcgtgtatagggcggtcagaccagcgcagcccacggtctgactgaccgacgctgtgtcggtttcggtttcgggtcatttgtttggatatccgtgattgtttcatgattatggcttctagatggatactatacgtatgttgatactgttgtttgctactaatgagtcaagttggagatagtttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatggagatttcatatggcatacgatggaggtattgtgtgtgtatgggatgcggagccgaatttggaaggagtccaaatttgttatgattggttatgtaaagtttgtttcttgtactagagggtttcctaaggtgtttaaaatttttagtataagtttggttcgtggctttaggctgtctatctcgggtataaatagagggagagcgtgaggcttccctgtatcgcttttgagagcaattgagttgagtttttcaattagggtttcgagtttagtcgaaatttttgtaaggaat

SEQ ID NO: 1260 - DNA, 1501 bp, Oryza sativa
ggtaaaacaaaaactacgctaaggaatcacctcacatccacccatgcccgtgggcacggctgttcgaacagtttaataacctctgcagagggggtacactttacccacacgacgttactagccttggtcacctagcccatgcagaacagccacgtctggtgactttggggctttcacgacaaggcatttcgaaagccgacacagggttaccatatgccaacgagaggggacccagaccaacaacaagttaggtcctagaccatactgcgccaggaagcccgggggttctccccgacaccaccccattgaatccacatgtctcttggcatcaaggctcccttgattagctatttactcagccagaggtgtcccattccacccgtgtggtcgcactattgtatgctcggatgtaattccaaaggaatcggtccttagatgcgaccgcacaagtattccgcctaggaatggccttgtgtcgcgagttttatttttaaaactcattttctttcataaggcaccgacccaggcgtcgggttttccaaagcttttgtaaaccaagttttacccaagaagttacttagattttaagtttgaaggcgaccgtcgatactcgcacagagtgcacaaatatcgaggcgcaactagatggttacaagggaacatgatataacaattaacaatggaaggatcagatgcaacaagttgggtaggcccaccggtctgccttgcagacggggcaaacagattaagtgcaatcctatcaatgcataatattttgcaagcaaattaattaagttcaaatataggctcaatatgttcaaaggtggcttgccttgcttagggtcttcacgaagcttcacaaatcttcgagaattccacttgaagaaaaatatccggtaaccgcaactaggcgcaaacaatcaaaaacctaaacaaagaccaaataaaatatcctatttaggctaattaatagtgccattagatagatcacaatttaatggaattattggaagtggaacggggtaaatcggagttacggatcaagagatatgaattttggaggtttaattggaatttatggacaaaggaaatgatttattggaatttatagaaataatattctcaagaatattattgacagtcactgacgtgcgggaccaagggaaattatttagggaattttggaatggagaattggtttatggaggcaaaggaaaaaggattcaataaatcccttggaaaagaaaaggaaagagggatgggatttatacttcctccttggaaaagaaaaggaaagagggatgggatttatacttcctcggggtggctagggcgcggcccgaggggtttacaaggcttagccggccaatgggctgagcgcggccacggggaggcggcccaacaaagggggcgcgggggggggggggggtgagagaggcggcccggtggacgcggtccaccgcgcggggcccacgtggcggtggttgggttcacggtgggg

SEQ ID NO: 1261 - DNA, 1501 bp, Oryza sativa
aggccatattaaaagaaatattgtaagggtctcaaaaaaacttttggtttatcacaatcggacttaaaatgactttctatacatttttaaagtttggactttataaggaactggatattagaacttgcaacaaacttttgtgcacctaaacgatcttaaaaataaaatgtttcgactatagagttgtagacatcatcgagctctataattttgatataaaacttgtctccatcccaagtcatttgtaaaaactaaaaaaaatcattttaaaaaatagatccaagagcttgtaacgaatatttggaccccctaaacaatctcaaatgcaacaatccagcaatttactctgtttctaagccacagtcgcaccgactctgcatcattaatttcaggcacccgaaataatccactccatatcagcaccctgcttccagtccgtttaagaaatgtggtgtaggatttggtatgaccactatccatccaaatccactccgttttacttccggttcatgatcatgtactagaattaaaggctatgcaactctgagcagcaaatatttactagttacaactaaatagttacacggtagaaattttcacttcgtttgaactaatatagttgttgtatgaataggtaacaaatcaagcaattcttgagagggaaaaggtggagctggataattcttccaccaggtactcactacaaattaaataccattccctccagaataaatatattacgccttggataacacatctggtcaaaattttgaaactttgtctcatcgaatttaaaaatacttgatttgaaaacatagaattggtatgtatagatttgtattgaaaaatactttcatgatatcataaactgattttataacttattctaattaaaaattgcgctcaagattacaactcaaagtccaaaaaagattcaatgctatattttttttatcgaatggagttaatatttacccatactacactttttgagcaccttatttattactctgcagatccaaaatataggtcattttaattttctcaagtcaatattttactctgtatgatccaagatgagttgagaaatatccaattaagctcgtcttttttcttttgattcctcattagtcttgcaaattaaattaatagtgaagtgaaatgaggaatcaaaagaattaaggtcatgactaatttaatttgatcctgatgagttgagaaaatatccaattaaggtcatattgaattcgggaagtagttattatgataaacagcattcttggctgctttttcacaaaaggatatatagattcacagttgttagtttagatgtcatgtctttacccgtgcatataatcaagaccttaaattgtacagaggtagctggtcatgaagattgctgcaactggacagtttctcttggtccttatggcatgcagtgtaatccaaatcgtgtgccaatcgttacatggaaatgagacagatcgactttcgctgcttg

SEQ ID NO: 1262 - DNA, 1501 bp, Oryza sativa
cgccgccgaggagctggcagggaaggggcgcggcggcacactgtctcctggtcactctccccgtcccgcttgagctgtgtcccaccctggcggcgccggcggctactatgccaggggaagatgggaacgaaagagagggagagaagggtattttggtcaccttcacgaaacaaaatatggaaaaatcgtttaattgtgaagaagttgaaaaaatggcattgtaccgtgttagtctagtttgaaagtggtattttaacgaagctaacttgtgggatggcattctagtgaaactctatcttgacaacggcaaaatgtcaattttctcgatgtccagcgtcgtctgtgctcgcgacggggtactccggattgacacgtgggatgcgctggtggtagcgtaggcgttggtggcatcaatcatggtgtccatggtccacgccatgttgtcgtcgtcgttcatccttagtgtccatgtcttgacgatgaaggcgccactggaatggtcgcagagggtggtgtcagggttcactttgatcggaggtcaccgaaatttctgaaattgtgaacaaaatttagttgaatttgaacaaatattaccaaaattcatgaaaaaatttaaaaatttaaaaatttcggccgaagtaatatcgtatcggaggggaccgaaatgaccgaaattttggtccaaaatttccaaccctgggtggtgtcgcaggtgttgccgatgtcgatgaacttcaacgtggcgccgcgtcggtgacacagacacttgggttcatcgtcaggcatcctcgtcggctgatgggaagtgttgaagtattgatctagtatctattccataagttaaaacattttgctatacctcatcaaccaaagattaaattttggttatttaattagtaaaattttttaactatagatgaaaagcatttgcgaagtaacaatctcacagcatatacaccttaaacgatgataattttaaaataaaaatatttatgatgagagaaatttggaagaggaaaaaggaaagaaaaaagagaagggactgcttatatttatggtgccacaattttttcttttaaaaaatagtcaaatgtaaattacatacacttgcattgtaattatattataatatttaaaaattataatgtggaagagagaggagagagaagagggaaggtgagaggatgacaatagggtccacgtggacccccaccattttttattgttttgtggtgtaattggcatgtgggccccatgattttattatttttccggattgaattaccacataagcgtcacgtcaatcccacgtggaacgaagacctaatcaaataagtcacgtcaaccaaaatcattgtgcaaaccgcataaggaccttatttcaactggttatgggagttgagtgacgcatcctatctatctagtattgtggttcagggacgaaatttagactcggcaacaaattaagatacctaaacttattaccaacaaaaataatccc

SEQ ID NO: 1263 - DNA, 1501 bp, Oryza sativa
atataggaaaaatttttataggattgaaatcatctaaaatttctatgaattttcctttgaatcaaagaggtcctaaatgttttgaaagctgcagttaaggtctgttcccccgaaaaaaaattaaataaatcaaggtctattcataaacatgcaaatttcaccttgagaaaactcatggagaagcgttagtggtgtgatgttgaattcatggttgtataacttcatccaataagatttaaataatactccctccgtctctaaatatataacgtcgttgacttttttaaacatatttgaccgttcgtcttattcaaaaactttttgtgaaatatgtaaaactatatgtatacataaaagtatatttaacaattaatcaaaatgataggaaaagaaatattaattaattaatttttcttaataagacgaactatcaaacatatttaaaaaagttaacggcgtcaaatatttagagatggagggagtattatccatgaatattacgcatagacagttcgtgggtacgtgagtgtgttgcgtttactgtggtgtgtgcatgtgtaaacttacggtataataaaagaaaaaaagaagaagccgatgaggacaaggcatgtttgtatcgtcgaccctccctattgcatacctgtggacctttttactggtgagattgaaaacatcgtttgcttgttagtttattagtgcagacaattttcaaaatttaagttagttttgagtatttatattaaaatttatttcttacattgacatttaaaaatatataacataaaagttttacctataaatttgattttgatttcttcgttttttttgtctgtttatcagcatagagtaaacaacgaaggttgaactgtatatttccagttttttttaagaaaaaacatgtatatttccctttccgccgacaaataccccatatgtagcgtcatctcgccacgaagcaacctatgtaggtggtgtttgaatctcctgagatatagatgaagatgattaagtgctctatgcaaaacgagatggtaatagcatgtgattaattgagttttaattattacaaacttaaaaaatggattaatctgatattttagaataactctcatatcaaaagttttcatataaaatacaccgtttagcagtttgaaaagcgtacactttaatccaaaatttcatcaattcgagtggggcagaaaccgacttgaattattattctccgtcccacgaagcgccgccgaataagatcacgctcgcctcctcctcctcctcctctctctctctctcatcccgtctccctcccgaatttggggtgtgtttggataatgggaaatgggggtaggatttaaagatgtctttttgttggtggaaatcatttccatttcccattagccaaacattgccttgcgatctcgcgacgaaccaaaccgatcgaaaccctagctagggttacgccggcccaccaccaccaccacctccccggccgccgccgcaa

SEQ ID NO: 1264 - DNA, 1501 bp, Oryza sativa
aagaaaagaacagtacataacaaaatttttacacttctttaaaataggataatggtggtggcaataaatccgtaaagttacaaattaaccttgaacctcttaatattaagagctcatttaaaatatgctgccacgtataaaatcgaactaaaggtgaacattcctcataaaaaagatgtgtaactcgcgtatattttgttttattcgtagtaaagctcctgcattcatttagtttaacataaaacagctagaaaacatttacagaaatgaagtagtaataattactgttcattagttatgactctctcacgggcaaacagccaaacatgcacagcagtatgaaaaagaagcaaatgcaacaaaagatcgcttggctggtggtcgtcacggggagtagtgtcagtcgtgagagacatccagcaaactccaacatccattctccgccgttggatccatcacctcaatcaacatcaaccatcccaccctctcaaccccaaacgcaaagcacacacccccctgcattaaataattcaaaccgaggaggtggagcgtttaggaaaagagccgccgcctccttctcctgcaagccactccgtttccgtctccgcccgcccgcccgccgtcgtgcgcgcctcaactcaaaaaccccaacccaacgcctctctctctccatctcgccgcgtcctcctcctccacccgatccagcacgcgccgccggcgacgagccgagagggatccgcggcgcgggtggggttgtggggcgggcggagatggcggcgaatgggcgggcgtcggtgcggcccgtggagaggcacggcgcgccgccccgccccgccgggcgctccaggtcggtcgcccctccgtcgcgcaggccctccccgtccccctcccgcgcgcgccccgccgccgccgacaacgacgggggttcaggtacgcgctcctctgctgctccgcgcacccgtgaatcatcggagattgcacttcatcatcggtgtattgggggtttttcgctgttggtgcttttcgtcggaggccgtccggtgaatgatgcatttcctctgttcgaggagccgtggaagcgcgtctcgggtttttcgctcttcgtcggtttatcgggaaactccaaacgttacggatacttgcaacggcgacgggaatatcattgtcgctggagagatgaccatttatgcatttcagcattggaaattcgctatcagttatatattgtactcattaaatcgcacacacatgaatacaagtcatatatgttcgcacacacatgtatacaagtcatatatgttcgctatcagttatatattcgctctgaatttacgccatttccctggtgctgctagccttctagcacagtacattctgctagatatctgtaatcgatgctgttttctcacattctgatgcggtgaatgtagcttaatatgctttacagtcgtttatggagttgatgtcaatatggtatgttttcagaattgataaagggtgt

SEQ ID NO: 1265 - DNA, 1501 bp, Oryza sativa
gccgcggagaggggaggagggcagcggcctcctggacgccagcgagcgggggagggaggaggatgcggctgcggcggaatcggccatggcggacgaggtgggggcgatgagatgcgcacgggatcgcggaaaaatgggtggattttttggggaggcgatgcgtgcgcgctctttttttcttgtggtggccggcgcttggtctcttggtcggtttttgttcttggccacaggaggaggatgttggatctgggccgttggttggtagctttaagaaagaatgaaggggtcagattagcccgtacccggttggggtgttttatccggtgtgtaaggtggtctgcggtgacaacaaggacggtttcagcggtcttgcttccctttttttttaagaaaaaaataacagttgttaacccaaagttaaaccaatcattgtcacactataaaacaatatagctttcctaaccgtttttcaatcaggtttagtatttagttctcccttgttccctacgagagaggatttggcttcctttaatggcaaaacatataaagtatggcgttattaatgaatctcctctttatcactttttgtgcagaaaaaaaaaattatagagatgaacatggacaactgcttgtacggtgaatccatcaaacataaaacatgtaactaagctacagtgaaaccatcaaactaaattctagggagtatttcatacaaaacataaagtgaaatgtggactagttagaaatagttgtactatatgactggtgttactctctagtttgtatccaataaaagatatcacaatgccattaaatagtgatgaatatactataaggtggtattttgttaatctaaacgaaatgaggaagggatcaaaattttagtctctgatcctaaagtgcacatatttatggaatattgcaagtttagtctacatcttttaagggataatccaattatccaattgtccaaacaaggtttgggggggggggggggggcattatttgcccaagtagtcgagtttgtgatttgatgtattatatcggaacagtttagcctatttcagcatagtgctattttatatgactatattaacatacatttttcatatttctaaacaaggttattttttttagagttataagtacattatagagaatgtatttgtggaggtgagcgtgatattgcatatgtgcacttatgcatctataatctctgtcgtgtatttttttttaaaaaaaaaatctaaatcgccgacttttaattttctcgaaacgaaggagggggggtcggagttttaatcccgaccccatttgacgttttctttcttaaaaaaaaaaggaactgacgtcagtgtggcaacgttgttcgggctggtctcccctccggcacgtctcaagccaggcgtaccaagcaaccaaacaggcgccgtcgcgggcatatccgataaccgataaaccccctcccacactctccactctcgagccatggccctcgccg

SEQ ID NO: 1266 - DNA, 1501 bp, Oryza sativa
ataagtctattttacatccttttctttcgtccaaggcatataatatgtctatttttactcccctatttttttttgtgtatcgggcttggctgccggcccatcgtgccgtgccgggccggttgtgtcgggctggcccaacgtgccggtggagtggcccaggcacagcccggtgctgtgcttgggccgggccaaaatgccatgccatgggccgggccatcgggcctcgggccttttggccatctatacattcacctctacctcctcgaaattcctagttttgttcgtcttctcttgtgtatctatttcctcttgtgatttttgagaggtgatggtattttttaagagacattgctgatggatgttattttccgaggtgctcccacatttcactatagaagagaaaaaagagagtctataaaaaaaacagatctaaaaatctcacaacggcacggttaatttatataaaaccggcaaaaatcctgccgttgacttactgaactaaagaacaaccatccaataaggaaaaaactcctaaacaaagctttaaggacacgctaacagaacgacgacatcgcccaatccaaacgaatataaggttttcacccgaagaaatcttttgatgtggagttgaatgaggactccatagcaacgccttcaagaaagtgaacagcgtcagaggatgtcgccgccgctagcaccgtcaagccaagcaagactttcaccttggagtcctatccaaccatatgccacctgcacatcgaaactacttgcactatgtacaccacctacacaccacaacaacccgcaccacgactggacagcgctgttgatgacccgctcctccacctagccgggccgctgagcttcaccgagtcgtggagctgaaccatcgctaccaccaaacgccaccatatagggaccaccatagcacctagatccggatctggatctgcaccgttgatgaaattgccgttagaatttcgatcatcccgccacgataaatgtattatttatcctatagcacttaatggagagatgctaagtactaacggaacattaacgacgatgatatttttgagacaaattaaatcgctgatgcaatgacatttcatgaaacttggacttatttgaaattgtgtgcttgtcaattatatttatttggattttctcttagattaattatgcatcctccgttcctccagccgatcgatcgtcccgtcgatacaccagaaaacgaccagaaaacatttttttttgaacaaggtaacgtggctatgcatgccgagaagagctgagggaagcaggaagaagcatcccctgctattattacacccccagaagtcgaaaggcgcgatagccatgaaccgtccagcgcacgcgcgcgcctcgaccgctcactcctctcccgcgctgaccacctctgcatgcgctctgtataagcacggcccgcaacgagccccaccattgcacgatactggacccctcgtgatggacacccgcc

SEQ ID NO: 1267 - DNA, 1501 bp, Oryza sativa
cggcggccttgccggccaccgcggacagcatcatccggccgagcccgcggcggcgccacggcgcgcgcacgaagatgtcctccacgtacagcccgggcttggagaggaaggtggagtagttggggaagcagatcacgaagcccgcggtgacgcgcccgccgccgcgaggggaggcgaaggcggcggcctccgggtcggcgagcggggacgcggagaggtcgaggcagtgggaggcgatggtggaggggccggaggcggggagcggggacggggagaggtcgaggatgagggcggtgaaggaggtgaagggagggcgcggcggcgaggggaagagcgtggaggtgaggagctcgtgggtggcggcgaagaggtcggtgaggagctcgaactccgccatctggtggatgagggcgtggatgtggggcacgtcgctggagtccgccaggcggagctccgcccacacctcgccggagaatgtggtggcgttcgccggcgtcgccatcttcgcttgcgggcttgcggcggagacgatagggagatgtggcgactggcaaatggagagatttccccccccccccccttgtgtgactttttatctggagtaaattttggaaaacactatagattttaaagcacatttcctcagtttcatattatacctcgattgaattttttaatcatttttctataatttaagtttgtatcaaaatacaatactaagaattataatacaaaacaaatattgtattaaaatatagtcaacgttaaatttaatgaatgaaactaacttactgtcgtagatattactatttttctctataaatttagtcaaacatatataactttgactaaggaaaaaaatctaacgataatataaaacgaaggagtactatgtaatataaaatcccatatattatgatttattttagaaaataccagatactaagagaaaatgtttttgaagaatccccatatttatatcacatgctcataatttcattaatagttataatattttaagtatatatttacattattaagctcaaaatacacatccctccggcataattcattttttcctttactattatacaattgaaaaaacacaatacaaatatataaccggttgcttatatatataaaaactaatgatactaccaataatcgaaaaaaatgatatgtactctgcaatatctcgtattattattatcttataattattatacataaatatattaaaaacaataatataagcttaagatattttaccttaaaatctgagattcactgaaaaaaattataataatttaggttttatgttagatatgcctcgaaatttttatgaattttactcttttatatctatttttctattttccttttttttttgtctagtgtgttggcttttaaaccccccttgaccgaagtcgcacgcgccgccataaaccctaaccgcagcgacgcactccacctcctcctccaccacgccgccggcggccgg

SEQ ID NO: 1268 - DNA, 1501 bp, Oryza sativa
tcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagtttattttagaatagacggactctctctccatcccataaaaaaccaatataatactgaatgtaacatatattagtattacgaatttggacatatctctgtttaaatttgttgtactgaatatgtcacatttaattttagactcggtttttatgggatagaggaagtaggtgcttaggccctcgagtctgtgattaatgggcaaatcatactcactccatccaaaaaaaaggcaaaccgtggattcccgtgctaacgtttgactgtctgtcttatatgaaatttttttataattagtattttcattgttgttagatgataaaatatgattaatactttatgcgtgacttatctttttaatttttttcataattttttcaaataagatgaacggtcaaatattggacacggaaacaagggtttgtctttttttaaggcggagggagtatgccatacctagcttgacaattgatacccctgacactgattgaagcattgtgtggctgctgtactctagaaaattgatattttgccattatcgaaacggttcgctggagtgccacttacaaaagtggtctcgttaaaatgccacctttgaacagggataacatgttgcaatgccatttcatccatttcttcttagtttaatgatttttgtaatattttttcttgctgagatgaccaaaataccttgatcctatctcatgtctcctccatctcttcctactctccgttgcagatggtgggcggcttggtggtgcggctggggatggggacggcggccccccccctggggactgggacggggacgaccccgacgtgggtgtggaaggctgcttggctcggcggcgctgctggggacggcgtacctacgccgcgcgggcgcggctgccgcccatggaccccgcgctcaacaccgacactaactgcatccggggatgcgtctcccaggtctgggtccacgccgcgccgaaggagggcgcgccggacagggtcagcttccaggccgactctgacgcgcagctcaccaagggcctcgccgcgctgttcgtgctcggcctcttcgacgcgccggcgcgggatgtcgccatggtgcccgtc

SEQ ID NO: 1269 - DNA, 1501 bp, Oryza sativa
ccgcctccgccagcgcaatggcctggaggacgtccggcggcggcgcggtgcgcatggacggcttgccgtcctccccacgcacgatccacggcaccacctgctccgcggacggggcgggggatgagggtttgggtttcgagggggcgggggcggtgggctccgcgaaggtgatgttgaagtccggggcgctggaggtggaggaggaggcggcgcggaggaggaggggagggaggcggcggtggcggccgcagcggaggagcacgcaggcggcgggacgggagagcaagggcgggaaggagacggccgctgccgcggcggcggcggcggcggcgagggccatggctcgagagtggagagtgtgggagggggtttatcggttatcggatatgcccgcgacggcgcctgtttggttgcttggtacgcctggcttgagacgtgccggaggggagaccagcccgaacaacgttgccacactgacgtcagttccttttttttttaagaaagaaaacgtcaaatggggtcgggattaaaactccgaccccccctccttcgtttcgagaaaattaaaagtcggcgatttagattttttttttaaaaaaaaatacacgacagagattatagatgcataagtgcacatatgcaatatcacgctcacctccacaaatacattctctataatgtacttataactctaaaaaaaataaccttgtttagaaatatgaaaaatgtatgttaatatagtcatataaaatagcactatgctgaaataggctaaactgttccgatataatacatcaaatcacaaactcgactacttgggcaaataatgcccccccccccccccccaaaccttgtttggacaattggataattggattatcccttaaaagatgtagactaaacttgcaatattccataaatatgtgcactttaggatcagagactaaaattttgatcccttcctcatttcgtttagattaacaaaataccaccttatagtatattcatcactatttaatggcattgtgatatcttttattggatacaaactagagagtaacaccagtcatatagtacaactatttctaactagtccacatttcactttatgttttgtatgaaatactccctagaatttagtttgatggtttcactgtagcttagttacatgttttatgtttgatggattcaccgtacaagcagttgtccatgttcatctctataattttttttttctgcacaaaaagtgataaagaggagattcattaataacgccatactttatatgttttgccattaaaggaagccaaatcctctctcgtagggaacaagggagaactaaatactaaacctgattgaaaaacggttaggaaagctatattgttttatagtgtgacaatgattggtttaactttgggttaacaactgttatttttttcttaaaaaaaaagggaagcaagaccgctgaaaccgtccttgttgtcaccgcagaccaccttac

SEQ ID NO: 1270 - DNA, 1501 bp, Oryza sativa
aacgtgaacgtacattggcgaagcagtcgtggaagaggaggcggaggaggagggcggaggtggtagggtcctccttgaacttgcgctcgatgacggtggagacgaccttctcgacgttggggcaggtggaggagtagaagtcggcggagagctgggcggtggcgagcagtggcgccgcggcggcgacgacgccggcgaggaggaggaggagggggaggcgggtgtccatcacgaggggtccagtatcgtgcaatggtggggctcgttgcgggccgtgcttatacagagcgcatgcagaggtggtcagcgcgggagaggagtgagcggtcgaggcgcgcgcgtgcgctggacggttcatggctatcgcgcctttcgacttctgggggtgtaataatagcaggggatgcttcttcctgcttccctcagctcttctcggcatgcatagccacgttaccttgttcaaaaaaaaatgttttctggtcgttttctggtgtatcgacgggacgatcgatcggctggaggaacggaggatgcataattaatctaagagaaaatccaaataaatataattgacaagcacacaatttcaaataagtccaagtttcatgaaatgtcattgcatcagcgatttaatttgtctcaaaaatatcatcgtcgttaatgttccgttagtacttagcatctctccattaagtgctataggataaataatacatttatcgtggcgggatgatcgaaattctaacggcaatttcatcaacggtgcagatccagatccggatctaggtgctatggtggtccctatatggtggcgtttggtggtagcgatggttcagctccacgactcggtgaagctcagcggcccggctaggtggaggagcgggtcatcaacagcgctgtccagtcgtggtgcgggttgttgtggtgtgtaggtggtgtacatagtgcaagtagtttcgatgtgcaggtggcatatggttggataggactccaaggtgaaagtcttgcttggcttgacggtgctagcggcggcgacatcctctgacgctgttcactttcttgaaggcgttgctatggagtcctcattcaactccacatcaaaagatttcttcgggtgaaaaccttatattcgtttggattgggcgatgtcgtcgttctgttagcgtgtccttaaagctttgtttaggagttttttccttattggatggttgttctttagttcagtaagtcaacggcaggatttttgccggttttatataaattaaccgtgccgttgtgagatttttagatctgttttttttatagactctcttttttctcttctatagtgaaatgtgggagcacctcggaaaataacatccatcagcaatgtctcttaaaaaataccatcacctctcaaaaatcacaagaggaaatagatacacaagagaagacgaacaaaactaggaatttcgaggaggtagaggtgaatgtatagatggccaaaaggcccgaggcccga

SEQ ID NO: 1271 - DNA, 1501 bp, Oryza sativa
tatatgtttgactaaatttatagagaaaaatagtaatatctacgacagtaagttagtttcattcattaaatttaacgttgactatattttaatacaatatttgttttgtattataattcttagtattgtattttgatacaaacttaaattatagaaaaatgattaaaaaattcaatcgaggtataatatgaaactgaggaaatgtgctttaaaatctatagtgttttccaaaatttactccagataaaaagtcacacaaggggggggggggggaaatctctccatttgccagtcgccacatctccctatcgtctccgccgcaagcccgcaagcgaagatggcgacgccggcgaacgccaccacattctccggcgaggtgtgggcggagctccgcctggcggactccagcgacgtgccccacatccacgccctcatccaccagatggcggagttcgagctcctcaccgacctcttcgccgccacccacgagctcctcacctccacgctcttcccctcgccgccgcgccctcccttcacctccttcaccgccctcatcctcgacctctccccgtccccgctccccgcctccggcccctccaccatcgcctcccactgcctcgacctctccgcgtccccgctcgccgacccggaggccgccgccttcgcctcccctcgcggcggcgggcgcgtcaccgcgggcttcgtgatctgcttccccaactactccaccttcctctccaagcccgggctgtacgtggaggacatcttcgtgcgcgcgccgtggcgccgccgcgggctcggccggatgatgctgtccgcggtggccggcaaggccgccgagctcgggatggggcgcgtggagtggtgcgtgctggactggaacaagaacgccatcgacttctacgaggggatgggcgccgaggtgctcccgcagtggcgcatctgccgcctcaccggcgctgcactcgacaagtacaaggggaaccaggaggaggggggaggcagcaaggcggcggagtagatcggccatggatggaaacgtcgattcttggctgtccaatctcgagtgagtgattagtgataataaaggtagtggattttggttccacttatctgctccttgtggtgatgtatttcttgatagtgattcagtgcattggatcggttcttcattgctatgaattacagtgatgttttagcttgattatgtcatgaacttgatctgaaacatttcggtatcaaattcttgattgaaccacactgatttcggtatcaaatttctcatagggtgtccaagttgattcatcagagttcagtaacacatggcttcagtgcaatttgcctcccatgtcttattcattatcatctaagctattttcatttgtgtcctgaatccctgatgcttccatcctggcaaggaaacatataaaagaaaaatggaagaagtggagtaaaagctccaatggtatatgaatgtcttagctgggtcatgtattcatgt

SEQ ID NO: 1272 - DNA, 1501 bp, Oryza sativa
ttttagtaaatggatgtttgtgtgtgcacatatggatcaattgcagatttttatcaagtatgcaagtttatacattttacattcaattcaaactgatgctacaacaagataactgagattcaatcagtttgaacttatccgggaacatcgaaaagtattcatgtaagtagcatctttaataacgattgtcctagtgtttgtcctgagcgtgaggcagtgtggtacaaattactccctccatcccaaacaaaggcaatctagtactaggatgtgtcacatcgtagtacgaggttgagtttttttgggacggagggagtaattaacagcatttaaaatatttataaatagcacaacaaattatcaggaatttcccattttcattgggtaaatctaactgagtgcctctttttccaatgacaccatgaatgaaatcattggctattaccatattggcttaacaaccaaaaatatttgctcattgcatttagaaaaatgagcgccaaaatatttgctaatttagtttcagcttcttttagattgccacgtcttggtcattattaccagatatatgaaacacaaaacgcatttaagaaggcattccagcaggagtcgtcattaaaactatccgaagcatcaagtactgacaaatatgccattacaagcttaacgtaatatgaccattaaaattatgtttggataaggcacttggcgggaaagcagggtggtgcataggaccttagtgggaaggtgacacctagcaccacagcaggtcacatcacaatttagaacagtatttttcaaaactaagacttttaaatatctctacgactttagttcaataggtgaaccaggcacatgctatgaaatcaactaaaaggtaccattttcaacctggctaatctgtttttccccaattttgtggtctgatcggtcacttaggccttgaaaaacaagggcacataccatacatctacttcctcaacactaatcaaaagccctgataccacatccactaatttaaatcttgcaagccaacaacaaaatgaaatcacaaggataaataatacctaaatttagtaaacaaaaaacattccagaccactaattttatcagctctacttcaagcatgactaaagcaacatcttttcccaaactacttaatctcattatctaattccacatccactaattcaaatttcacaagccaacaacaaaacgagattgcaagggcatagattacctcaaattagtgaacaagaagcatcccagaccactaactttatcagctctacttcaagcatgactaaagctaacactttttcccaaactacttattctcaacatatcaaattcgcattagatacaactctatccaaatcgaacgagtcggagatacgaatctagtgcaggggggggggggggggtggacacaataccatggccgtgcggacgtcgtcggcagcccaccgcgcctgccaggcggcggcgaatcgcacgaagg

SEQ ID NO: 1273 - DNA, 1501 bp, Oryza sativa
atacttgctcggccagccacctggagtgaggcgatacctggtcttgctgttaggaaccaagaggggcggacagacgacgcaatacaagccggcatgagtgggttattgttccagcatgactcaaccagaacgtggatagcggctgcgatctcccggcgtgaaggcagaaagcggcggcgtcctctccagattcgagagccttcgaggtgagttgaggtgaactgcaacggcagattcctgacgttgtggaggcggaagccggaaggcagccgttgcagtctcccagagtcgaggtgaacggcggggatggcagcaccttgcctgagccctgcaccaacattgggcccgaggagaggagagtcgacgatggcgcctctccgcatggcggcatgggcgccccaaaccgagcctggacgtgcttcggtacaacgtccacctctggacacttcttagaacaacgtccaaatctggatgccctttgaaacaacgtccatcctatttttacaaattcaatttaagatttaccacttatttaattcaagacttattaattactataaataaaaaattagtttttcataggcagggtaaaaaaaatattgtataaaaatcagaatggagatgcatttcttacttgtgaaactctacaatgtagagatgtgctcaggtgggactatttgaaattttcctaataatctcatcaccttacgagagagcattgatgaaactcaactgccactaagtatatgagagcactgatgggtccatatttctcctttatctgttaattctctgatagaaaaataatggctggacaggataaagtggtagactaatatccgatggtacattaagtttttcaaaaatacatttatatgcttttgttggcatggttcctcgtccactcttaccatgaactatgagcaaaacagaaacctacggccaggcacatgcctgcaattaacaccaaatgcaaccaacgctatcaccattgttctgctcaccggcagtcttaccgttgcctagtcacccttaaactatgcccagtgcccaccaatcactgccaaagcccaagacatcaggatcagtagttgcaaagcactagatgggccatggcgcggcgccacgccgcgcgcaagattatatcagtaataacatgaataatacaggatggtacattgcgataagagcatttacaataatcatctaggcaaaacagataggtacaaataactgacaaattattaatacatatacgcatgtcacagtggacatatttttgacaaaccacgcattatgacaattgccatcttcaaacaagaggcaacgaaattgtcttcaaacatggttacaacagtatgacatcttttgcttggtttccagctgaagactaacaatgatcagtcttgtaagctcaccctattagtgaggtctctgagaaacaactccacttcagtgaacaatgatttggataaaaaaggagtttgctctgttcttttgt

SEQ ID NO: 1274 - DNA, 1501 bp, Oryza sativa
gctacagccttatacttgtcaacatttgagataggtaggctacaataatttttattatatatttaagttgattgggttcgagtgttccatcaagatcgtgttccttcacaatgtctatattatggtctaattacaatcttttttgtttccaaaaccaaattacaacacacgacacacatgatccagtttgctaaccatgttagtgtctaattttggctctgctcttctcttgctctcgttggttagagttaggcgtgccactgcctcgccccctctatccttgctgccatcaccacacttggccgtcagccaaccactctcactttcttaacttcttgatcacatgacaaggcaaggtcacattagacgaatcaaatgcacaataacaacatggagcgagtaaaaacatagggacaatagaagttatgccatgttattcatttcaatagtgcgggagtttttttcctaaatgatctaaaggttatgttacaatttctcgttactattttacaagttaagatccataataacaatatttctcttaaagggatcgaatcacaaagattaacatgaattatctaacttttattgtaattatagtttcctgttgcaatgcacgtgcccttttgctagtataagaaatagatatagagtctagttacaattacaaaacggaattttaacaagttatgtaactaatcaaagactatagatcttaaaggctcattcatcctacacatatgctttgaagttttgaaaccattgatccaccgatgggttgatattatggtaaattcattcctctgcttccaaatgtgccaacatgcaatgcacataatctttaggaaaccttttcttttcaagccgattcttggtagaacaatcatttgaaacaaatttaaattaatattccatctgaatccagttcttgtcccttcaactaaaagggcacatgaaaaaagatgtatcaaggtctcccttatactagttgagcgcagaacataagagatgttagcatcttttgaagcacaattctttttgtcaagcatatctttggtgttcaatctatcataaaagagtagccatatgaaaactttgattttcatgacacacttggttagtttgttttccataacaatttaaatggtcttgaggagaactaacaaaattagccttacagaacttttgagctgtgtatctttatgctccccaaatgtagctcctagaatccccaattccccattggcatatgcagaactaactagatttccatttgtaacaactgaaattcactgtatgcttcagctgttataaaggcgtacttgaaagaatcttctagaggttttgcgcacatagcctttactgatttatttatgttgaatgcatgattgcataaatgagggtatttttttagcttctgacttctgaatcatccattccataaatcatccaagaataacactgtatttctagagacaacagtatgtgtaattgctctata

SEQ ID NO: 1275 - DNA, 1501 bp, Oryza sativa
gccttcttaaatgcgttttgtgtttcatatatctggtaataatgaccaagacgtggcaatctaaaagaagctgaaactaaattagcaaatattttggcgctcatttttctaaatgcaatgagcaaatatttttggttgttaagccaatatggtaatagccaatgatttcattcatggtgtcattggaaaaagaggcactcagttagatttacccaatgaaaatgggaaattcctgataatttgttgtgctatttataaatattttaaatgctgttaattactccctccgtcccaaaaaaactcaacctcgtactacgatgtgacacatcctagtactagattgcctttgtttgggatggagggagtaatttgtaccacactgcctcacgctcaggacaaacactaggacaatcgttattaaagatgctacttacatgaatacttttcgatgttcccggataagttcaaactgattgaatctcagttatcttgttgtagcatcagtttgaattgaatgtaaaatgtataaacttgcatacttgataaaaatctgcaattgatccatatgtgcacacacaaacatccatttactaaaatgtgttttgccaatgtgtgcacaagtccaagttagcatacttgcatttatgttatggttttatgtttaagcactggtcactatactagttattctattgaaatggtgatgcgaataagtatctaaactagaggacaactgcacttatgaactaattattctgttgaagttgttactttagttaagagtcacaattagagccacaatgcaaatgtgccaagcttattatactccgcgatatttgccaattcattgtgaagtttgctcccacaatgaactgttagatcattagatccaagtctgttgaactccacattagttttagtttcccttctattagacgataatgatatctttattgatcagtaataatgtttttccaggtcaagggagaagcttgtatgatatgcaagaatgatgcaaacgagacccttcatctgcggaatatatgctttgattggacaaaagatgatgtatgctttcatccttatttaattaattgattgtaatttttgtcacaagcatattgttattttctacaagggttctcttctgtgcagttagcggaggaactgaaaacttacaagttggaaaaccttgaggatattaatttagtcgaggatccggaaagaaaaggaaaaaacagaggctatgcgtttcttgatttccgcacaaatgttgatggtgtggatgctttttttaaactacagaacagagatatttatcttggtacggatgttcgagcccaagtgtccttttcaaaaactctttcactggatgataagattatggaaaaggtagtcacacaaacaaggcatctatattttgtactatatgaatctgttacacgtattggaatatcttggctttgacttagctgctataactttgattatgcattgcagg

SEQ ID NO: 1276 - DNA, 1501 bp, Oryza sativa
tgcttcatatctggagatttgggtagcggaaattgactacaacgacctatctctgattttggagtcgatactaaataatcaagagaatgggcttgttttgtttttttttttttttctagagtgggatatggaaacacctagcccaccgtctaagatgagatgttgtctaggataatagttgtaattggtagatgggatattgcagggctacgagagggtaaatgatccctctgtgtaataggggaggggagtttatttctagggtgaactaaaccatccaaacaagcaagtgcaattctgaacagaaagtaaggtaattgactgcaacatctatcaccgaatagatggtgaaatgaagatcttaggcttttttgccacttgaattgtagtttctaaatacatgtccactgatatatctgaaccatagctacttttcacggacaaactagcttcatatgtatgaaacatggcaatgaaaatgttgtttgattcctggattctgacctactggatttggatgcatcatctttcctttgaagtgttagccatcatctgcaaaagtattgcattcccaagctctttggatggcccggtgccaaaattgaagaacatcatgtactgtgttggagagtgcaaaccattcaaggcaccacaaaacatatctcctctgttctttgtagatgttgtattaggatacatgcaatcaaagattcaaacatcagattctttaccagctaaaatatcaaaaaatattaagacttggcagtgtagttatctttttactaattcttatagatatatgattagaaaaatagaatggtaaaaacatgggtattcgacactctcgcagtgtactagacaagtaaaaaaggacactagggagtataaatcagtcagcacatatttcattttggcacttgatatttggtgccacctcacctgtcatatcatggttttgttgttttccaccttactttcaggacagtgcaaatgtaccaaacaacacagatgtttgcattgatgtgtaccatacccttcagttcaaaatttcgcttacatgatacaagcagatagcagcagactccggtccttctcgtttttgtatttgagagtattctgccatagttccttttagggttgctaacttacttgccattttaccccacgttatatatgatgtattgtttggcaggagaacgtcaatcgaggtcattccagttcagaaagaaaaatacaatttctttgctatccattcatgaagaattgtacattacagagttttaaagtaaattgaaaaacgattgcaccacaaaccactttttatttaaatttgttgtacctactacatctcatattgttaaatgtcaggtcaacatactggggatatatacatgacaaaagaacagagcaaactccttttttatccaaatcattgttcactgaagtggagttgtttctcagagacctcactaatagggtgagcttacaagactgatcattg

SEQ ID NO: 1277 - DNA, 1501 bp, Oryza sativa
aatcagtcagcacatatttcattttggcacttgatatttggtgccacctcacctgtcatatcatggttttgttgttttccaccttactttcaggacagtgcaaatgtaccaaacaacacagatgtttgcattgatgtgtaccatacccttcagttcaaaatttcgcttacatgatacaagcagatagcagcagactccggtccttctcgtttttgtatttgagagtattctgccatagttccttttagggttgctaacttacttgccattttaccccacgttatatatgatgtattgtttggcaggagaacgtcaatcgaggtcattccagttcagaaagaaaaatacaatttctttgctatccattcatgaagaattgtacattacagagttttaaagtaaattgaaaaacgattgcaccacaaaccactttttatttaaatttgttgtacctactacatctcatattgttaaatgtcaggtcaacatactggggatatatacatgacaaaagaacagagcaaactccttttttatccaaatcattgttcactgaagtggagttgtttctcagagacctcactaatagggtgagcttacaagactgatcattgttagtcttcagctggaaaccaagcaaaagatgtcatactgttgtaaccatgtttgaagacaatttcgttgcctcttgtttgaagatggcaattgtcataatgcgtggtttgtcaaaaatatgtccactgtgacatgcgtatatgtattaataatttgtcagttatttgtacctatctgttttgcctagatgattattgtaaatgctcttatcgcaatgtaccatcctgtattattcatgttattactgatataatcttgcgcgcggcgtggcgccgcgccatggcccatctagtgctttgcaactactgatcctgatgtcttgggctttggcagtgattggtgggcactgggcatagtttaagggtgactaggcaacggtaagactgccggtgagcagaacaatggtgatagcgttggttgcatttggtgttaattgcaggcatgtgcctggccgtaggtttctgttttgctcatagttcatggtaagagtggacgaggaaccatgccaacaaaagcatataaatgtatttttgaaaaacttaatgtaccatcggatattagtctaccactttatcctgtccagccattatttttctatcagagaattaacagataaaggagaaatatggacccatcagtgctctcatatacttagtggcagttgagtttcatcaatgctctctcgtaaggtgatgagattattaggaaaatttcaaatagtcccacctgagcacatctctacattgtagagtttcacaagtaagaaatgcatctccattctgatttttatacaatattttttttaccctgcctatgaaaaactaattttttatttatagtaattaataagtcttgaattaaataagtggtaaatcttaaattgaat

SEQ ID NO: 1278 - DNA, 1501 bp, Oryza sativa
gcatgttaagcttaagcagttagtgggggataactttatagtaagataggattatgctttcagcccataacttcaggcccgtagagatctcaattggaaactggcagaatatccgaggatggagggccaccggctcaattgaacaaccccacctgcgaggtctgggaatacagatgccggttgcctcctcttctgcaactctggtgacagaatcgctcccccgaagcgaactatttctccgtttctttcctaaactctagctatgcatctcgccgtcgtctcccgctccgcacgcaagcagcgggcggctgctgctccgcgcctccgtcgtgtggggctcgcgagagcctggaccatggcggaggcctccgccgacgttgctcgccaccggatttggcgtggtctacttcttcggttattggttggctacttggcttcacgtctcttccaccccaaacaagagcttaattgggccgatctcaagccctagaaggaacttgcacttctcgaccaaaaaacccaaacaaggcctaattgggtcaattccccctatattctcgtttcgcacggctcaaccgctcatcaagccctagatagtgctctctctctctcttcgctcgattcgccggtgatggcggtgccgccggaggcgacgagggcgccgccccagactgaaggacggcgtcgaggtctgcgtatttgacgaatcaccagaggtcttctccagagcggtgcacgccatctcggagctcacagccggggagcccgagccgaacttccctaacgccgaagtcgagcggctcgcctcttcattaactttcctcgggtgagaaactccctccttgctctgtctaatccggtacctaatcaccgcggcaaaattggtaactttctgttgttggcctatttagctgggtggagtggacgaatttgtgtttaatagtatcgtttatcagcaaagcattaatttgttagtcattgatgcaatttcagggagcttttaatgggaaaacttatgtggcatataagctctctttaatttattcattgccttatgtgccacacgcggtggcaaattttattggaatttgttaatttagatcccaagacatcgctgctacacaaacaggaaaaaagcagttgtcacatgaatgctttggtgccgtttcattattcctgttgtggctattagaattcatttggcttttgccactgcaattgaccatattcttacttccagtatccttaggtaacaatattagctcaatgcacaattttgtttttctattaattagaacgatacatggtttttttttcatgtcgtaaacaaaatgcaactgcatttttagttgttttactactaattcactaagtttaagtcacttttgttctggtagttatatttccttaatctgtactcatctgttgtttgatgactctgatcgatgatcatttttgcacattgtgactttctagcttaccatttgatgttatggtttac

SEQ ID NO: 1279 - DNA, 1501 bp, Oryza sativa
gatcgggaaccctagtgcacatcaagtggtatcagagctctaggttcaccgtcaggttcgctcagtttctttgccctagattagtttttgtttttcgtaattatcctagagtctacagaaaagccaaaaaaaatttagtcgttagtaaccttaacctagaccgtgtttagcctttgcatgattctttttcagagtccgtagtgttgagtttgagtcctagtttaagttcctattgctggtctagtgcgtgttttagtctagtcgtgtgttttttcctttataaccctatcctttgagagccatttccgccatcataaacacccaattccagatcaccacgcatcaccacaacatcctacaaactccgctgccaccatatcccaattccaccgcaaaataggctaggttatatcccctttggaaaacttagccagaagccaaaacttcaaacagccataacttttgcatacggactcggaatcaggcaaattttaacttttcagataagagaaaaaaattctaaaatttggcttgcaaaattgtctgttcgagcccacaagttcctgcaccttgtttatagtggtttcagaaaattccataggccacatatcaactccgatttagctgtaacttagaggtgtgcctattttcgtgttctggaaaaagaaaaaaatatcaaaaaaataaaagaaaaaaaaagaaaagttgatttccactactgcattaagctcacgacgtgctccgttgagcttatctgccagttcggttttgttgtttttgctaaaactcgccgaagcttgcctgcaagtccttctttgctatttactagtgtcattttccttgaaccattattgttaccactactgtctaatacacgagtagaccagcaactaagggcaagtgacttgggatttttattcagcattactatctgtcattggattgtgtaccactcatatacatatatttggccttcctagctccacatatttacttctggacagcacaggttcttgatccctgcatcgctgactacgccttccaggtatcctttgctttgctactaagaaccttataagagcttggttaggtactccatattgctgagaatcgttgagaggcaccactacacctgcgtagtagattattagggataaccttcaccgtttgtttctgttttggtgtttcaatggcaggtaacgaaggtgagaagagtccccaggattttgctgactatgtcagctaagagcaactatgaactctccaagaaaaaggacatcacggaggccgttggaaagtctgtgcaagatgccttcactaaactcagcttcctgaaccacatggagaggttggacaaacggatatccacgctaactgatcgggttgccgcgttggagacaccttccaatgaggaagtggtgagtggtgacgacgatgctcatccggaagatacggtgtatgattccagtggctatattgacacaccagctacaaggcaagc

SEQ ID NO: 1280 - DNA, 1501 bp, Oryza sativa
cctagtgaaccgacatcaattaattttaccttttcactctaaccttctcatctttgcaattgttgagagtcaaaataattgcagctaatacatgcataaattaattgagtttaaatagatacactcggaactccttttatctgacgacttgtttttgtttcttcaacgtctgttacataagatgctaaagccaatgatatccgcggaagggagaaggtggtgtcaatatgaattatttaacacgtggtcctctttcaataagaattttgtgggggaaaggatttcagcatagttatctcatggaaaattgaaatttccttgttctcagaaatttaggaatttttgggaatgatatctttttgaaagttgaacaaagattgatttaactcataaaaaaatttaacttggaagtttaaattttgaaacgcatcttgatttagtgcttgctatattagggtggttggtgactctactatcactgcaaagccttggaggtgactagagatcggtcggccgatcgaaatcttcaaaactcgagcgctgacgtcacgctgatatcagcgcccgacttacgtgcaaaactactttaaaatgattttttcttaaattacttatccaaatcatgatccgattgcaccattaaattcgttgtaattaaatcttcaaaataagaccatacatagatatattctgatgaaatttttttagcttattattgaattttttttaaatgttgcacgatgttccatcagatatatcggaattgtttcactaagtagatcgaaaatgtttcactcgtttaaatcgggtattatttcaccttatataaaaacaatgtttcagcaaatagcgaaagaatatttcagttcactacgacatttgatctatacacactaaaacattataagaatagtaggtgaaacattttttcggtggaacaaaaaataaaacaaattcccttaataggggtttctaaaatatgtgggttttttttgttgcaatggagtatttcagttcactgcaacattagatctatacatagtgaaacatagtgagtacactaggtaaaacattttttgtagaaaaaaataaaataaattctcttaacagggggttttcaaaaaatatgagttttttttttcaatgacgggtggtagcatagaacgctggtggggccagagcatgcatgcacgggggaggggcgtggggggagcgcacgatccggctcccccgcgtcgggcgaccggatcacatcattatcgcaaagctttaggcgctgcgatcgtggttgtcaacttgtcataaaaagttaccaacagcttgtaatggttgcttattagcagaaattaacaaaggattaaaactttgcaacacaacataaatagtaagcgacatagtacgcgtactatttgtttgaagatactaaatgatagaacaaaattgtgtggcatatagattagtccggcaatatatagattacattatgttccaattgatgcta

SEQ ID NO: 1281 - DNA, 1501 bp, Oryza sativa
gcggcaccggaaaggcccaacacaggcagacaaagaatgccccttctctaagcaacgtccacaaattaaatttgaatttaaaacttgcttaggaaacggatcccgattacctcgctcattttgaaatttgagactagccgccggctggatcaccggagctttggtcaccagaatggtggtcgctggagaaaccacgccatgcaccttcaagggctcctttaatctatcaaaaacactcttcaaaggaatatcactgtgaacagcttgagcgtaagaacgacccggttgtcccagagaaccagagatacgtttcttaggagccaccgaaatccattctttttcttgatcacgggtccaagcatcaaattcccattgccaattaggtccaccatttctccaaaggaagaagcgtagaacaaaatcatcacaagagaaagacctcaaacgataaatccataaacccactggcttggagcagaccaagaaagaataagaacgatctttaagaagggtaacagagagatccacaggagaaccaccaatcacagccctgagggctagagcaacagaagacgttgtcaaacgaaaatttgaacggggaatatccaccgctaaccggaaaggaggcgagctgaacttagcagagaaataaaccggcgatcgaaaacgatgccaagcttcatccctaattgcatcaccgggagagaaattccaccctcccagcggtgccggagtcaccatggaggatcactggaaatcgcccatcagagcacctccgtgaaaaccggatcgactagcttactcgtagcctcaactgctggtttatatgatactcctatctgatagatcatctgaggcgtttcaattgggggagtgcagatgagtattggcatcctcgttaggcttgccacagaacgggctagcatgcgccatcgtgatgagcctagacttcaagtcgaaatccacgtcccctatgttgacctacggcccaatggccacattgtcagcagagggagcagcgaactcacggagagtcttgttagccatagtcttgaaggttggtggcgctggtacggctggtttctctgtcggtagagttttctgcggagcagcgacttgcggcctgacgctccggaagaaagcttctggattttctttgaagttttccggcaagttgataccagtcatgcactaccctattttcacaacaaaagtgaaaacaaccaaggttagcctgcaaaggaaaatgattatacagaggcaaatataaaatattagttcaagtagtctctattatgaatcttccccggcaacggcgccataaatgcttattggtattcccagcaatggcgcagaaatacttctggtatattttggttacagagttcatccgcaagcgcacggatataccattgtagcatttcacccaagagtatttcaagggtatcgtatttattttatcctgtgggaagataatgtagagagaacttgactaataatt

SEQ ID NO: 1282 - DNA, 1501 bp, Oryza sativa
aggcttggcgaaaatgagatgctgcatacgatgaaaatgaatttctccaatataatacatatggaatcccctgggaatgaaagtgtcaaaaacacaaattccaaaatcacaaataagattctgaagtaataggagagtaggaattgttgttgaaagaaaaaagctcagtaaaactgcaaaaaaaatttgtaaatgttagcaatcatcttgccgaaaaatgaatagcaattgctcatcttacaagcatataatgatataaacattccaacaatagaacaacacctatgctagacaaaataaactaaacaaatgcagtttgagtatagtaattgtttatggaaactaagctcatgctacacatcagagcaattttttttttaaaaaaaagtatgaggaatcatttggatatttacaagtatatatgcatcccaacaagcagattcacaactgtggcaaaaagacatatggaacaatccacaacctgttcacaaatttttttaaaaaaaactaattgaaaatatcacaaaacaaactacctttaactgaagagattgagcaagcttttccccagcaggaacttccaaataaacctgtataaaagcttagacagtaagataaatagatagaaggaagacgaccatggaaaaattggaaaagaaaaccgtttatgaaacaaaacagaaaaacaaggagcataaggttttaaaaaataaaatgttagtagctacaagtcagacaaatataagtggaatatgtaaatcaagttatgggcattaaaaaaacaaaatattggaatatcagttttaagaaccaagttggagctgttgtgttgcgtttgtgttgtgattacatgtttaagctgttgacggaatacgattgttaaattaattgtggagtgtttgaggaatcaaactgaggttagataaatcctactccctccaggttgataatacttgtcgttttggacaaggctattgtcaaactttaaaaactttgactataaataacatctaaaatatttgtcttagaagtatggtgaccatatatatagactgatcttaaaaagtacttcaataaaatcatatatttattgatatttctatatatatatatatatagtaataaaaaatagtggtcaaagttgtttttaaagaccgtgcccttgtccaaagcgacaagtattatcagtccaaagagagtattatacaacttctgattcatccacatttgttcatttttttgcctcttaagtacgtgaccaagcattgcttttgcctcttaagcatgccagcaccagtattgacatgcatctcaacagttaatgcaaggtattagaggaaaagaacccataaaaagtgtttcgggaaatatgtgtgtcccacaaattcttatagaagccctaagaaaattgcccaacattttctacggagggagtataaatgtctgtcacataaataaaatcgaacagcacaatgaaacggaagcttatggtagtatcagt

SEQ ID NO: 1283 - DNA, 1501 bp, Oryza sativa
tggggtcggtcttttttttttctaacagacctattacccgtaagatgcaaggctaatatttatctcattagaagtttcaaaataatatatgaattttttatgtagcctccttatacaatatagaaatttgcatataagttccatttttcatttttattttttaaaagttatttttgtgcggtatatgaaattgtttacgcaaaagataatgtcacacaaatattttgtgtacaatataaaagatgatttacattaaaaacaacaactggaaaattctatttatatatatatatatatatagcatctaacaaataaattacattttaaaaaagaaatgcaaaaatcttttatacatatcaccctatgctaatgtttagcctaccaattcatgactaaacattagctctcaaaattagccatgggctaatcttttaaacatggccttattcatgtatgaaagatacacaaaacaattatttgttcatgaaaggaaatgaaaggaaaccatgatcattctagaatgattgaaagaaatccagaaggcatcaaatatgctcatacgctttaaaaagttgtaacaacatcaataaaaagaatgtagaataaatatgttttgacaaaattaatcgattggagctcatgtcctcgagctacatcacctggtgagtggcgactgcaacacaaaattatagtctgcttacgacaatgaagcatacgcaaagatatcctatctaaaccaacgtactgaaatttgtctcctttttataaaaaggattatcaaaatttacttctttaaagggaaaacatcaataaatcgtgacaacgaagtcgatgaaagaaaatcgtgaaagaaaaccacccaagcgtctctttcacacgcctgtgagatgaggtagccggaggcggcaagaaaaaaaaagaagcaaataaccaaaaagccgaggaaaagaacagaaacaaacaacacccaatcaagaaaaatgaaaatgaaaagaaagaagaaaaaacaaaagaattatctgcctgaaaaaagatttgaaaaaacccggagacgcgttggtttaatccatctccccccctccccttttctatccctctcctcgtgaatcctcgcctctccagccgtcccgtgctccgctccactggcgcccttctggaaccctcaccccctcctaaatccaaccaaatttccctcttctcttagcccaaatcacttccccttgttccaaatcccgcttcgatccagcagccgcggtcgggttcgtggcgaggttggagtgctcctgccgaattcgggcggttttgctgggggcaccgagagttgctgccatctgtggtgatctgatccggcggcgcgcggcgggagtggtggtggtctccgttggttctggaagtggtggtaagagctatgtggattgaggcgtcgccggattgagcatgaggggtggggttgctggtggtggtggtggtggtggcgcgccgccggtgtgcgtggcttgga

SEQ ID NO: 1284 - DNA, 1501 bp, Oryza sativa
tggacttgcaaaatggttttctttgtcaaatattttttcctaagcaaactttaccaaattccgtcttcattgatcaacctgaaaatccatttactaagcatacacttgttctgcatttctaggttttggattcccaaccccccacattccttaggtctacacaacacactccatttagctaacctatacttctttttgtgctcatcacattgccaaaaaaatctggatctgtaaaaatccagcttctttaaaattcctttagggatttcaaagaaaaaaaacatctaccctataatgcaccaactcatcttactcatactcattcatcattggacaaatccaacggccaaaatcatatgctctgcaaccaacgatctagatcacccacctctccggctctccctcgcgcgcagattggcctcccctccccctctctctttctcccgtaacttcttccctttattctctctttctcccgtaactcccgtcacgcgcctcaatctcgccgccgatctccacgccccgcgccgcccctcaatttgctccgcagcgccaccgattcctatcgccctcctcccctcgcgattccctacccgccgccctccatccccggcctcgcgccgccgcctccctcgccgccaatccccatcgaccgtcacccgcacgtcttccgcggccacgccaccgtcgatccccgtcgagcacgaccacgcctcacgccgatcctccatcgcgcgccgccaccgatcccctccctcgcgacgccgcctccctcgtcgccgatcccatcgaccgtcgcccgcacgtcttccgcggccacgccaccgccgatccccatcgaccacgaccacgccgcccgccgatccgtgagtgcctccttcagttcctcctcttctgccaggtcttcgttgtacaaaaattgatggagagtatatatttgattgaactgccaggtcttcagtttctcttttttcttgttcgagtcaatcgggcggatgaaaaatgaattcagaaaaacaaaacttggcatgggttaatatatctttcttctgaatatctagaaaaaggaatgtgtaaaatatcagtgaccctagaagaaaaatgaatttgtcatttacaagtatcagtgaccctagaagaaaaatggatttgtcatttacaagtaaaagaaatgtgtacaatatcactgacccttgaagtcagctcagatgtgatacatcttttagtgttgatcttaaattgctgggtacaatccaaagtcagatatgatgtgttgtttgttcatggaataatttcatagatgaattcataatgtcgagggcaatgcagcttaatgtagaatctgtgttcatgtggatttaatattctgaaatctgcttgtgatttttcttgatttatttctgatctaccaaactgagttcatattttgatttgtctatatcaaattttcttcctgttaatcagaataagaggtcaagaggcaaactaatcagtgaaattc

SEQ ID NO: 1285 - DNA, 1501 bp, Oryza sativa
tatgttccgtgcaaaaagtttttgtataaaagttacttaaaaaatcaaataaatacattctttaagtttattatagttaatactcaattaatcatacgccaacaacttgtctcgttttatacatcggtgataatctttaggggttatttggatgggactaaaaattgttagtccctgtcacatcgaatgtttggacactaattagaagtattaaacgtagattactgataaaacccattccataaccttgaactaattcgcgagacgaatctattgagcataattaatccatgattagcctatgtgatgctacaataaatatgtgttaattatagattaattaggcttaaaaaatcaaataaatacattctttaagtttattatagttaatactcaattaatcatatgccaacaacttgtctcgttttatacatcggtgataatctttaggagctatttggatgggactaaaaattgttagtccctgtcacatcgaatgtttggacactaattagaagtattaagcttagactattgataaaacccattccataaccttgaacgaattcgcgagacgaatctattgagcatcatttatccatgattagcctatgtgatgctacaataaatatgtgctaattatggattaattaggcttaaaaaaattgtcacatgaattagctctcatttatgtccaaacatccgatgtgacagggactaaagtttagtcctggatccaaacactcccttagcctacaacacattcaaatgaactaatgaaacatttttttcttacaaaaatcatctcaacctaacaaggctgaagatttttaggactaatatgcccctttcctcttcttctactactctacttgcctccacaatctatactatttataaagttacaacccactaattctaaagcttaacgtgcaaacatatcatctcatctactagcaatagttacatacaaaactcatccaagcatacaacaccatttacaattcattgaattatacaaatcaatatataatcatctaccttcatttttatgatacttactccctcaatcccagaatataagaagttttattgttggacacggttattaagaaagtaggtagaagtaaatggtggagggttgagattggataagtagcggaggtaggtgagaaaagtgaatggtggagggttgtgattggttgggaagagaatgttggtggagaagttgttatattttgggacaaatccgaagggctaagagttgttatattttgggacagagggagtgtcacgctcagaaattcccgaatagaattccaagcagaatgtgcattaaaatccccatccaggacaggccggggtacacaaacgacaaagttgatatacagatccacgtcttacaaacattataaaagtcttacataaatgcagcggaaaaacaaaagataactggagctaagccttgacttgatctgcagcgggaacaccactccacagg

SEQ ID NO: 1286 - DNA, 1501 bp, Oryza sativa
ctgagttaacgcatatgtatagaaatattaaaaagcatattagttcctataccagtttaaggtagctatattggtaaaaacaaggtgcaaaaagaataattaatatttgagggatcagagaatcaagagaataactacataattaattagttgaaaatagctcaaattggagcggtacatgtgcagctaaaataacccatgcatggaatacctacaagcatgtgcaaacaggtacatataaagggtgcattttgtagacaatttctgctgaatgaaagccccactgatggcaaccagatgcaagattgcctgagttgaccatattaataattctaagcccagccccctccataccatcaatcaatttgtaggatatgaatagtgaatattgcacatgggttttcgaggacaacctcattttcttttgatacgagtcttatctttaatatacggagttctggttgtacactcaaaagtcgaattttatataaatatcaacatgtaacagtgatataaatttgtagtttccaatttccagtacattaacagagtggtcctcatttaactataacatcagcagcagcagtgataaactcacacatataaaacctatgaaatttcatcaccaattcagaattgcatggtaaacacgaatcccattatatacctgttctactccgtacaactaatttatatatatatacttgccctactccataccaaatttagtaattgcatgctcttagggcatataatttgtacctctatctgtccatgttcaaatgtcattactgaagatataaccaattgctaaaggggagctcttatggtataatagataatgttttttttgttttgaaatgaggcattcatgagctgcaaagaatgtgaagaaattggttcacaaaggcggcacgaaggtggtggtgcccaggcgcggttccaatccggtggtggtggatggtggcaccggcattgtcggcgaagactggaacccaggcctggcggcaggcttgttacctgcaagaagaatttcactgattagtttgcctcttgacctcttattctgattaacaggaagaaaatttgatatagacaaatcaaaatatgaactcagtttggtagatcagaaataaatcaagaaaaatcacaagcagatttcagaatattaaatccacatgaacacagattctacattaagctgcattgccctcgacattatgaattcatctatgaaattattccatgaacaaacaacacatcatatctgactttggattgtacccagcaatttaagatcaacactaaaagatgtatcacatctgagctgacttcaagggtcagtgatattgtacacatttcttttacttgtaaatgacaaatccatttttcttctagggtcactgatacttgtaaatgacaaattcatttttcttctagggtcactgatattttacacattcctttttctagatattcagaagaaagatatattaaccca

SEQ ID NO: 1287 - DNA, 1501 bp, Oryza sativa
cgaaaagaagaagatgcaccaatgcgcgtgctcggtgggagatcttgtcgtgagttgacctactcattggatggggaataacgaggatactccatttcattcttcaacagacttgattcaggccctcttggctgtttggttcataggactaatccattagtctctctattttagttccttttaatctttaagaatctaaacagagacgactaaaagggtcttaaaaagtacatataggactaaaatccattagtctctcttggaggtatttataggactaaagtgacagcttcactcttctctctccctcggtccacgtgactttactccccgtttagtcccttgatctaaacagtaaggactaaagtttttaggccatgaactaattttagtccagaaattaaatgatccaaacaggtctctcgttcccaagtattctactcccctcattggttaatgagggtttttaagcatagctgctggcagctctagctccgcctctaatgcacgctccatttctgcacccaagtgatccaccatgcccattacatcgccggaaagtaaagctaccggcgaaaagcctacattgtttgtgcgttccgttactagaggcttccctctcggtggtcaatattctcgagaatctatctctctctcagccgcggattacatcggagcagcctgcatatgtttaagcttaattcgtcagcgctcgtcgattggcggcagctacaaagtggaagaaaggagaagggatagaacggccagagccggccccaacgtaactcaccatcacgtattcacgtacacggccgagacgtcgccgtcgggcaatgtcacggaggaggtagccggcggcggagttgggtccacgtggcgcacacctggagcgctggcggtgcaacttgcacacgcaccggaggaggggtaaggtagtacctaatcctaaagctataataagcaggtcgcgtcgcgtgcatatatccgggccgtcctcctcgctccttgccaaattccatggcgtaatcatgcccttttttctcttgcgtttgtggtggtgactctgcacgtacgccatgggggggccgggcctgcaggacttccctataaaatgcacacacacgcaagttgttgctcggggcatcatcgatcgtacaatatcctgtcccggtccggccggcttagctgctgcaaattcagcaattgcttggcacatcgagttgattgatcgaggtatagtagtagtagcatgaagtagtgctctgctctctctgtctcgatcgatcggatcatgatcctttttttcctttctgtccgtgtccctttctttttctttctttcggtctcgaaatggggtgcgatcgatgatgagctaggtgaatatctttgtgtacgtatataattcaatgtcatgcttgttgatgcctacaggtcgatcgaggctagctaagctgcgtccaatggcgttctcacgggctacggcggcggccgtcgtcgctct

SEQ ID NO: 1288 - DNA, 1501 bp, Oryza sativa
ggctccgcttcggcgacttcgaggcactccaccgcgcgctcggcgacgcgctcttcggccccgtcgaggaggaggagcccgggaagcaaggggaggacgacgacgagggcgacatgaaggaggcgttccgggtgttcgacgaggacggcgacggcttcatctccgccgccgagctgcaggccgtgctcaagaagctcggcctccccgaggcccggaacctcgccacggtgcaggagatgatctgcaacgtcgaccgcgactgcgacggccgcgtcgacttcggcgagttcaagtgcatgatgcaggggatcaccgtgtggggcgcttgacggcggcgagcgaggccgccgtccttcgtcctctccccgtgtgtcatgtatgtatccacgcattgcaacgtgtctctgctcggcaaatttttcttgatcgtcctgtggaatcctcctgttcttgacttgatctgcttaattgtagcattgagaattttctgtgaccaccatgaaatgcgacattatagaaaaaaaatggcatgcgaagatttcattggtatttactccggtacttaaacattggttttgttaattattcctatccacatatatctaagaggaaagttgaccagcttcaccacaagtttttctttcttcaatttcgtggtgctttcgtgcacatgcctaggcctatcatttccctttgtgcgttgacgtattcagccgtcatttgaataagcgtttgcttgaagaaatggcagagaaagaagaaatgggcttgacatgattttctattgaaaatattgtggacaggtttaaaacatagaaatttcgtagaaaaccgttcaatattctaaccaaggggaaaatcattagcactaaacagggttatagagaacatgggaagtttgttctatgatcctactacaggaatataatatctatggaggcctttggaacaaaggattagacattacagattactttaaagttattatctaacagactaatccatagtaattttggaaaaaaaaaatccatgaggtcaacttcatgttttcatcccctttcttgaaaatcaacatcccccccctccccctattacatccaaacctctcttttaaagtactcgtgtttttccatcagaatttgagaaggcatttctccttgttttcctcctttctattttgagttcccttcattccaaaagcttaattgtttgaaatctaatagataactcttttaaatccaaggaggcatagagttctcacatggaccattatcttcttgttctttcattagtacagtagtgtacgtttaagcacatgaagattgctaggccaacctaacgtctgcttatgaatacctaccacatgttaataggaacttgcatcagcatgtttgcatgctctacactttatatgattacgcattgctttcttattatacatgtttggctttaaaccaagtttttatatgccttcaagtaatgtactccattgatttgcaga

SEQ ID NO: 1289 - DNA, 1501 bp, Oryza sativa
aaactatggatccaatttttaaaggttccaaggaaataaagaaagatatgacagaagtaagggatatcaattgatgtgacttttaaaaattataaaattagaaacacgaggatgataaggtttggtctttcaaagtcttaagacaacgaggtaactatttaataaattttaagtaaaatattatatttaaaaaatataattttgtattgatgctagccgcgcaattgcgcgggccacccagctagttatattattaaaacagctttgaaaggagatatcacgttcgctgtggaggctaacaattcaaaaatagctgaaattcggaattaaaaataagcaatattaaaagaagagtccatataaaaacccaatacgagattaatcaaaatttggaataaaaataaaataaaattcgaaattagaaaataaaaggagagtccaagtaggaatataatttaaaaataactgaaattcggaattgaaaataaggaatattgagagaagagtccatataaaaatccaatacgagattagttaatattcggaataaaaaaataaaaataaaatctgaaattagcaaaaagaaaaagaagagttcaagtaggaatacaatttaaaattaactgaaattcagaattaaaaataagtaatatttaaagaagaatcatataagagcccgatacgagattaaataaatttcagaataaaaaaataaaataatatccaaaattagaaaaaaaataaaagagagttaagtaggaatacaattttgaaacaactgaaattgaaaaataaaaatattaaaagaacactatacggtattaattaaaatttgaaaaaaaataaattatgaaactagaaaaagaaaaaaaagattcaattaggaatacaatttataaataactaaaattggtgatagaaaataaagactatttaaagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagttatgttcgatttttagaatcccaatgacaataaagagtaggcggcggatgagccgtagaggagtatagtggcctcgtttgacgggacttctaaaaattataaagaatgaaacccaacaaaacaataaactccaaaaactacatggtccaatttttaaaggttcggaaattctaaaatgtaaaaaaaaaccccaataataatcatgttcgattttaaaatctca

SEQ ID NO: 1290 - DNA, 1501 bp, Oryza sativa
aacaatagagtcatcaaaatcgatagatcaaaatcggctggtgaaaccgatttcgagatcaattcgctttcgtggaatcacacgactaatttataagcaaattagtaaagaagattctatcgtacttacgtgacgacgaacgactagtttccgagcaaactagcaaaggataaccttctcgctttcgtggaaaagcacgaccgtttttcagcgcaaaacggcaaagattaaccaaattctagggttaagcaaaatagaaaataacagaaaagtaaagaacaagaaaaataaaaataatagtagattgattatttgttcggggttccacaaattgacgcaatgccctaatatatataggagcaactaaacgctaggtgcgataagcacggcaactccacgtaccgtatagcttaaccgaatacgattccatctaaacaaatctaactattaaaaggaaatatatcgctacctttcctctgatacgcatataaccagcggcttggctccatctcctctctgaagacgtaaatcgcgccggacgtatacgtacgcaacacatgcgtagcccctgtagtttcccggccatggaaccttcttcgagccgtactcctgacttgatgaagtaataggaaaaacagcccagcgccatgcatcaatcaagcagataacagaccagcaacccaaagcaaagcacttaatctccatcacacgaaatccccgtggtgcatttcatctactcatctactccctctgcatatgattaatatatatgtttaactagccctcaagccaaccaattaaacatatataacagctgctccaatgaatttggcctgctcaaatgaaactgactattattagccaaattatggtataaagaggcatatgtatcctccagtcccccgtcagcgagcaacggatgaaacaaaaacgacatatgctgatgctccatcagtcgtgcaacggaagtggttggtcgacccattggctgccattggttatggcctatgtccctatttttactcttgcgccttgattgtcttcctgcgagtaatgcaatatgactagctgttcttttctgattaagattcagattttatctcggttttcattagcacgtatttcaaagtatggtactttccgtacgaaaatttttatataaaaattgtttaaaatatcaaacatatctatttgtcaactttgtaataattacaacttaattaatcatgtgcttataattttcaagttttatgtgtgtcagcttaatatttatcttaataagttacaaacaccactgtaggacttgactcggtttagaccctgtctctttcagcttaagattattataatctagattattgagtcagattactgtaaactagattgttataatctgtagtagaataagcggttagttgtttctttcctagattattagagcctagattattgggtttgcaagtctaaagagggagtggggtagcatggtgggtaatttttc

SEQ ID NO: 1291 - DNA, 963 bp, Oryza sativa
gcgaattcgagctcggtacccaaaaaatgaacaacaagaaaaacatcaaggtggttggaaagcagtgtgacacgaggtcttgcaaaattagagaagccaccatgtttggctgccttgcataaatttttgaaaatacgttgattacgctccaaccaaatgttccaccaggaggtgatcaggcaccctggagttctttttcgctgggtttttggtcgaaaggttgagagcaaactccaccaacttttctaaatctaaggtgttaggcaaagtgttttgacctaaaccctttcaagcgcaaattttgttccccacgttgatggtgaaaaagcattctttgaaaagatgagcaatgttttcgaaagcctccctacaaagagggaaaatccaatcacaaggccagtggcgttgaaggagattttgtgcggttagagttttttggtgcaagatgagccagccaataaaacgatgtttcagttcagtaggagctgactagatcctcgtaaaatcgatggtggtgaagatgccttgaaattgcaacatgtatgcactttttgagatgtaatttccgttaggcgagaatttacaaaggatatcatctggcaaacttggatggagatgcacgttctgaatgagggcgcctaaagaaatcaattcatggatcccctctattgtagtgagctgccgaaaggaacatcttttacatttgtgcataggggatttggaaggaggagaaaaaggacaatatgccactccattcgttgggtttagacaaaatgcacccactaaaatgcaaaggataaaataccacatgttaccttaagatattttgccactttgaaaaattttaagaccaaaatacccttgactgtggagagagaaaaagaaagggaaccgttctgctcgctagtgatggaggaggacggcgttgctgatgggagggaggggacggtggcgctgacaaga

SEQ ID NO: 1292 - DNA, 1501 bp, Oryza sativa
gagatcttgcccaactgtggcaatgacaaggcttcaaggctgacaagttgatcgagagatagattaaatagaactctttggccagaattctttcttagtagatagtgggatgatagaaagatgggtggatttttaacaatgaactgatgaagaaactttatcactgtacaaaaataatgtaattgacatgattgtgtaccaaattatgaaatatctaaagaactggcttttcaattaattaacttgaggtctacaataaccacatggtcttcagagccatgtctgtcacaaagctttaccgggccttgcgccacagcccacagcacataactatcagtttggacaaccatgtttacaattttacatataaacagttgaaaacccaataaatgagatccagatgtggaaaaacattcacaatatgaactagcagcagttcctgaatttcttagtgacaatggaattatagttacaaaacagaaatgtttccaccaatatatatttagctgcagttaataagttatagttgattctcactgagtaactttggccttaatagaattataaaaattcatttgtccaagttaatcaagttcaatacaaataggaaaagaaccattcaagataaataaccaggaagtggtaagaaatctgataggaactatttgctttcaagtaaagttccaaaaggagcaggtgataaaaacattggttgaataactactgatcatcaaggctgatagtcagcatatctttagtattaatgtgatatcatccatgagcaggtccattagactttgaacgaagaaagaaatgctgcaccgtcagacttcaaattccaattatcatcactaaatgttttgtaaactttcactatccttcattccatatagatctctaaggacaccatgttttttaagattaaagtggccattatgtgcctaacagagatattattgaattgaccatgaggaccatgacaataaagcaacgcatatctaaccaggatctttttgctaaatagtttaagcataccatgatagcaaattttcacgagaactccacagctgaaaaaaaatggcaattgaagatctcaaacataatcacaggagggctgcttttctttgagaaattaagactactgactttcatgatagttaaataatagctatctgacaaaataaaagaaaacaatgtatttatgaacattcttctacagaaatttgagatgattcagatttattttcgtttacttgttttgttttaaaattatctaaatagaaaagtattatataccattattctatagataatataataagcctatgctgaaattaagagctcagctaaacaccaaataatgaacttaggtgctgacaatttgaatgagtgaacatttacagttgaggttgatagacgaaactatgttcgataatatatataccaacaaaaaatctagtgcccaatggtgcagagtgaaaaatgaaatgaccgttcaaca

SEQ ID NO: 1293 - DNA, 1501 bp, Oryza sativa
aataaagttcagtacaacacataaacgttagctgatccggtcaggatttttcataccttagatcattaattattaatacgtgaaatttatccatgtagagttaacatcgatttttctctgcaattgtacttttactactcttttatattttataaatatatagatcaagaaagtaataataacaatgtgcattttgaggctttgtcaatgtctaaaacttagttttttttaagtacacggcgcatgattgggaatggatttttataacaacttccgggcataactgaactactgaagccttgatgaaggtggcggcgcgtgaatgttgacggtatacagtagaagtgacggcgttaattagaaatgtcgaagctggaagcaaaggttccaaatacagagatgtgaaccgattatgcaggtcaaatttcattcgaataaattttattactagctagccggaatgatataaatccatatacttcaaatttaattcatgagtagtttgtttcaaccaatcatgcaggccaaatttaaagtgttagtttaatttatactttttaatttcgataaaatttgttaaccacctgttgctgtcgatgattcttataacaaattaaacggtgttttggaaccaggtcaaagttaaagttcatggtcaatgagcaggtacacagcagaaaatatgatgttgtcttaaattaaaaattggtgggagacgatgaccatacccatgttaattgtcctcttagtgctaccataatgtgggaggaaagcctgtaagaaacaacaaatacaatacaatattcttttaccaggtcatacacgttgggtagctgataataacaggtactaggttaagtgtcgctgccggcaacaagcaaactttacaaaattataatggcatggttccaatttacccttaaaaaaacgaattagggtgttacatgtcattgagataccgatggcatatctcaaactttgcaaaattataatggcatggttccaatttacccttaaaaaaatgaattagggtgtttggcgatagctactttttttgtctgtttcaatcacagagagtgtttgcaatttcggtagtcaccaaaatttatgtggctgccaaaatttttaaaattcatgaattttgatattttctaaccgatttttttggggaaattttaacatattttgattaaatttgaatatattatcagtcaaatccacaaatattttaaaaaacaaaatcttcggggaagatatgtgcttaccggtggggtccaaaaattcaaaatttccaaaatttcgaaccaatgatcacagctcggtactactacctgatcataagtcccacgctattttcgactatcatgatatacgactccatccatcttaaaatataacaatctaaaactgaattaaacaaatcataatactactaatctaatctagagagctgtctgtccttataaatacgcttgtttgcatagctagcgatgcatgcatg

SEQ ID NO: 1294 - DNA, 1501 bp, Oryza sativa
tgttcatccatcgcaaatagaaccacccgactagatctaaacctaggtgatccaatagacaaccctaacaatggtatcagagccaccctagagtttagattggttggggaaagaaatccaaaagaaaggcaaagaaaagcaaacgatccaacggatcgaaaagatcgaatccctaaccctaatcttacctcgtcgccggccgtcgttgacgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccggaggcggttttgtttgcccgatccgcccgcgcgaccgtccgatcgaaaccctagcaatcggacggccgacggcggccggaccgaaatcggcccatgtgggagcgcacggcaagccactttcccggcccaggcccaggttgcggcctggcgaaaggggagggggcgcccgcccgcgcgcaaggcggccgtgggccgaccggcaaaggccgaaaaagttcattttaggtccctcggggccgaatcaaaagaaaggaagttcattctaagtccctgtttcagaagcatttacaattatagttgttaattgtgtttatttctaagcaatttgaaccaacgtgaaaattgtttagagaatagataaatgtgagaaatgcttctgaacatgtactttgtatattttcatgcaaattacaatagaattttgaattgtttttacatgttttacctctgtttaaatttgaaccaacgggagaattttacagagagtaaataacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctact

SEQ ID NO: 1295 - DNA, 1501 bp, Oryza sativa
attgaagggaaaatgcatctctaaaaccctcgaactattataaattgtctagtcaaacctatgaagtttgtttttattaagccagatctgttaggtgtattcattatggctaatgcgccagcctggccgctcggcagaatccgtttagattccccgccgggcccacaaccacagcttgggaagtcgtgaggcgccacgtcagactgtcctcaagaggccaatgtctgacgtggtgccgggggctactgtcggagatatgggctcgggggtatgtgaagtgaggggaatttaccttcccatcctgccgcgtggccctacagcttggccctacccccgcacctcgcggatcgcagaagcagccgggaggcctcgaggtgccacgtcatgcccctcgggccctcgcgccaccttgccccgaggccctcgcccaactgccatgtggcggggggagcgagcggggaggggacccaggctgaaccgctatcaatgcgcgaggcgccccaactgcccctcgccgcatttcatgcggcaggggcagacgtgcggtgccacccgactgacgcacggcagtcaggaatgaccggtctgtgaccggcctgtcaccggtcatgaccgattggacgggcggccgtgcccccacgtcgcctctgtatccggcggagtggaggtaggtatgacccatcccatcggagtgtcattcggagctccctccacgaaaggacgaccaccacaagtcttcacccatttatgagggaatgacaaggttgtcccccgtgtcaggcggggggcggcgctgggtcccgctcaaggacaagttacggcttagcttccgggcgaagggatagatcgtgatccggtcaaggtagggtgggttcccaccctgtagaagagtaggtagaggcggtgcatgtggtatccccttgagctataaaaggaggatcttgcccaccgagaaaggggacgactctcagcagacctgagctctaggagaagagaagcgggaacgctcaccgaaatttaggaaccctagtaactctcaaccttaatcccacacacaggagtagggtattacgctccatagcggcccgaacctgtataatcctctcacccacacgcgactagcaacactcagggaggatacgcgatctctagaggcgagccctttccctcgaccgaactcacaaaagggggatctcacgatctcccgctagagaggatcactcctcgacaatgccgccacaatctactccaaatttctcaagtatcaagtttgagatttaatctacatgtccaggagtttagagttatcaaccaatcagctcagttttgacgagttggacaacagcatatactttcctctaagtgaagcatctacaacagctatagcaccaagttctactgccatcttcataaattaagatgcgttgcatcaatcttcgtcacacacatgccaacattaagaaaatacttgagcatggatttcttctcaacagtttgatgg

SEQ ID NO: 1296 - DNA, 1501 bp, Oryza sativa
atgtcacctctggccacaagatcatccaacaacaagttcagctttgcaatctttgcggcgagacagtagagtagagtagagtacagtggtgtgttccagcacttacggacgaaggaggcgacggcggaggcgatggcgaggtagatgaactcgagggagaccatggacacccggttgacgacgtcgtggatgcccatcgcgccgccgaaggcgtcgatgaggttgccgaagagcaccgtcatgaacggcagcgcggcgccgttcgccaccgcgcccagcgtccccagcgccatcagcgccgcgtccgtcttgtccgcgaacgcgaacagcttgtggaacggcacccgcgccgacgccgacgccgacgccgcccgctctcccctcgccaccgcggcgccgccgccgccgccaccgcccttgccattccccgggctcgagtccgccgcggcgacggaggccgacgacgacgcgttcgcctccgcgtctctccaagactccggcatggcctcctactctcgctgctacctccactgaccaaccaaagattttcgcagcttttcttccttcctggcgccgccgctagattgggcacagcaacaaccgcagcgccgagctgctcttcttcaagaatcgattaatcccaccgagctcctgcataccagtacctcacctgccacaaaaccccaataattgctcccacattagccggattcatccacctcggcaactcaaaccaaagcaagaacaactaatcaagaaaccaaccatacacacacacgcacggtcagaactcagaacgaacagggagcaagcaagcaagcactacgaatctgaatctaagcaactgatcagtcacttgagagcaacaccttcctctaatccaatctacccaggaaagagagaaaaccacgagccgctgattttataggaggttggagttggaggggggattggggagagctgcaaaagagtactccagctagctaagttggagaaggaacaacaaccaaccgagcgcaaagttggcagctttcgcatttgccgccgcacaaagaagcagcagatgccactacgagcagcagtgggaaaagatagaagccggtgaaaaaaaaagggaacaaataaaaaaacaaatttaaaaaaaagatccagggagagtgggagcaaacaaagaaggaactcggcaactactactgctactgtgaccctgtactccactactacactacacaaaacaacaccaaagctgacgacgagctgtacaagaagatggctctcagctcaagctcgagctcaccatggcagaggcaggatcaatcagtttccattgggtggtgctctccagcaggcagcgtgcgtgcccagcggtggttgccctgcgaattatgatgatggcaggcagggactgtggttccttccgggtatatatagataactgggatttttgggggagtttcaggggccccgggcctcactgtcatcaagcaaagcgcacatttct

SEQ ID NO: 1297 - DNA, 1501 bp, Oryza sativa
tctctcagtaatttaaaatagttgaaatttggtaactatataagaaatcctgccaaaatttgataactatataagaaatcatgccaaaattttggtacagttgtcaaaatttcgacaatgccaaaatttggtaatgttttttttggcatcaaagtaaacatgtcactaattaaaaatcaaaaactgagttttctcagtttcctcatattcttactggtcgcttctcgaaatctaaaattcttaaaaaatgggcgccgccttaattgtactactaccatgtttgaactgttgtaattcggatgtaacaaaacggcatcgtactagcatgtgttaatctaaagttaatctcggatgggtcgttttcaatcagcagggcagatactgttctcatctcgcagttttctttttctgtaactgtgtactactagtacgagtacccaacgtatacgtacgttttaacagatgatttttttgggagtttctcctgtggattatacagtatagaaatgtgcgctttgcttgatgacagtgaggcccggggcccctgaaactcccccaaaaatcccagttatctatatatacccggaaggaaccacagtccctgcctgccatcatcataattcgcagggcaaccaccgctgggcacgcacgctgcctgctggagagcaccacccaatggaaactgattgatcctgcctctgccatggtgagctcgagcttgagctgagagccatcttcttgtacagctcgtcgtcagctttggtgttgttttgtgtagtgtagtagtggagtacagggtcacagtagcagtagtagttgccgagttccttctttgtttgctcccactctccctggatcttttttttaaatttgtttttttatttgttccctttttttttcaccggcttctatcttttcccactgctgctcgtagtggcatctgctgcttctttgtgcggcggcaaatgcgaaagctgccaactttgcgctcggttggttgttgttccttctccaacttagctagctggagtactcttttgcagctctccccaatcccccctccaactccaacctcctataaaatcagcggctcgtggttttctctctttcctgggtagattggattagaggaaggtgttgctctcaagtgactgatcagttgcttagattcagattcgtagtgcttgcttgcttgctccctgttcgttctgagttctgaccgtgcgtgtgtgtgtatggttggtttcttgattagttgttcttgctttggtttgagttgccgaggtggatgaatccggctaatgtgggagcaattattggggttttgtggcaggtgaggtactggtatgcaggagctcggtgggattaatcgattcttgaagaagagcagctcggcgctgcggttgttgctgtgcccaatctagcggcggcgccaggaaggaagaaaagctgcgaaaatctttggttggtcagtggaggtagcagcgagagtaggaggcca

SEQ ID NO: 1298 - DNA, 1501 bp, Oryza sativa
taatttttggagaagctcctgctgctgagcatgagctacaagtctacaaggatgcacatgcacgttgttcgttgcatacacgatttccatggtggagggagtggatgatctgggccgtgcagtgcatcgggtgcgtggtggcctgtaaccggcgggcgggtccacgtcggcgttggttggttggaatcctgtggttggtttggctgcctgccgtttcttctcgcctcgccaactttcccttgtccactttggttccttcttcttccattccattgtgttgatgagttgagttggctcatctcatcgtcgccgtccttgaattgccgcctcccatcccacgaattccgcccctcccaccctcctgagatctctctctctcccccacctccgtatttaggtaggcggcgggcgcatcacgttctattgccccctcctgcccgccgccgccgccgcacagccggcgatcgagcggaattcccattcctttccgcccggtttccggcgctgccgcccccctcttaccatcccgggggggcccagaggccaggagctgtcgccggaggtgagattaaatcatcaatcttcattctttatgctcttctttccttcttctgcgccccgcccgcaaaagaaaagatctttcctttctcccttttcttttctggaggcaaaaataaaattaacttaagctcaccctgtgggtagtagtagtaggtagatggtttgtttggatttggaattggaatttcatatgggccctttgctctttatgttcaatattatttttctataataatagattgtatttttttaatgttgggaattgaatctggagctgcctaccttctgcagccgtaagcataattagtgttcaacttgtttgcactcttacatcattgtattacctggcatctcttaggaggagtaatagtaagtaatttattcccataaatagatgcaggcaggtgtcttcacttaacatcaaagaaatttagagttttcatccagctgttctctcttcattctacaggatgccatttcttagagcacttgagtttcacttgcaaattgaggaaaacgccttgtctcttgttttgctagtagtattaaattagacgtcactgtttttagaagcagttgaaaagggttctgtttgatctttactttatcatcatgtcatgcacaagttatgcacataagacaacttcttcaaagacttctgaccctctgaatgcatgcactctaggatttcaatttttcggagccatttgatgctaatgccacaccaccactcctgctaaagctgccctcattatgaactcgctggacaatgagtagcaattgcacattgctgatttccatctcctgcggttacattcgtacacgacagcatgggaaaacttgcagctgttgttcgcaggtttgtatacttctctttttattttgaccccctacaccctcagcaccagaactaatatcatctccttgttcaactgacatg

SEQ ID NO: 1299 - DNA, 1501 bp, Oryza sativa
  unsure (1)..(1501): unsure at all n locations
taaaccttgtgatgtcagcttatatctcaaaacagaacttatgactctatcaaatttgtcaaacactcaactcaagagatgagctttcatcgaaaatatagtaccatatgcctcgatttcttacaatgtccaatgcgttatagtcgagacaggaaaataaaacaacttaccattcgacagctacagatgggttaatcaatttgtttcctggtaatttcgcaaataaccgccttatcttctagaaatgcaaagagtttgtcgcggggagaaaagggttggggggcctttcttcctgggttcagttcagtagacttgccgtttaagttcttcagacttgacnnnnnnnnnnnnnnnnnnnnngcagaagctttaataatgcttggagccagcaacagcaaagaaagggaaatccatccattaaaaatgacattgcaaccaaccaaaaccaacaatggactacttccatccagaccctctcaagattcttgtactccctccatttcaaaatgtttgacaccgttgactttttaggacatgtttgaccgttcatcttattaaaaaattttgtgaaatatgtaaaactgtatgtgtacatgaaagtatatttaacaatggatcaaatgatataaaaagaataaataattacttaaattttttgaataggacgaatggtcaaacacgtgctaaaaagtcaatggtgtcaaacattttgaaacggagagagtactgcatcattttcaggagttgtattgtaattctgacaattagaggatagttgtagatttattataataaggttgattagttctctgtagaatataccatttgcagaaatggtctcgaacgactgcaggagccaataggaacttaacaaagaaaattaagaatgaaaataagattcttttttttttgagagagaagttgctagtacaacaatctgcagatttgagaaaaaggaagaaaagttttggatgggtttgcaaaatgcagagagagaagaaggaggaggaggaggaagagtttgtggcgaggaggcttccaaatcagtcgctatcatacatctccctcccttaaatctcatcaacccccccaaaatttgttactttcggagtatatttatttactagcgcgacagtgccaatttcgcggcatctactgcttctgctgctgcatgctcctcctcgtcgccggcgatctatctcgccgccctgcctccgccgagatcgacatccaggtacttacttgaaccctcctcttccctttcccggctataaagattcgtttttttttctctcgatctcctcgcacccctctcaactcgcccaaattcgccggcgtttcgtggaggtggcggcctggttggggcaaactccctccgtttaatctttccaattccaattccaattcggtggatgcagcggcgatgatgctttgcggcggcgccttgattccgcgctcgacaatctactgtttttatagataagatcttcagtgagcgaga

SEQ ID NO: 1300 - DNA, 1501 bp, Oryza sativa
aataagagttcaactaggaatacaatttataaataacttaaattcgtaataaaaaaataaagactattgaaagaggagacaatgtagaacacatgaagagattaattaaaattccgaataaaaataaaagaaattccgaaaatagaaaaataattataagatttcacgtaggaatatgatttataaaaaaatattggaatgaaaagtatgaaattttcaaacaaaaatttcatctagaacacggatgacaaatgacaataaatattagagaagcaacatatctgtaaatgagtagagttgagatggttgatgggacatccaaaaactattaacaaaaccccaaatacaatcccaataatgattaaaaggagagatgacagatatgtcgttaagcaatacagtcacagtggttggcaagacttctaaaaagtaaaaagtaaacctcaataataattatgtttgattaaatctcaatgacattaaagatgggaggtagcgagcgagccgtagatgtgtccagtagcaaaaccgttgatggtttggtgggacttctagaaagtaaaaaatgaacccaaatgataattatgtttgatttttaaaatatcagtgaggaagcagccgagccgtacatgactatagtggcgcgtttgacgagacttctaaaaattataaaaatgaaacccaacgaggcaataaactctaaaaactataaggtccaatttttaaaggttcgggacttctaaaaagtaataaaaataaaccccaacgataatcatgttcgattttaaaatctgaatgacaataaagaggggaggcagcgggtgagctgtagaagagtacaggcagtgggcgagccgtagaagagtacagtggcaaagccgttaacggtttggcgagacttttagaaaataaaaaatgaaccctaacaataattatgttcaatttttaaaatcgcaatgacaataaagagaggaggcagcaggtgggctatagaggagtatagtggcagcatttgacgagacttctaaaaattataaaaataaaacccatcgagacaataaactataaaaactataaggtccattttaaaaggtttgatacttctaaaaattaaaaataaataaaccccaatgttaatcatgttcgattttaaaatctcattgataataaagagaggaggtagcgggtgagccgcagaagagtacaatggcaagccactctgtttggcgggacttctagaaagtaaaaaatgatcccaaataataattatgtttgattattaaaatcccaatgacaaaaaagagatgggacaacggacggatcgtagaggagtatagtggcagcgtttgatgggacttctaaaaattataaaatcgaaacccaataagacaataaactctagaaatcataagatccaattttcaaaggttccaagcagaatgaatagaaacaatggtagattgagccaacaaaaaaataatggatgacttttaaaaactat

SEQ ID NO: 1301 - DNA, 1501 bp, Oryza sativa
cttatgcttaagtgatcaaagcaatatatatagtcatcgccacaaagttttaagtattcaacaaaggcttcagggttaaacgtgcaaatccaatgttaaaaagctccaaatgggataagcttctcggttcaaatatctgtaggtcatgaatccataagtgtagtagttcaggacaggatatagggatataccggagcaaattaaagggctacttaataaagtagtcctctagtattagtttctcaagcttggcagggatgtacccgcacgaccggtggcttttgttgtctgttactcttaatgcacaaattgatgcacgctgctgccacttttagatggtataacatagaagacaatgtggagtccaacgtgaaaaacacatttcaaatctatatgatacaatcactctggacaaatcaaaattgtctaggctttgacacagtcaaggtgaagcatatacttcatttttttagtggatactgattattggcattgaattatggtgttttaaaattctataattcctacacaacccctactaaactatcacaataagcataaacatcaaaccaaaaatagaccccgcccacaacagaaagacatcaactgcctggatggaaccgtacatctgatgcagctaattaaagccaaccaaagagtaggtgacccgctaagctcagccccaaacatttagtgcaacagccaacatgggacctagctatacaatcagccccaaaatgttataattaatggcttactgccaaacttagttgtcagctgcagttgcaaagcattgtttgcgctccacttccagaaagctatctctaacctcgtttgattttgtgcttggatctaactgtacttgctactagaaatttggagctcacctggagcacgaggagcgagaaggaggagatgtcgtcggtgtaatcaacggcagggatgaggcgcttgagctccatggtgggcgcgaagtcgccgtagtcatcgacggaggcgtcgggcgcgtcggcctcgacgaagagcaccccttccccgttgcagtcgatctcgaccctcccgtcctcgtcgcgcgcgagccgcccggccatcgggtagaacggcacgagcgcctccgccagcgcgcgccgcatccgctccccgtcgaagaacccctccggcgcgccccctccctcggggccccggcggtagaagtagacgcttggggtgtggaaccgcggcaccacgaggtcgaggttcgagttccacagccgcacccgcggcgtctcccacgccggccgcaccatcgtcgaccgcctcaccgtgatcgccatcttcccctgccaccgccgccgccgccgcccacgcataccaccaaacacctcgtgagcatcccaatcccctcacacacgaaaacaaaaaaaaaacaaaaaacaaaaacgccaagcaccactcaccagaccaacctagaacgaatcagatctgaggcggatgaagaccaaagcgaggcgcggaacaaagc

SEQ ID NO: 1302 - DNA, 1501 bp, Oryza sativa
  unsure (1)..(1501): unsure at all n locations
taggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcggcccccacccgtcgccttctccaacgaacgacgccacacggggtggaagaaaacccgaaaaataggaggaaaccgacgggggaaagccgcaaaaaaaaaaaagtagagagaaaaccagagtgagctgcgcagctcatgacacatgatggtgagctacgcctacgcgagctcggagctcagctctaaccccccggggcccccccccccccccccgggccccaaaccggggggcccccccgcgacgnccgtagnctataaaagccgctccacccccaacgagcccaccagctgctctccaccaagagctgctccgcccccctaccccgcaacccgttgctttgttccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggc

SEQ ID NO: 1303 - DNA, 1501 bp, Oryza sativa
aaaaaaaaaaaaaaagatctcgggtggccggttttgtatagttaaggcaccccgtatatttggttttgtggttcgaggatgcttttgtatcccgatgacaagttgagggacctttggtgtacttttttcccttactaatccatcatgagatgatgggccgacgcagcctctcgccgcggtggctccggcccagcccgcctgaaccctagaggggagcagctcagctcgcgtccgtcttataagtcgccgccccgcgaggccgctagggttttctcctcagccgtcgtctccctcctcgcttcgcgtccgccgccgccgtcccggagaggtaaggtaagcgtcccccgccgcaactaccaccacctccgcccccgccgtcctcgtgctcgtgttcgtcttagtcaagcgcatttctgtgctctgtagccgcgcgggatggagctcgcgtctctcccttaatctgagggcgaggctggatccgctacttgcgcgcgcttttcgtcgatttcttgtagtggatttcaggtcgttgctcatccagtagttggtgcttttcttctggagattcaatttaggatggcgtgttacacagtctagtacggtgaatctttagaactgtgggtgatgtttagggatgctggcgatattagtgtgctcgttatggttgatttgaacttgatgtagttgtttgttgactattaaggtggttttttttttgtgtgagttctgaatctgttgtcttggttagcttttggtggttgattggtttcacatcagaaattaccctgtttggattataatacaggatacattttgattaccacataggatgtatcgttgctgttagcctgttactagtactcttatacttactgaaatggtagggccgaacttttgcctgattgcttatttagatttacttggctaatgtgaaatgtgtgagcaagataccttttcctcctgaagtgtataacgactctactgtgaagcagttctatgcttagttaggtggctttctctttctatattagtaatgtattatgaaatagctgaattcgcaatggtgtattgtttagtttttctgtttcatacttctgatatcactgttctctttgtgtgcagttcaagaggcagccctgtgaagctccaatggctcctaaaggtacacagatgatattgctggatcatgtttacatgttcttttgatttcagaccatgtgcaaattgcttcatattggttgtttttaactatttctagttttgtacatcatattattatgtagtctcgcttgcactatataaggtcttagtactgaataagttcttttatgcatatttgtttaaaataagtattgaattgctaagcattgatgaatatggtccattggaaatgagtgtattcctgtagtcgggttgtataattagtctatgaatccatttctgcctggcttttttaacctcagcttggtgcttaattaagatgcatgaactgattgtttta

SEQ ID NO: 1304 - DNA, 1501 bp, Oryza sativa
cctgtgttgtaatctgaatcgctatcgtacgacgactcgaatttgccaacgcctcctttcccgtactttttggtcgggttgatgggatcgataatcccgtggccgtacttgccgaggccggtgccctcctcgtagttcatctgagccatcaacctcgccactatctggttggtcgccaggctcccgggctgcggcggcaacgggggatagtaggaattgcagtaagcgggaggggaaaacaacgatgaacaatggtgatccatgtcgccggagctcgcgtgcacaaagtggatggtgggtacgtctttgcttgcagccgccgcagtttcctacataccactagtctcgttgttggagtcaggaggagtgcccagatccggcgtttccgatgcagtagtcccgccgtggggaagaccaccaccagcttggtttctcccctcgtcacaggccatgaaaacaaccatgttactccccttgtcaccggaggagaaggctttggaaacatgcgtgttgcaggtcatgaaacaaccatgttactcccctcgtcaccagaggaaaaggctttggaaacatgcgtgttgcttccctcgtcaccggaggaggaggctatagtcccctcgtcgtacgctatggaaacaaccgtattattctcctcctcaccggaggagaaggctttggaaacaagcgtgttgctccctcgtcaccaaaggagaccatagatatttacaaagctaactagaggatcgatgagattaatgatgggttctgtacgtcctcccccgtcgaggccggcccttttgtataagagggctggcgtgatcttctgttacgattcagcgagggaagtaagtcttttgttccgattcggcaacggaaacggatcgataatctacgatgagtaatcgatgtggtggacttgtgtaatatacgggagcttagcgtctttttggcaaaaacgttcaatccctatatgtccatctctcttctctcgcgctcccaacgacgccgccgcggcgccgccttctcttccaccccgccatggccgccgcctccgcctccttttccatgtccccgctggtgccgctcctctccatctgcaccactttggcacgcctccctccatgaccccagtgagatcaccgcgaaccctctccttccacgcgccggcgagccgccatctcctcctcgtcgtcgctggatggggccgaggatctcgatgacggggcgaggaacacggtgaccgcgtgcggagattggggagcagctctccggcagcgacgagctccgccgccggcgtcgcccctccccttaagcttggtggcggcacggcgacagaactcctcgagctggctgcagcggcagcgcaggttcggccaaccgatgcccccttctccttgtcgctggatgggggtgaggaggtcgatggtggcgcgcaggtgggtaggagctgggcggcagctacgagctccgacaacggcgaggcgctctcctcctcccttca

SEQ ID NO: 1305 - DNA, 1501 bp, Oryza sativa
cttcaaagttcaaatgctctgaagaatattgagagagcattttccctatatgatacttctcattgtcagatatctttagaactgattgaaaatcaatgagacccttcagaactgcatcaaatattttccttgttgtgtctctggaaaaaggataggatgtgatcactttagcaattccagaatatattagattcaaatttacaacacataaggttttagataactcacctgcccaaaatggtggcactccactcatcaaaacgttaagtaccactgtagctgaccacacatcagattttggtccataagtgcagtacctaagattctggtctataacatatctgtgcagtacctcgggagcaacataatatggactcccaatcaactcggtgaaacctgacctgcaaattgtaaaatggaaaatttaagataaaagttaaaaactaatttatatatccacaacacttcacacatgagctgacacatacagtgccagaactgtcaaggaagatggataaacaacagaatatagttaggatgctcttgattatgttggcgtgcaaatactatccacacatatacagcaaagcagacaaatactctctaaaattattctgtggagtacatattatgttgatctgttactctctaaaattaaaaataaaccactacacatgcattaaaatgtagcataagaacaccacctggtttgaagaacacggatgtctatcgccttaattgacagaccatcgtctttaatctctgcagcctacggatgtctatcgccttaattgacagaccatcgtctttaatctctgcagcctttcgctcgttataatgcccctcctcctgaatcttgtccaagagctcaccaacaatgaagagctccatcacaatgtgcaccgctcggccatcctcacatacatccttgattgcaacaatattgaagggaggaggagagcgcctcgccgttgtcggagctcgtagctgccgcccagctcctacccacctgcgcgccaccatcgacctcctcacccccatccagcgacaaggagaagggggcatcggttggccgaacctgcgctgccgctgcagccagctcgaggagttctgtcgccgtgccgccaccaagcttaaggggaggggcgacgccggcggcggagctcgtcgctgccggagagctgctccccaatctccgcacgcggtcaccgtgttcctcgccccgtcatcgagatcctcggccccatccagcgacgacgaggaggagatggcggctcgccggcgcgtggaaggagagggttcgcggtgatctcactggggtcatggagggaggcgtgccaaagtggtgcagatggagaggagcggcaccagcggggacatggaaaaggaggcggaggcggcggccatggcggggtggaagagaaggcggcgccgcggcggcgtcgttgggagcgcgagagaagagagatggacatatagggattgaacgtttttgccaaaa

SEQ ID NO: 1306 - DNA, 1501 bp, Oryza sativa
ctgaccttttgttttacatagataagcttatctacaccaacaaaccaaaattcccatcataaacaatagcaacacatagcaatacgccctacaaaccacaaaatctgtaaaggaaaaaaaaatcagaagtaccaacctacggagagggtttcagcgaagaaacttacaattcaacgaagaagctgtgtttggaacccccgatcccgagcgcgcccccgcgtgatccaattctgatcttacgaatccccccttagctccccccctcttcacgaatatcacgaaacaagactaccaaaaatcctctgagcctacggatttctcctctccaagaaaacggcggcggcggcggggagcgaggaggggggggagttcttatgcaagaaagcgtgcggtgcggctggggaagggaaaccctgatttggcccggtatttatagcggccgcttatcggattcgggtttttcagtgttcgtgaccgccaaggagaggggacgcgcccgacccgctgctcgcgtggaggctggaccggccggcgcgtcacccgtggcaggtgggcccacacgcgctggtgggattcgcggctcacagcgtccgtccgtctccccggtccccctcttcatcggccgggtcgcaaagcggatgccgatgaggtcgcaaaggcaaaaaaaaaaaaaaaaaaaacaaagcgcgagaggatttttttctttttgcaaagcgggggtagttttcggcgctgctttcacaggaacacggatgaaaagacaccggattaaaaaagttttgccaattctagctcaaaaaagaaaaagagagatgacacacaggagcttcagggaaaaaaaaaaaaaaagctcacggctgcgtttgcccaaaaccacacgaatttgtgtgggcgtgcatgagatcgctccatgtgttgaactgttgatcaccagaacatatatctgcagatcagatcgggttttcctgcatgggtggatcctcgtagctctcacaaaagaaaatgcgatccttttttttctcactcttttttaacttcggaccttaatttctttctccgaggccgtgtaatttaaaaacccaaagaatatggatgggggtggatagataatctgacgatatatatatctccggcgtttttcaaccgtatggcaatgatcatccttctggtccatgattcctttcaccacttgccctttgtcttgttcctccgcgcagctagctaggtgtagtagtacaattttatgcgtgttatgattattgtccttactccttcccttttttttctctgctaatggctgtgcatctccttgtcctctcctgtgtttatttcttccttctggaggccccagctgtttgcctttcctgcctgcggggacgttttacagtgcccccacttatacgtgtagtagtgtagtaagattatatctgaccgttaattgtcatgggcattttagtctttatgtttatttcggtggaaggatatttcggtaatttcgcgt

SEQ ID NO: 1307 - DNA, 1501 bp, Oryza sativa
gcgtaacatcgtgttgccccctcggcttaccccgatggcaacacaagctacgtggccaaggtaactacggggttcttgagcatgatggcttttccagcagttgctccagttcctgtcgggaaagagatggggaaaagggatgggtagatagatattaggtaaagggactcggtagagagagttggctgctaacatgtaagacccatgtgggtctcacgctgactcaaccagattgataatagtcaactcgtcacgttagttaaaactggatgttatactgtcatgtgacctcggttacaccgatcttgcaaattggttgaaggacacaatctaaactcatcgtcaataagagagacctaaagtgaacttattataatgaatattgactattgagttggcccagcagcccaccatgttcataagaataaggtccacgacaactgctgctcacctactctccacctctcccagtctcctgttcgttcctctctcccaagtctagggatgaaagtggttggaaatggtcggaaacggcatcattattttattattttttaaaaaacaagcagaaacggtcgaaaaattttcatattcatgaattcatctatttagtgtcaacttcaatgccacaccgttagaaattaaaaaaaactaaattttaaaaatgataaccatcgataaaaatattattattatattagttttgcggaaacggtatcggtacggtcagaaaatttccataccgttttcacccccagccaagtcccaacaacgttccgaggtcacagcgctcgtccgggcgtccatcgctgccaatttcaggcccgttgttttggcgcccgaatccccctcccgcatttttcccctttagaaaaccctgcgcgcgtggccttctcgattcctgcccgtccgatccgccctcacggcctcaccgcctcatctccgccgtcgattggccctaaccccaccgaccacccgcggccctcgtcttcctcctcgccacgccccctttcacaacggagccgggcgctgtccccccctccgcgctgcaccgcaaaccagccgccgcctcccgtcaaggccgtccttcgccgccgcagccgtgagggcatccctccccctccccgctgagcgagctacactggcctctttcccccctgccccgtgctggacggtgagtggcattcttcttcctcctttaaaagttttcttgggttgatgtgtatatctcgcttaggtctggggatttttgggtatgatacttcttgattttgttaggctactcatatagcatatggtagttcagatttggatgtgttttgcacatatgttgggttctgcacactggttaattctgtagtttagctattttcacatagaggttgcacacatgcatgctaataatttgctggcaaattcgcataattcaccgccgccaccgccgcgtccgtttcttcactctccgtctttccaagcagcatgacgagaggcaagaagggga

SEQ ID NO: 1308 - DNA, 1501 bp, Oryza sativa
agaagtagaaaagaacccatcgagtctatttatcgggaagagttcaacacctattaaataatacttccttagtcccacgacaagtgtacttttagggcctgttcactttgatgtcaaaaaaaaccttaccaaaatttggcattaccaaaattttggcaattatactaaaattttggcaactttaaatttttggcatgatttcttatatagttactaaaatttggcagcaaactaaatgtaactattttttttggcaacttttccaaaatttggtaagtttgaaaatggaatcaaagtgaacatgcccttaaagtggagtactatctattcttttaaccatcgcctattaaacattctactatcatctcagccacccttatttaattaaaacacctaaacgattttctttgtctgataattgtttgttatatcattttcgatgtatatctgtttatctgtactggtttgtctctgcttaaatatattttgtgcaactgaggataaaacagggtatgtatataatgttggaattaatgaatgggccttagcccactcgaagattaattctttggaaaatcacaaaagctcacctcataggatggcatgcatgtggagtttagtaccaccttacttattctaggagagggggacatccttaaaagggaggatgctctcatagccacttgaagcatgtgtggtggagagaagagggggaacacacgcgcgcgctcgcctcgcctgggcagggcaggcggcgcgcgtgcacgatgtacgcgtcgaatggtccgccaaaattggttctatgcagcctccttttgcagttttgttttgctgcaaattcggattcgtttttgttttggaaacgtttcaaaaaatccggtgcgtgcaaacggcgtggagtccggataagttacgcgcgacttattcagttcggttacgcgcagtggagatcgtgtgggcgccctgatcaagcgacccttctctatataaaccgacccgccgtcttcacgcaacacacgtgaaatcaatctagggtttgcctcttactctgtgctgcgctgtcgctcatagattactctatcccgctcgctggcgtgcacctgcgatcgggagagtaggactccggaacctctgccttcgacgtcctgcaccgggagaaggcggcaataaggtttttgggaagcgctttgcgcgactgctccctattcgttcgcgacagctcgtcttcctcttcgctcgcgtgctgcgtgccttcgtagacgcctgcgaaaagtttcgaccgagcagccggtctttccgccacctaggtacgtgttcaatatgttgcgcatatttgatctgttcatgttatactgtgtagtttacatgtgtagatttaatgatgcgttcatgctagttttcatctgtaatgtcatgatttatttatggaatagattaaatcattatatgcctataatctcaacaatccaaaaatcttattataggcactgtgattttacta

SEQ ID NO: 1309 - DNA, 1501 bp, Oryza sativa
cagtagaaccaatagacctatcagctctatgcctgcctttgctcggacactcctccgaaactccttttgttcttctctctttaaagtagtatcagcgccagaaacataaacatgtgtgatgtgttctgttccgtcgcaaaaaagtgaagctccaaagcctggggagccgatgactgacgtcgcgtcgtcgttggccgtctctcccacggaaaaacacacagaatcgctgtcgcgtcgatcgctttccggctggccctcgcagctcgcagctggcagctggcagctggcaaggaagagggcaagatgcagcagattaaccggccttttgctccgtttatgggctaagatactatgcgcatgactaactaatcaattacagtagttgcaagtacgcagttggcgacatcctttgcagttgttggctactactccagttatactcagcgtgttggcttgttgcagatctcggcctctagcgcggcgatcatcgtctccttccgtggccgcatacgctgaatcgatctgtcaatcaatcagccggcgtttggagggctcaaaagccgctcttttttcagatttgaacagccaaaatcgtcgtcgtcccagctgatcatccgagcaaccgatcggcccgaacgatgtcccgatcgcacacggtacacgcgcgtgtatatgtggtttgagaaggttggccggtcagaggcagaggaattaatagacgccaacttgcatgtatggccaatgatttggggaaggatattatcgtctaaatactacttcatccatcttataatataaacgattttgaagggatatgacacattctgaaactatgtatatatgtatatagacagaagtagtatagtgtactagtctgatcgatgatcatggcgaccgggccacgtacgagatgcaatccgaatttccgatcaatcaggctggcacatccacacatgacagcggatggtgagcgagcggcagttgggctggcgcgcggcgccggtcgacgtgtggccggcaaacgctgggaatgtgctactgctgggtacacgcatgccggggtgtaagtggctaacccgcgaaacccacttatagactaaaataagccgcaaatccgcttatgctgatttataagtgggttcgcggctgatccacttacactcttacgcatgcgaaggacatttgctgatgcggagcacacggatcaatcgcaatctctcctagtgtgtcggagcgtccccagcgtaagcccaaaaattcatacagaaattatattttcatagaactataatcggatttgtggtgtgaatatatttttatctccagctaaatatttgacatcccaataataaaagaaaggtccacccccaaccaataaaatcgttggcttccatcggttggcctaatcagctaaagaaaaagtcaaattttgaattttcaagcttaattttgagattgattttgagatattttcaacgttgttggtgatataggcccgggg

SEQ ID NO: 1310 - DNA, 1501 bp, Oryza sativa
aaaagtgaatggtggaggattgtgattggttgggaagagaatgttggtggagaagttgttatattttggaacaaatcctaagagctaaaacttattatattttgggacggagggagtagataataaaacaagtcacatcaaagtaaatagttattatattttttttaaaaaaaaataagactaatggtgaaatgtattgtgtaaaagtcagtgacattatatgtttttccaaaaaaaaatagcattatataatatttaacaacggagtttagtatctaaactcactatatatatcatgacaatggttatggttatggttttcattttaactacgtacgtcaagcgccgtggaaaagatcaaaattctctttacagaatatgctttccttaaacacgaaaggaagatcagaattttcataaacaatatgatgccgcgtgctcctctgtgataattgataaggacatttatccattagttaatcgtctagtacatctatgtgctccacatggaggaataattatattaacagtgtttcattagaacactctattattaccatggtgtccaggggtacaactcatgtgttgttacgtactcccttcattccaaattgatttatatatttcacaggcatactcccttcatttcaaattgatttatatatttcacaggcacactaagaccaagaaaagctaataactctctcatactatatttactctagcaacaaactcaatgcatgcaccatccccactatttcctagccaatagcaaatcaagatattgcatatgggttataaatacttgtgtgcaaggatgcatgcatcaatttctatttactctaatgcataaataacgaatagacttaatgaatgaacataaatatgtagattatttagaaataccataaaaaaaactatatatagattaatttggaatgaagggagtacctctttatgtaaaaactgttttagggtttgactataataaaagagatgttaacaatacaggtaaacggactcgatgagacactgacactcgcatggccttataataatcaatcatcgtcgcagatattatataggactccatcgcgcatcttaattatccgccgttaattaaggtacaataatttatggtccacatgataaggaaccacagttttttttttaagacaggaaccacagttatgtatattggccatacatatctggatgtgatatttcccaaaagaaaaaaaaatagctacttactccggttttataattctttacgtcttgaataaagtgagggcaaactttttctgactatcaataacttcaaaataattttatttaaaagaactataacaacatcaaacaacatatatagatctatatatgtcttttaagttactaaaataaaagtaaacaagtatttatttattatatatattataataaaaaataaaatcaaaaatatattttgaagtccgtgttattttctaaaatgttattatat

SEQ ID NO: 1311 - DNA, 1501 bp, Oryza sativa
gtacgtgatatataactttgtagtattacgaaatattaggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcggcccccacccgtcgccttctccaacgaacgacgccacacggggtggaagaaaacccgaaaaataggaggaaaccgacgggggaaagccgcaaaaaaaaaaaaagttgagagaaaaccagagtgagctgcgcagctcatgacacatgatggtgagctacgcctacgcgagctcggagctcagctctaccgcccccgcacgccgccgccgcccgtcgcctataaaagccgctccacccccaacgagcccaccagctgctctccaccaagagctgctccgcccccctaccccgcaacccgttgctttgtgccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggc

SEQ ID NO: 1312 - DNA, 1501 bp, Oryza sativa
ttatgcttattaaccaatccaaactcaaataagatgcgattttcttcaagtctcagcgatcaataaccttattctgggttaatatctatactatgctatattagtatctctgtctcactcgactctaacgttacttaaatactactcagcccaaaatataactacttcttatcctaaagtatactccatccaaaaaatacctttgtaccatttgagtacagtttctggctccatcaccaattagcctaccctcatttaacttttactcaatcctacatgaggctgtgctcggaagatgatgttgggaacaaatcttatgtacatgtaaaaaagagtacaactcattagcatatatttaattaagtattagtttaaaaacttaaaaaatatattataataatttttaaagcaacttttgtatagatttttttagagaaaaataatatcgtttaacagtttggaaaacatgagtatgaaaatcaagagaggaaaagttggaaacctacactactgaactcgaacctaaatgatctcccatttgataatgggcatggtagtttttccctttataatattgtcagtttatcctacaaagtgtatttttcttacaccaaagtgttagcgcacatagattagagtccctttgaaatatacaacttttacaaatatacaatatcttcaacattcctcaatagctatgaaatatacaaatcttacaaatatacaattctttaaaattatttattagcaagttaggaagattttaggcctccatagtttggctaaatatggataatacaccattcgacgtattagcaaaatagtaataatttataggtaaaatttttatatatacgttcttagcgatttaaatatccatattgaaaaataaatttcgatcgaaaaaatttcaaaattaacgatggggaccttaatgccaacagcctgcacccttcgttccattaaaaaaataaacttgtgactacaaacctctggcgacgttccaaaatacaaccatcagtaagattttccggcgacggcgttggcccgccgttggatcgcagggaaatccgcgtccggcgcggcacacattacacatacctccgtgctccatgactccgtgtacccacggacccaccattttcctcgccgcagtaccgcaccgacccgcagttagctcacttcccactcgcccacttcccccaccccactctgcctccggccactgccgtctctcccattccccccaaccccaccaccaccgcgaaacaacaagacgaaaatcacacgcggacgcggcccggtcactcactcacacgccgcgggacgagacgaaacggtaaagaatccggcagcagcaagcaggagagcgcgagctcggcgtccccgctccgctccacacgcattgcccgctcgcccgcccgcccgcccgtgagcgcgagcggctggagcgatggggcggcgcgggggcgcggcggtggcggcggcgtgcgggcggtgg

SEQ ID NO: 1313 - DNA, 1501 bp, Oryza sativa
ccctaattttcgatcatggaatttttcaaaaacgtactccaggccagtagaccaggagtgctattaatcctgtaactttgcaaacgagaccctatttggatctttattattgcttacgatcctcagttcagacttcagagagagccatagccagcccgccgctccccgccgctgcctcttcgctcgtctccgtcgagtccgtcacgcaggtaaaatcccccgccgctgactcgcgcgctgatctcgtgtgtgttttggtcccgatttgggccgagtttgatcggcatgccgcctgggtggtgttgattcgggtggccttccgcaggggatagttggggggatcgatccactggttctcgaactgccatagtacttgctttagaggtagcggtttcacttgtgtgatcgaccaatcagccatttctgctcgattaaattcggccagacctgtgtaaattggggtttacgcgaaccgaggaggtgttgtagctgtgagtattcatgccacatgcccacattgatcaaattatgctcttcaaacacatgaatctactaaatttagaagaaagaaaaaaaaacagaggggctggcaatttcatagtggattcatttatttttgtcatctcatttttctaagttcttaaggaaatgttgtgcaaattaagcagaaactgtaataccccaatgtggtttcgtattagcacctgtttgtgtgacaggagattctcagattttagatttgaggaccatcaatccctcactacttcactagcatctacttgtcatgggataaatctgaagtcccaagacctgtataaacgaaatttctccaattctcatgcagatcgtagtaaactttggtctctttgtttcatccagatcgggagaggtttgacagtgcaatgtaatcgataagcaaaaccgacagatacaccaaatggcacgcctgtgcagcttcttgtttgcaatgatgtgatctggcagaaagaaggcttgttggttgagactgcagtagccttgggcagatacacttgatgatttattgatgcagaaattagtgcttagcaacataatgttgtctgtgtactttattaagctaaatggacaataaatatgctgatacaatcagcatgccattcctcgaaacgaagtactaaagagaataaatatcgaagaggtttttcagcaaatagctatgtcttcctcgatgagaagaggtaggagcattatctttcatagttgtttgaatcgagttattctgaatccctgaatgttgatgaagcttctatgcctaatctgcagcaaacccaggagttagagcagtcaggaagccctggagagaaagcagtccaaggctccaagctattagttttttcaagaagagaaacctgtgaccttttggtgcaatgtcctctttgggagatgttctgcacaacatcttgtgaattgtgatgctagatttcatttcctgttgcttgctttgcttccagctgactgtata

SEQ ID NO: 1314 - DNA, 1501 bp, Oryza sativa
tacgggtcagtatatcattagaatcactaaaagattttcatatggagtcaccgaaactgaaattgattattctgacggtgacattggatccacaatctaaaatacagggcaggtgtcccccaaactttgtttgcatcccgaatcaaacaaatcaaaaggaccaccgggacacatgagcatgtccgatatactaattgaacatttcaaccaacaaaagggcgttgctctagaattagtacataaaacaacaaacatattcacctaagaaaaatgaaggaatgtgctcaacaaacggtcattatcttgcgctggagtggccgacctaaaaggacgattagtaactattaagagtccagttttgtcagggagctattaagagtctttaatggtattatagaaaaaaacagtggtcatttaggacactaggacagcacgatgttggaacagtgagctcttataatcaccttcaattcacagcgtttagggtttcttcatagtccatagcgcagtaattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacgcgcgcgctcgctcgcctggccgggccggcggcgcgcgtgcacgacgtacgcgttgaatggtccgaaaaattggctcctcacccttgcgcagatgcagcctccttttgcagttttgttttgctgcaaattcggattcgtttttgttttggaaacgttccgaaaaatccggtgcgtgcaaacggcatggagttcggataagttacgcgcgacttatccggttcggttacgcgcagtagagatcgtgcgggcgccctgatcaagcaacccttctctatataaaccgacttgccgtcttcacgcaactcacgaaaaatcaatctagggtttgcctcctactctgtactgcgccgtcgctcgtagactactccatcccgctcgccggcgtgcaccggcgatcgggagagcaggtctccggaacctctgccttcgacgttctgcaccgggagaaggcggcaataaggtttttggaaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttataccgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 1315 - DNA, 1501 bp, Oryza sativa
tgggtcgtatgtgtgaggataacacttatctatctccgggtggaaggatatctttgtgtgaggatataacaagtcccaacagacagatcccgttaacttccaatggaagaaggcctagcaacatctcttctctactacttaaaaaatctatagtggtgacggtaactccatacacgcggaatatggatcatgggatcgggagatcagacggtgctgagggatcccatcgcacgcgctcctcccctccgcctgcgatgcatcccctccctgagggatcccctcacggtcctccccctcgactcgcttttctccccacaaggcagctcgcgctcgcgaacccgccgacgctgctcctccgttagcccccgttgctccgcatcacgcagcaccgcgcccccgcaacccatcatccctctcgtcgccctatctcctctcctccctttccctcttgcattgccgtcgctgccgccgtcatcgtcgcgtctcctcaccatcgatcgggatcggacgtcggccagtccctcctcgcctccatccccaatcccctcgccctcttgcacctccatcacgaccaacgcacgccacactagcgccgcctcgccaagcgccacgacctccgtcccgcgacgccgccacatccccaggtgcccatcttctgccgcccactgtcgatccctcgtcgtcgctccacctccatagcagatcccctccctggaaccccctccccttcccacacaccactccctcccattgacgcaccttgatgcacgtctccccaccttttgcccgatcgcccccggaacggatggatggatgcctccacggccacgctgccggtcatcgaagcgccctggccacctccgtcatcgtgtcttgcccgtctccttcgcgatcagccgtcccacccggcgtcgacgccgggagtctggagggactctccaattggtcctgtcacctatgatcttggtcctgtcgatgtccgcctctgctacaccacctatgattttgggtatggaataactgatttatcttgtgatggttagggattcatgttttggatttttttttttttgctttgattcccttcaagctaaggaagaagtttgtacttattcagtgtttcagtatgttgtatctagaactacaaatacaaatacatgatatggttgatgatctgcaattcttcttcactatatactgtctgtgttaatcttttagattgaccaatttgggattatcagaaaaatgtttctagattatcagaaaatgtcatgaagtcttgtatgtttctaaattatcagaaaatttccttcaaaaaaaataggggctattgcattcttacccctattttgaagttcaattgtgattttgccctcgctttttagggtttgcgtttttactcctacttttttgaaacgaagtagagatttgtccctggtttggatggtcaatttaacggggttaagtcgagcacgaaaagacttttatgcccttgctagct

SEQ ID NO: 1316 - DNA, 1501 bp, Oryza sativa
tgagcagtcagcatcggagactcggtcaatgatgttccgctggtgatgaactgtatacctcttagctactggaggctacttgttatccataagttattttcacaactactcctaattgacacggtgagtatgatcgttggtgtgttccgcggaggattcggcgactattttagcatatattttttttcggctgctgcgagttggcgatcctattggtctgtggaaatgggcgcaggattactgcctgcacaggtacaggtgcacacacgccgtggaaaaaaattagcatcagcttggcagcttggacccagtaagacaaatcatgtactacctccattccaaaataagtgcagccatatatatccgtgtttagcgctttgatcatccgtcttatttgaaaaatttataaaaaaatattaaaaaaatagtcacatataaggtactattcatgttttatcatctaataacaataaaaatattaatcataatcttttttcaaataagacgaacggtcaaacgttgaatataaatagtgctaaaactgcacttattttaggacggagggagcacaaagtacaataagccgccagttttttcttatgctgttgtttgtaactagattcattaacatctaaatgaatatgaacaatgctagaaagtgttacattatgaaacggagggagtagtacagtaagtttcttgctggaatgtcaaaataggagtggacacatttagtatcagtgaaaattttcttttgggacagaagcggcgagggactgtcacgtaaacttatctcgcgtggaacctcccaataaactgcgaccattcgtactattacaactactgaccatgagagatcccaaagtccaattgaaactgaagggcagtgttccttctcttcaagctaaatatattttaaattagatttaaatagcgaaaaatataaaaaaaaacaagttcagatatatatagtgcatgcacttcacttaccttgattttcctttcataattaaatttacttgttcttcaggggacaagagtgaacatcccactaggtttagaaaagattcaatcaatcaaatactattaaagagaaccgaagtggttcgtttcacctgtttattttgtccttaaatcagtagtactcctagcaaacgccccaaaggccaaaaatctatcctgggccgaacggcacgtgccaaatcgttctgcgtgtactgcagggccgaatccgcgtctccgccgaatgagtaacccgaagcacacggcatagccgcatgggcgccagggtgggaaactcggtgcaccacagccgttcttgttccccccgcgcgatcccatcagctcaccactacaaaaagttttcacgcactcacccaaccagcaagaacgaaggaactaccacgctcgatcttccgctgcgcgcgccgatttgagctttacgccggcctacccaattacccaatccagcaagaacagcatatactcgtcccgcccatgg

SEQ ID NO: 1317 - DNA, 1501 bp, Oryza sativa
gagaagaagttaatatattttgtgataaattttaaatgatataagttgcaatattttggcatagaacgagaatcatccaaccgttctggtagtagatgtcgctttgctacattaaacaattaggtcgagtcgttatatatgccaatagggagccatgagtccattctgcgttaggaaggctaatgaagacgtgaagtagaagctgtagcagacaccctctatcaatatggcgtacgctcaagaaattcagctccaaatcagaggtgcctccactgctcctcaccatctttagtctcctctcgtgtaacccttcctttctggtgcttaatctcgtgacaatggtttaaaacttttaaacggctctcggttttgcaaattgccctcgttttctcgatgtttagttggtgtggttttctgcttccgctctaatgaagtttggagttttgcgagtgaaatggacgagaaagacggtatgtgcgtctgaaatgtccagcttaggagctgtttccaaggatcgagttctggcgcatggtaacctagatggtatgtgcgtctgaaatgtccagcctagtttgttcttgctctggctcgctggcagccgtcctgagccagcaagacagagctgttgggatcatcgctcttgttcttcttcttgttgggatttattttaggagtttcttcaaacttgggcgaggtaaccgcgtacaaggagtgctcaatagaaatagaaaatagtttttcagtttccaaatagagaaatactagtagcaaccattagaggaataacaggggcggagctacagtgatgcctatgtattcccaggaatacccaactttttttatcaaaaaacaactatacttcagtatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaagccgcgagacggcaaccgacgggcgaccggtgacggcgggagcgaggccacgaggccgaggggcaggggcgcggcggcggccggccaacagctgcagctcagcgggacagcgcccagcggcactgcggcaggcgcaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctag

SEQ ID NO: 1318 - DNA, 1501 bp, Oryza sativa
atgaactcatgatgaggtaaggtgtggccgtatgcgagttggacgtgagggcaggtgacaatgttctccaggttggttagtgatagcccccgaccaacctgggtcctaggttgtcgtgcaagtggtctagtctcttgagttggcctttggtcactagtgtttcatcaatcggatagggtatgtttggttcaaggttatggttggatgtaatatagccatctatattttagaggatgaagctaagttttttttaggatgggataagcttatttgattggtaggatgaggatggattggatgaaagcaataaacttaattataatatcttcctcgaaaaaatgcccgtgtgttgcaacgggaagaaaagatgagaaaattgaggagaatttgagaaagatttacattatgtaattaaattaaatacacatttcctggaatacttgattttttaagtaggtaggtgtttaaattaatttaaaagtaaagtaagtgtggaaataaaatgatatagctaaatttaatttttaatgaagttctccatgattaattacactctctggaattttcttgaaattttcagatctcaattgctaactttaataatacaaacatcatttaagaatttattttaaaaaaatctaaataaaaactctccattctctctacgccaatttcatcccgtttccttcctcggcctgcagcctagccggcccacttttctcccttctcctcccctcttcctcggcccgcaagtacgcatccggcccagcaaagcactacaagtctaatcagcctccctcgctccttcttttactgtcatgtgggccagtgctaccgggtcgtctcctacctccgtccgtattgccgcatctgcccgatgacgcctgaatccgcctcctccgtgaaatcagtccacatccatggagataattagaaattgagtgaggggttttgatccttatcttctcccctttctgttttcccaagaatcaaaacaaaaccacgtcgtatagatgttggaagagaaaccctagctttatagttcgagtctgtttctcttcaaatctgcgcatgcacgtgctgagatggagggaatcggacggacgaaaaaagtgtgactaaaggaaaaatacgaatattttagttaggtacagatatagaagtgctataataatagtaagtcatacaattaataatacaaattagcacttgtttacactagttttatcgtgctaattactaatcaatatcaaacatgtttaatatcattaatcataatttaacctacttagtaatcatacactaattagtattctagacaaggtggattatagattgccaaaaggcctgaggctagacaacctggcccaggcatggcatggcctggcccaacctttgggctgtgcttgggcctctgcctcagcatggtggaccatcccgatacgacatgttccaatgattagggaggcaaaatagatgagggagagaaatagacttattt

SEQ ID NO: 1319 - DNA, 1501 bp, Oryza sativa
tattccacagtgcatcactttgttacgagaaacctcgtgtagcatggggcaacgggtctcaactctctctttatcccacaatgcaaaggagttatacctgtggctttaacttttcatatcagcccctaacattttacattaaagttctcgtagtttgtcaatttagagaatacttcaaattttacacaaaacaccctcaaaatcggaaacatatataaaatccctccttcctcactttccccgttgcccttccagtgccaccgacgcctctcccgttcccatcccccaacggcgacccacgctcctcaccatacagtcgccaccggcacaccacccctcctatatatcctccttccccaactggcggccctattcccttgggcggcgtggactgcgggagacggcgagatcggcagcgtgggagcaagggacggcgggagctcttcaaagacccccactcatgtcctactccaactggtggctttcctcccttggccggatactgacgagctcctctccctctccgtcaagctgctgctgctgcagaccgaggtggttcggagcggggacgacgacgagcttggcggcgctgaacgggaacgaaaacaaggttagtttgccacctccttttcctctgtcgccaccatcctcccttctcctcactcgaccaccaccccactaagcagatccgacctcgggttcacaggatttagcgagcaccgctttggcgacgacgcagctcgtgatggtggcctcgctggcgacctccgccgccttgcacgaggtgtggaggcgtcgcacggggccacacctcacccaacacgctgctcgccctgtgcctcattccgccttgacaaatgtctatccaaattttgatgaagaaccggtggctttgtttggttccacggtcttcaggttgggagcgcagatgtgtgcgtggcatggaatccccgatgtggatggtcggggccgaacgtcaagcacgcgcactataaatggcattaggtatgcaattaaactttaatatttagtactctcttcattaaatttgattttcaaattaggtgggccgacacatcttaatattcaggaagttgtgatatgacggcttgctatcgagaggcacattgtctattaatgaaataataattagtcataaagacaagtgcttatgcccacttaagaatttaaatccggataaatagattccagaaacctagccggttaatttatactcattttacgattaacgttataaatgaccagaaataaacaagataacattcatttgtcctcacgaagattaactgcattttcgtcgcatccggattatggagctccatactgaaaacgacatcactacagattaagaaccaaatccccttcatccacgagccgtctcctccactacattttgtacgcaccaacactggcaaacactagccgagcgccccagcatcctgcctgcgcgacacagcaatggcagatggttacttctacc

SEQ ID NO: 1320 - DNA, 680 bp, Oryza sativa
cggttggttgtcatgcctggaaaataactatccagaatgctagtgtattaatccccgtcccaggaaaagccaggtacatcacacatgatacaaaagacacatctttattaattatcgcgataatatttacattattgcataggcacataagacctgacaacaaaagaaaaacaacactggactagcatgtctacggttccatcttcacaaacgcttaactagggtataagccaggactctgcctaagacttctgttgtcgaagcgacaactacgtacgttgaaggacgtggttattcaacagtgttgggaacaataaatgtattactttaagatttttcttcgggatcccccccttttacatgtcctagggggctatttataatcctattataggttcccccattagggcttaggctttacagggaaatttacatggctgcccttatgaaagggacgtttgcttgggtatatagtgatttggatacataggcctctaatgggccaattggcgaataggcctaagcaactgggatggcctcttgggcctcttcaaagtcgggcttgttatggcgaagcccccatccttcaacctacacactttgcccaagatgcatttgatcttgccagataccagcgcgatccttcagccttcgccatctctgctttatagtcttcgcca

SEQ ID NO: 1321 - DNA, 1501 bp, Oryza sativa
gcccatctattaattccaacactattttgttcgtggtaaatacgagcctacacaccatatcaaaaagtgtcaaataaccagatttttttttacaatttggttatttctaaaaacttattttacaatggcccctttctaaactttactatgaaagtggacccatagctcgcgcctaaggctattggcactgaagttaaatgtctcaataccaatacccaacccttatgccagttggtttggcactgagcatccatatctcatagtatttttcttctctcctcccatccctcttcaaaattttttgattttctgctaaattttagaaatatcatgattcatttccgctaatttatttcaatttataagaaacctaatttgaaatgagggtatggacgctcccgtccaccaacctctaaatcctattggttttccaaggaaattttgacaaattaaaatatcaagattcattttccataatttgttatttataggaaacttaatctaagatgagagttcctttctcctttgcccaacctatatgttgattttttgtgtaaaataaagtgggaaaattgacaatgtagaatttttttaatttatttctagaatttcagtaagtagtttttttttgaaaaacaaaatggtgattcactgtagtaatacttgtgataaagagataatttatcgtcatactatcatgatggaaaaaaaattaaaaatgactacatggaatctatttaaatttttctggaggtcttagttagaacgtgtactgtggtaaattttatttaccaaggcaagagagtcaccgatggcttagcatgaacaattactccctccgtctcacgatataatgaattttaagtttttgcttgtactgtttgatcacttgtcttattcaaaaaatttgtgcaaatataaaaaacgaaaagttgtgcttaaattactttaaataataaagtaagtaaaaaaataaataataatttcaaatttttttgaataagacgagtggtaagccctttttgggggtttggggcccccaaaaaagggcccaaaaaaaaaaacccttttaaaaaaatttcctcccttaaatatttaattgggtcccgggggggagtagttttttttttacaaacgtctcgagagggaggaaggagctagggtgatatattataaaagcatgtaagtagtgtaactcgtcctttagcggtacttcgtaatacgtacttgtactttcatttttgttaccataatcaaacctcctgttttgtactcattaattttagttgtaccaatgtacatttaattctttgtgaaaaacagaacacatctgattatgaaagactcttgtgtcttggtgctccatatagacgccattaaaaccaacacccaagaattgcgtatatatacgagtacatagagcctctcacttcccaacacagctgcagaagcatcgtcgtacaccacacacaaaaaatggcagatcttcacacctatctgt

SEQ ID NO: 1322 - DNA, 1501 bp, Oryza sativa
ttggtcaggccgaaaaccagtgaatacaaggtgttagtgtgtgttgtgtgaaatgtgagcacaagtctaaatgcataatgacctaatgtggcaattaaaatcatctctttgctagatcattacccctcttaatagtacgtcgaaactaaaaataaactagcaaatttgatcgccctacacctcgattaattcaaaacaaaagcactagttttaccgtcttttttccctttactttgcgccgtcaattttaatccatcgataatcatccatgcgcacatatgacgtgaacctaacttaaaatatatagctcaaagacaacggttagtccacaattagtgcttgtcattaattaccaaaattaacaacgggggactagatgcttcacatgcaggacccgctacctcgccacgcgcgcagctgtcccgccatcgaggtcgccgccgtctgccctcgacaaggagaggaatgggcgggcggagaagctcgccggctcgatggggaaagcgtagagaaggagaggagctcgaggtcgaggccgcgtccgagctcgctgttgtcgccttgatccagtgagcctaggccagatctggctgcttagcctggcgtcgtcgccgtcgccgctcgggccaccgctccgcccggcttcaagaggaagacgaggtcgcgtggctcggtcgacagcgacctccgcgaggacgaccgtgccgccgcttgtcgtccgcgaggaagacgaggtcgcgcagcgacctccgcgaggaagaccccgccgagagtccgtcgttgcagagggggtagggggagggaggcgccggtgcggcgtctgtggcatccagcctcgatgatgagaggcaccggcgtcttcgcatccttgcccgccatccttgccccttgccgcttgccgtcctggtttgggaatgcgaggagagaggatagagagagaggggaggagagatgatggatgtgaaaagagagatgggtgggacccactaacatgtattgcttaagacacatgcactgtaaagtgtggttctttacccggttcgttgtctagctggaggctttgagctcctcatgtgcgttacccgcactgtgaccggccttatattagacattttgctcacacatatacagcagacaaagcccaagagcatcatcgattcatcgtcatcccgggatacccatacgagatgggtctcaaacgacccatgggacataaatctcatccagcccaatcccagcccaactcgcgagcccgtcacgtcacgcttcgcacccaccagtccacctcctcctcctcctcctcttccgcaccgcgccgccccgtcgccggccgcaaccaccaccaccactcgccgtcgcctccgccccccgcacgcgctcctcccctcccctcccctcccctcccctctccccggccgcgccgctcgccggatctctcccctcctcccttccaggaaccccagccaagcaggtagcgtgtgacgggggaagggggggatgg

SEQ ID NO: 1323 - DNA, 1501 bp, Oryza sativa
atatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttcatccataagacaaggtataattatacttcatatgtgatcatctagagcaaactgaaagtactgagtgggaagatgacaaggtgtgtatggtttcccttgaaacaatgcaaattggttcaccgaagaaaaacatcactttgagtttacatataatacctaattgaaatcaaaatatgctctatttgtaaatatgataagaagtacaaacatttgggcgcccataaccatcaaagtgaacagcaaagcgcttcaagtgaccaacttctgaaaacagctcctacaaggcgaattgaaaatgttagcctgtcaactctatatccaacaagaatagtgaaaagaaatatcccaaaaaattaattagtctaacaaacctttatatcctcattggaaaccccatagtccaagtttgaaatgtacaattttgtaccagtttcaattccactagctgccatactatcactaaacagatcaggtctccaggtcatgtctttggttctgctaaaagactgaaaatggccaaacatccagcatgtgagaaaatgtgtcatcacagaagcatatcacctcaaactgttctgtatgatcatggcaactatcattagtaatatcaatctttatggtagagcagaaataagcagcttgactatgaaaatgctgcattaacttaaaatggagaggaagagagttccacaaatatcacaagtggagtagataaatggctagagcattttctctggagacatcctagaagcacttcaccatagcagatcccaaagctgtcagatgagagctgcattgaagttccaggtattgcacaaggatcaatgaagatccttccttcggcaccacatgcagattatatattgaattgcaagaataccacaaacttctttttttttcttttcatttggttcgatccatatgtgtgacaaacctccttttccatttatttcgatccatttgatcgaagagcagttgctgtccttcaaagttcccactagatgtatccaccagttatttctgccactccataaatgaaaccttagaaatgatctacccaatcaaagtttttcacaagagattaacagcaaaggaggagagcattcactagcgtggcattggttccccttgagttctctaggaacatcaaattgtaaaaac

SEQ ID NO: 1324 - DNA, 1501 bp, Oryza sativa
gataataaattagcaaatagacgaacaatagaatgagtgttttcaataaaaccttgttccgtttggattgataattaggaacatttaaggagatgtggaagaaaacagtaagcaaagattatttcaaggtggttctccagccagccattacctccttttacaaggaaattcaaaccaaattaaagatctctaggtattcaaacaacctaatatatatattacacacatgtttatccaaacaaattcactgcgattcctcgaacatatatgcaatgttgtatttgaaccacattttctccctatatagaagatatatacgaacacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccgatgcatatggcaatcagttgccagtacatcatgatacatataatcatttgtttttgcaagcaataatatatcaatctatccaaattgtgttctgtccatcttgtacgatcaagtcatatatatgtattgtgcttaattactccctaataataatggacttatatgtactataggaaaatggcatttgtttctagatcaacatatatatagatattaaattatgacggacgtttttttattcaaaaatatgacatgcactatttatcatgtgatttcatataggagtgccaatcaattaacagcgttctttggttggacgattgatgtcatggccgtacgtaacggttagaagaattttagtcagaagtttatattgcaaaaaatatacacacactccataaagtgagaaggtcgatatcgggaagataagaccagggaaaccgaattaataagagaaaaaaatgtttctcgccttaaggttgatgccaaaaaaaaaagtcgctagcttatctgaaagcacgactgattcataataaagaagggtctaggtacatcctaatcctagtaaatcactaatcaacaactacaaaactagacataaccaacaataacatcctataatatgttttaccttttgatgaacaatttttttaacaatttttttaattttttttaacaataacatcatacaatcacttttgtcagtttt

SEQ ID NO: 1325 - DNA, 1501 bp, Oryza sativa
atgggctcgaacctgtataaaaatccttgcctccgtctcttttacttcaatcttgcatataccctggtaccaacgatccccatactatgcaaataccctagtcgcgatctcaaacgtcgacatttatgatgtcaattattactactcaaattttgatgatatagatagaatactctattttgaaaatgagtgaggttaatcattatgatacttaaaaaaattatagttataaaaattatagttatagagacatatcaccatgataatattcagaacaccatattattgtttatattttgaaagatatctatagtttaaagcctagtttgttttcaacacctattgttcataaccacatgagatacttttagtaatttgaagaatatatttgttttttcaagcttatttacaataactaatccgttggagttcacttgtagtataagaaaatataatatgagtagtttattgtgccagttacttcattgttcatgtgtgtcaaaaatatttggaagaattatagcaagatcattggctggaaatgttattgatgactttttttttcatatctgtataccatgtatgctgcccacttctcaaataccaatcaaatagttctgaaaatattaaaaaactttatgaatcttaatctcaaataaattacaattaaatcttagatatacttgaaaaacacagctaaattgtgttgttttcattttttacatatgtagatttaaatatcatgtgaattttttgaaaaattatcacataactgactattatatgtcggccccatgtgttctgatgtattaaggacctcaatattacaattttatagtttgatttgatttaaagaatacaacgggataataaattggatatataatttttttttaaaaaaaataaaaggtggtataaagaacgttgataggatattttatatttttattatcgatcttaatttaactacatatttatagttgtgaagtaatatattttattttcatattgtaaaaaataaattgaccgtcgattttttccgttggccagcagaaggtaagctttgttttcaatcgtactacctacgtgttttcagtcgtacgtacgtacgttcctacggatcagaacagcagtcgtgtttgtatcatatatacaggaggaggaagttattattttttttaataataaatctaagctaatagtgtaaaataataaatcaacagtgagattagaacgggtccaccaatttaaatgaaaatcaacggtaagattaaaaagtaccatatgacggcttaagagcgtttatagaagtgtcatgtgacgactttagagcgtttgtggacttttaatatgtaatagaagatagatgatattatgttattatgttaatgtggaaactaatacacgatgaccatgtgcaactgtactcagctatatatgaaactacccattcatgttcaattttaagcagcaaacagggttcaatgcaattgtgaatttt

SEQ ID NO: 1326 - DNA, 1501 bp, Oryza sativa
tgatatgaagctccactaaatgtatgggtttatataggctaatatgagtgatgtagtttgagtgatccatgtatgaacatttcatgtagggtgggtgataggctacatgcaacctaacatgaatacgataatgacgaaatataattgcgcagtaatattttggaaatgtcatgtaccatgaatacatgcttatcttttatataagatataagatagatctaacggttataactaatagttcaccggtttaaaagacatagaagtatcccaataatatagcttaaaaattatggttattttaatatccagcgctattgtgaagtgagcgcaactcaattggttaggtttcttgtggtgtaacttgcccacctggttcaagtcctagacttgacacgggtgctcgcatttacggctaattattctttcagtggtaggtgacgtaccaatcgacagcgagacgcctgtggtgacatcggcaatctcaaaatgtgtcgactcagtcttttggaggaactcaaaggtgcaggaggtgcgcgtgctgtgtttctaaacaaaaaatccaatattgttgattgtttttgttttagtttaatagctaagaaatagcgaggagacaacaaaacttatttgcttttttcttaaaaatatatgatccaaagtaatgatttttttaataatgtagttaacttgattctttaatttttaattttatagtaaataatctaatatatctcctacttaggctacattcaatctcattggttgagcttatgcatggcataaaaaacgatgtaggtcatcaacacaagattaattaagtattaaatattacaaacataaaaatagatttttttttaaaaaaaaatgtatagaaagtatttgcaaaacatgtacagtttaatagtttagagaacatcctcaagataaatgagggagagccaatctaataagtactttagaactcaacattaaatttattacttatgtacttaaaaaatatatgtacaaatcaaaagcgtagattgagtcattaacggttaaaatcctgactgtgttttacgagaaaaattacgatatatttttaaacaatacattttttatttgtgtttctgacaatatgtcccgagtaatattttaattactcattatttcatcttaaactatcaatgtaggcccattgatgcaactaaaagttatctatacccaataattgtagtgtgaaatgatatgtttatttgatattttatattatattatagatctaattttaggtgtgcgttttatgaagtaatatatttttcttaaactaccaccttcactaaatatttggcgttgatcatcataaataaaataaaaaaatcaagagaaagtataatataaaatctagtttaaatcgttgttttctttcggtagtttcactatatatttaacattggccgtcataaaataatacaaagaaagtgaaaatccagtttaaaaagcaatttttttccagtagtac

SEQ ID NO: 1327 - DNA, 1501 bp, Oryza sativa
tatatagttgatagataatagatagatttataagatgttttaaagaacattgattggatatttataatagatcttaatttgactaaatatatttatatttgtgaagtaaatatattttatctttatactgtagaaaatcatattttaaataaataccgtaacattgggaaagttttattgttttattttcaatacgtacgtaacgttctgtatcgtatataaactctatggctgaacagtaccgtttctatgttatataatatatgaggaagttattactttttaataatagatctaatctaatggtgaaaaataacgggtctaccaatttaagtgaaaatcgacggtgagattagatagtgccacgtggtggctttagagtgtttgtaggagtgccacgtggcggcttaagagcgtttgtaggaagtttaatggacttttagtatataatagatagatagatagattttagagttttaaaatgcaagcatggtcaatcatcatcctacgtaattcaaataatatttaaatatatatttccaccattttttataatatgctatataccgatatagttcatcctcacttaattaatgttatatcacatcaattgtttttagctcatagatgattaatctaggtccaaattatctttctcgctttcttctctcgttaagccataccacctcaattgttttttgcccttagataattcatctatggtccaaattatcttcctcatcttcttctcttataaaaacacatcaccttacttttacatttggatcatcattctatatactatttaaattaccataaaccatatcaacttatgtaagcttatatcttctaactatcttatacattatttctacttattgctgtcacactaaaactcccacggcaacgcgcgggttttcacctaattaatagaagaagagagacgtccgagatgcaattacgaagaaacaacaattgaacaaagcatacaaaacagaacaaaagatagcaaacaagtcactccatcaagatcctcacaacatcctaactcttaagccttcttagccccactggtagcgagttaggggtgtagcaacttactccatttccattttccttagcatgcttctcaaactgataaatggtgcggattttacaaaatctttttacatagaagttttttttttcaaaaatcaaattaacatatttgctaaatttataataattagtactccattaatcacttgcttacagcttatctcgtttcgagagccacggaaaatcccactccaaaatcactttcaaattcagccttagctaggatcaaaatcagcggtagccccttatctcaagaatgatcagactatttaagcctttcctgatgacccattgcactaaactattagcccgactccaccaatcatcaaagatctcctacgttggtcaaaccggtagacggatccgctgcctccaccattgggagcgacagcgaaaacgtgga

SEQ ID NO: 1328 - DNA, 1501 bp, Oryza sativa
ccagttatgagcacgtacaggagttgcaagccaattactgcttacaagtaccgttagctcaaatagctagcaatgctggttacacatttctttctggcccaggcaaagcccagagtgcgtggcggttgatacggaggctagctcctagcgaataagttcactttaggtctctccattgtcactgagttcgaaattaacctaaagtgaactaagtgttaaaattacactctaagatggtctttaggggcatagctacatcaatgcgggacctatgtttcaaggcattacataagaaagccttggttggcagctaaagttgacttcatccgttagagagccattcatgtttatttttaacagtgttattgtattatccggtacatatggtatttttagactatttatatacagatatgaaattaagtgacgagcaccgggttatgcgatgtagatgaattcttttagtgtattaataatgtatcatttattttgtggtactaatacagtttcatttattaaaagtacacctaattttcagaacaatgataataagtagtggtgacaaaatgcgaatttatatatgcctagaacgaagggatttttatttaaatctgagggacattcttattagatttagtggtatattagaatctactgtcaattttacggcaaatatgtgtctatttttatcctagaataatctacatttccttacaatgtatatatagtgatgtatgatttctttaacattcttttccttgaacaataaataagatgcccgtacatatgtgcgggtttcctttatatgccggaaatattctccaatttatattatgtatttatagtttttaaacacagcctatgatacatgtccgtgcgaatgcgcggactatcttcctaattgtattttaaagttcaaagagagggaaaaaaaagaaatattattaggggtaaagtgactcatctcagtaattcatggactaaactggtgcagggagccaacgattatttttttaaaaaaatatagtacaaatggaaacactcactatatttataaacgcacacgacacccacatgaacactattgaaaggtacatcactaaaagaatattagacctaaatgcgagaaccaaatcaaatctagaacttaaacctgagtgggtaggttccaccagagcaagcctaatcaattaagctatgcacacttcacagccaacaaatattttaagggcgttaaatgaaaaccatttttttatgtaacagaaaaatactatatgccatgacaagagattagaattggcattctccttcttgtgatactgtaatacactatcactacagctatatatccacatagacatctcgacacgtacgtttggctgccaagactatcatatcccacctcttaattaaggattgactagtgaaaggtgctttattagagagtgtggccaacgatatgccctctcgcacaatcccccaccacatacgaccatgaagc

SEQ ID NO: 1329 - DNA, 1501 bp, Oryza sativa
gcaacaccttgtttcttcaactgcggatgactaagatggaatttggcgacggggatagatcagttgaaaacagagctcgtatgcacatttggcggttgtttgaagtcaacactgtaacaggtggccgaattggattacagaacatggacagcttcatcaattctttggccaaatttggctatggaagagtaaggctacctcaaaggttaaagttttttgttggttacttttgatggacaggttgaacacaaaatatgtgttggaccataagcattgtgcccccacctgattgtgatcttagttgtgttctttgtccaattcaccatcttgagaatctattgcgtctatttttttcagtgtacctttgcaaagtcttgctatgatgttctaggtatctcctgggacacatctctgagcttggataacatgatggtacaatcaagaaactgttatcaaagccattgtttcatggaaaaaaaatctttgtgggactaggaatatttggaggcaaatgaatggtttcatctttgatcataaacctcctcctttgaattcatggaggcaactccttaagggtgaaaacaatcaaggttagccaacaaaggacagtgatctatacagaggtaatgcatataaaattattagcttatagtaatctctttattaatctttcccggcaacggcgctagaaatgcttgatggtatttcttaacgatgttactagaaatataaattcccagtaatgacgccagaaatagtcctggtatatatatgattacataagggatccgcaagcgcacggatatactattgtagcattttacccagaagtattccaaggtatcatatttatttaatcccaaagaaagatttataatatagaactatgctaataatttatttacaccactggtacgattagagtctaagcagggattaatacattcataagggtagagtgacacaaagcaaaaagaactcagatcttcttattaattaatcctaagctatgtggaagaagaaatagaaaagcaatcaattcatatacttctagtatacactccattttagtttacatctgctagtatacaattgtgtggccactacccctaacagtgccctcctggtgtttcgagagaccaccctaggttaccgagtttcttatgacaacctgtcatggccatccaatcggggctaaatacggaggagtaccctccccagaaaaatgtcttaggaatatatactgacgtggaggaatacccatactgagttgtcaccatcaacgggccacctctactgtcccgcagcatatatgctcagataatgatacttaataatctacacaccacctctactactctatgtcccctggaatgacacagagcaaccgaataatcggacattaaacccacaccattgcacctctctggtaggctagctacacaactataatgacatagatataaaataaagccgatactcggacaaataaagtaccgag

SEQ ID NO: 1330 - DNA, 1501 bp, Oryza sativa
tcgcttctcggctaaagagggttaggttcttgaagacgccattgttgccgtcatcgtagtagctagttggggaggattgcaaagagtgaagattgttgacgttgatgccaacgtggttggcgttgacgtcttgaaaatcggtgttctggacggtgtcgagctcaaccgcgaagaggtggttggtcgtgttgccgttgttctggacgttgaggagggccaggtacccaaccggcagtgcggtggtgaagttcttggtcggggacacgatgaaggccataccgtgggcacagaaatcggtgtagtcggagatgatggcgaacacgaaggcggccgagaaggaccgagctgtgccatcaggcgatgtgcggaactgcagaggcgcggggaagaacgcatggccttttaggttggtcttgcggctggtcagcacaaggatcccatctggcatgacggtggcgttgccgtcgagcgtgaggttggtgccggtgaagccatgataggcgaactggaagtctccgctgccggaacacaaggcaagtgctaggtgaagaaggctgatgaggcgcaagaggaagaacgcaggcttcatggtcgtatgtggtgggggattgtgcgagagggcatatcgttggccacactctctaataaagcacctttcactagtcaatccttaattaagaggtgggatatgatagtcttggcagccaaacgtacgtgtcgagatgtctatgtggatatatagctgtagtgatagtgtattacagtatcacaagaaggagaatgccaattctaatctcttgtcatggcatatagtatttttctgttacataaaaaaatggttttcatttaacgcccttaaaatatttgttggctgtgaagtgtgcatagcttaattgattaggcttgctctggtggaacctacccactcaggtttaagttctagatttgatttggttctcgcatttaggtctaatattcttttagtgatgtacctttcaatagtgttcatgtgggtgtcgtgtgcgtttataaatatagtgagtgtttccatttgtactatatttttttaaaaaaataatcgttggctccctgcaccagtttagtccatgaattactgagatgagtcactttacccctaataatatttcttttttttccctctctttgaactttaaaatacaattaggaagatagtccgcgcattcgcacggacatgtatcataggctgtgtttaaaaactataaatacataatataaattggagaatatttccggcatataaaggaaacccgcacatatgtacgggcatcttatttattgttcaaggaaaagaatgttaaagaaatcatacatcactatatatacattgtaaggaaatgtagattattctaggataaaaatagacacatatttgccgtaaaattgacagtagattctaatataccactaaatctaataagaatgtccctcagatttaaataaaaatcccttcgttctaggc

SEQ ID NO: 1331 - DNA, 1501 bp, Oryza sativa
actttagttttgtgctctagtgctaagtggagtagaatagaatagctcttggagtcctcagagtcttcggaagagttcgagtatggctgtagtagcttttctttcttcttttgtatgactttcagaattactagtatattattctttatatactctcggtactttatttgtccgagtatcggctttattttatatctatgtcattatagttgtgtagctagcctaccagagaggtgcaatggtgtgggtttaatgtccgattattcggttgctctgtgtcattccaggggacatagagtagtagaggtggtgtgtagattattaagtatcattatctgagcatatatgctgcgggacagtagaggtggcccgttgatggtgacaactcagtatgggtattcctccacgtcagtatatattcctaagacatttttctggggagggtactcctccgtatttagccccgattggatggccatgacaggttgtcataagaaactcggtaacctagggtggtctctcgaaacaccaggagggcactgttaggggtagtggccacacaattgtatactagcagatgtaaactaaaatggagtgtatactagaagtatatgaattgattgcttttctatttcttcttccacatagcttaggattaattaataagaagatctgagttctttttgctttgtgtcactctacccttatgaatgtattaatccctgcttagactctaatcgtaccagtggtgtaaataaattattagcatagttctatattataaatctttctttgggattaaataaatatgataccttggaatacttctgggtaaaatgctacaatagtatatccgtgcgcttgcggatcccttatgtaatcatatatataccaggactatttctggcgtcattactgggaatttatatttctagtaacatcgttaagaaataccatcaagcatttctagcgccgttgccgggaaagattaataaagagattactataagctaataattttatatgcattacctctgtatagatcactgtcctttgttggctaaccttgattgttttcacccttaaggagttgcctccatgaattcaaaggaggaggtttatgatcaaagatgaaaccattcatttgcctccaaatattcctagtcccacaaagattttttttccatgaaacaatggctttgataacagtttcttgattgtaccatcatgttatccaagctcagagatgtgtcccaggagatacctagaacatcatagcaagactttgcaaaggtacactgaaaaaaatagacgcaatagattctcaagatggtgaattggacaaagaacacaactaagatcacaatcaggtgggggcacaatgcttatggtccaacacatattttgtgttcaacctgtccatcaaaagtaaccaacaaaaaactttaacctttgaggtagccttactcttccatagccaaatttggccaaagaattgatg

SEQ ID NO: 1332 - DNA, 1356 bp, Oryza sativa
cgccaccggtcaccgccaccacccctcccctttgtcgtcgccggagccgccgccattggacccgccgccggtgggaagggaggagaggagtgaggcggtggtgcgttagtgagggaggagaagaggagaggtgtcgatctgaggagaggagaatgaggagtggatctgaggatatttgctatgcgtggttttttaatgcaccacggccgattttaaaggcggtgctctttagtgaccgccagcgctggcagtcgcttaagagatccgcttgtaaaaatatcttaagtggccgccagcgaaagttggtgaccgcaatccgtcttaagtatatttacaagcgcgcatttattaaatccgccagtacgaataaaagggtgttgctacgaaagatggtttctattgtagcgacggtaacaaaatacgtatgaaacttgattgaatactcgatcaatccacgacaaaatatatcaggataacacactgacacagcaatagccggttcttttttcatttagatgcaaatttcaccttggtttctattagcacacttttcaaactactaaatgggcaatggcatgtttcgtgtgaaaactttctatatagaagttggtataaaatatcaaataaattcatttttcaaatttgcaataattaaaacttaattaatcatatgctaatagcttcttgtttttcatgcccttacttaatattcattttcattagtatcaaacaccagtcgagtccctcgcaaaccgcagccctgctcaatcagttccccgcatatccgcttacatcacccacgtcgagtggcctaggagatccgtgcggtgcacctcgctgatgatggcgctactagcacgactgccatgggcctgcgatagcggtggtgtgtgagacagataaccaagtgaaagactgcaatatgcagttgcggtggcggacaagttctacttggccgaagctgtctcgacataagttgtcgtacactcttgtcactcgcactcatgcacaattttagcttcaatttatctatttctttatggtgaaatcccgtggatctatctaatgattttatttgaatggatttagggtccaatttgctgacaaattaaagttctttcaccttcgtgctcaagttgagaatttcggaatggtccggttgcagactctgtcggactgtactacccggtccctctacacacatcgcacatatatgaccgacaaaggaccttcagaggaacaactgagaaaaacatcctagatttcttaagtagctaaatatttagtttctaatgaatccgttgcaacgggcatattttctagtcctattaaaaaaaaccttttcctctctctcac

SEQ ID NO: 1333 - DNA, 386 bp, Oryza sativa
aaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttatatagttttcaatataaaaaattttgataactattgatatttataaaaaatataaagcacagtataaaatcgccctcccccagg

SEQ ID NO: 1334 - DNA, 1163 bp, Oryza sativa
ctcagggaagattcctcaataagggggtgaaaggggtaaaaatcaacaaaggattacgccccatttaaaaatggaccttcggttccttcgtagttcaccatgtttcatttatcttctttgatggggttataaatctggccgattcttaatcctttattggatggtaccttcgaaccttttccaaaacctttgtattaattttattgtggtgcttaaacttcccattattttcttacacttgaattttcccatattggattccccttttgggtttgtgcataggcttatctttatgcaacttgccttgattcaggcttcgttggagtcaagctccaagcctttgccattgcccattggcatcacaagtagcctaagggtgtgttcggacttccaggttcccaacccctcttcctcgttttccgcgcgcacgtttttcaaactgctaaacgtatgaaagttgcttaaaaaaacaaattaatccatttttgaaaaaaatagctaatacttaatttatcacgtgctaatgaaccgctccgttttccgtgcgctgagataggttcccaacttcctccagcgaacacactctaaggaggactcaatcattttctatactctttttaagtcatgttctgcaaaatgctgataaaaggtgtaatttgctcattcttgtggggcttcttttgcaaaatgggatgagtgaacgcactgttaccacccatgtattttgtttatagtctttataaaaaaaaacaaatgcacgagtttaagaaaatctacaaagaatgaatctaaccaactgacctacacgactttggtcaagattttatttaaattcatgataagatcatggaactacctatatttcagtctacataattctcaaccaaaatcagtccatttttattcttcatggttcacaacaaactattatatagaaataatatcatgcattaaaaacataagaagttgtaaaatcataccatcaaactataatcaatagaaaagttcccaagtaattaacttaaaaaatcagtaaaatattccaagagctaaaacacaataagtgtttctatcaatccaaaatcctccattaaagagttataaaggacacctttcccaatactttcccaggagatagtgaggacacctcgcctgcatgtagg

SEQ ID NO: 1335 - DNA, 1039 bp, Oryza sativa
gctgaggtctttgtatctaccttaaatccttacaggatgtttatacttaactagatgaataccccgccgtatttgctgcaggaaaatatatacaaataagctgtaatatattttctaagccaaaacaaaatgacttcctatgttctatataatttacacatggttgcaaatataatgcaaggtgaacatattttatgtaattgatacttatgaattttgagcctaaaaataattgagattgtatggttttatgagagaagaaagaagtgtttgtaccatagatctatcatccaaagagtagaaataattgggatgatgtagcttcatgagataagagagaaatagcattaactatacttagtgggaatgaactatataataatataggattcattcacatgaaaccaaagtttgatatttattgtgtaacatcatgacaggatattggccattcagcgctcatgtttgtggtttttggtttcttcctatggcttggcaattttcttgtaataaatgcaaggagttactgtgtggaaatgccagtaattctggtggtgctctctgtgtaaatcatgctggcctagaacactttaccatgggaaattcttattcgtccttacctatatttataggattaagttccattggtaggtgagtttcttattctaacgaatttatgtctgtttttctatttcacaacgacatttctcttagccagtgcagtgtccttgatatgtttatatatttaacatttggtttgttagactttagagctgtatgatttctccataagtgttatctgatttgtaccttactaagatacgagaatcacccttgatgaagttgacatctcgctcatgcccttagaagtatcgaccgctcacaaatgcgcattttgaatctgctgttgacaagctcactgttcttattttgtgcttattttcataactttaggagtcaaatttcttctatttcattagcaaaaatttgaattaggcctttcttggtatacttatcatgacatcaacctcctgcagca

SEQ ID NO: 1336 - DNA, 1501 bp, Oryza sativa
ttttagaaattatttaataattaaagaaagtgtgtgaataaaatctatgaaaaatttgaacttaaacatgagctagataaaatttcatcaaatactttgtgtgcccaagtattttcagaatttttcttggatttatttgagcattggaagtatttttaataaatggaacattatttcagcaattatttaaattaaaaagtcaattaaaatcctcttctttgtctcgggccgaatccggcccattcgctttcttcctctctcttccgccggcccaacccgagcctgcatcctctcttcctctctctgccgaagttctatttgcttccctccttcattgggccgaggaaatgaagcccggcaagaagtctgtcttgtctccctctactacagtgtcgcccctaacctccagccggtcgatctcctccctgccgtgcccgtgtacagcgccgcctccccaccaaattcgtcctctccgttgctcctctttccaaattagttgtgggaatggattcctctcgatctcctctatcttatccccaagaaacccccttgagtctcgtggtatatcgtgtggattcgacgcggttttgagttcctattttccggcgaacccaaactaatccgtcgccgattccatccgttcccgagccgatctctccctcttccggctataaatagcatcccctagccgtcctcttccgtttgcctcaagtcccaagccgagccatcgtccgtagcgccgccgccgcgtagccctagccgccgacgtcgccgacgccttccagccgcgccgcgccgcaactgtagccgtcgtcgccgcttcccgtcgccgccgtcgggtgtgcacggaggaggagtacctcggccgccccttagccgccgtcgcaagctgccggagcgccaccgccgccgtcgagccgagccgcgccgttgtcggagctcgttgccggccgctatacgtcgtcgtccgtcattatttcttgcaccggtgagttcgcgtcgtcgtcctcttcgcgtaggtgtcctcggatagtccaaccgagctcccttttgccggtggtcgcgtggagccgtgccatggccggcgatgatgtcagcgatgacgtcataaatctttttttagttttctctgttagctgaaaatcgattaaacttcggaaattcataacaaaatcatcgtaactcggattcgagtggttaaagttgctaaattcatctaaaatcgagatttacatgttaaaagtatccacatgtactgtttatgcttgttttgtactgttttgttgattttgttcatttactttagtttccgacgttctggaggagagcgtttacgttgaggaaggttcagaagcgtttgcggaagctcaaggcaagtcacacagatcccaaacaaccctttgtacatgttgaacccgtttaaagctaatattttatttcaacttatgcattattttcgaatgtcattgggtggtgagcctttcccatttaattctggccg

SEQ ID NO: 1337 - DNA, 1501 bp, Oryza sativa
gactgaatttaatactaaaatttattgtctctaaattttaagggccctgtattgtcagatactctctacagatgctaatacacggccctggaaggccaagccaagcctgagttgcagcccatgcatagtaagccatttctttaatctcttgtcttttacttctattttacataattacaaattcatttttcaatctactatcttgttcatatctaattttagataaaagggtaaactagttttcattttgatggatagttttattcaacttttggatcccactaacagttcttcactttaagtttagttctgtatttgccactgctcaccggcccagccccctcagccattgtactcgccccatttaacatatctatagcatatcgtcccggccgtaccgaaaacaatgtcatggttgtacttaaaagcctgccaaaatagtggtgtgatgaaaggttattttagaagtaacattattaatagtctattgttagaatattattaaacatgtttagaaatatgtctttttattattaaatgtacaaaaaatgatggatatatagatttatgtactttttttaaccaaaggtagtgggggaggcccccacggtatattaattttccagtagtatgtacaaagaaggaaaaagataaacaatgaaggaaaaaaaacatctaagttacagctgatctatccatgattgaactaggggcctgtaacattctttgagcctaattaaatgtaagctcaaatctaacttcaagttcatcaaccagttttgcactgagggctggatgccttagaagataagtccatttctctccttacagatattccatgaggcaattaagaatagatccataaagcaagaatgcaagacagccactttttgagcctggatcctttgatgaaaatccaagttagggttccatgtccatcccagacaattccaacaagccgcactaaaaggacaaaggaagaacaggagatctctagtttctctggcattagctgagcaagagagacaaaggactgaagtattgggtggcgcgcagtgctttctatcaaggagatcccttgtattaaccctgtccatgaagaagagccattcaaagaccttaattttcatattgactttggactgtcatatccatttgatagtaggtgggggagtgagagccagaaaactgagcttgtaacagagtcgcgaagtgaatttccctgatccccaaacaaatgtccatgaatcatcaacctcctgaagggtaaaggattggagattttcttgcatgtccttatattcatcaaacgcttgctgcgaaaggggaaggaaaaattgatcttggggacctctagctaagtgttgtgcaatataatcattcctatgctttgcgaaggagtataaatggggatatttgttgatagaatcatgtactttttatttttagtacctcatcatagctggacatatgttgataattttcctacttttagcatata

SEQ ID NO: 1338 - DNA, 1501 bp, Oryza sativa
aaggaatttggcatcgttgaatagcctcatcaccgtcgcagaccacccatcgcctgatctgcgcctgctgctacccatctgcttgctagccggggccgatcgatcgagaggcccaatcagtgatcagcttgcgagcatggcgacggacatggaggtggacgagatgcgccggtgccggcgatcgtcgggaggaagaggtgcgcggcggaggaccggaggatggagtcggatttgcggcaggaggcggagctccgtgcgaaggcgctcaaggacaacacgtggggggagatggtggcctgcgacgacccctggctgaaggagatcttgcggaggaggtgcgtgaacgcaatgcggacgagggccctccacgcccagatcaccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatat

SEQ ID NO: 1339 - DNA, 1501 bp, Oryza sativa
caaatcgaatcccccaccttccccgcaaatctcccaacccccccccccccttccctctcgccgccgtcgccgtcgccgcccggcgcctaggtaaaagtggatccctcttccgccgggcgcttctgagctccagatgattcgtgcgatcgatgcgtgtagttcttttttttttttgtcggcgtgtttgcttcgtgattgccgcggctcggtgtgagcgagggatttgttcgttgggtttgagtgattgggatcgtcggatacgtggagggagacgtttagggtttggttgggttgggtctgcgctgccgggggggattcgtctacggagcgaggttatcgtcccttctctgggcgttgtgcccttttagatttgatgatgatggttgggtgttccttgatattggttcgatgtagacgaatgttatagctctagggtttgctttgttaagctgtattgagatctgttagtgttacttcattcacatgcctcctattttcactgctatcaccgcctggtgcatttcctagcaattgctaatcaaacgttaattcatttcttcactctaggtcaatgcgctgtggaggattatgttttactgtatgcgtatgaacagccatgttggcattttgttgtatcacgattgtattctggattgtttttctttttactgttagactattgttgtgttaatctagaactgattaatgcggacacctcttcagaatacttatcatgaatggaatctgtgtgcgtacttttctaataaattcaattttccaccataataatattcatactcatgtgggatgtatcatttttacatagggattgcttttttacgaaattctaattcaatattttttttaattcttaaatctatgtatactggcccagggagcatctattttgatgtcctccacagtttgtatttactcctttcccgtttacggttctaagacctccattgcttcatatctatttcagatatatgtattaactgttctaagcaacacaactatttctcgtcaaggatcttgggagtttttgaaatagttgcataatggagttgtcaaatcaagggcagacacccatgtcaactaacatgggttctcaaccattgccttcttcaaatattcaacctaatcaggctgagtatccgtctatgttttatccatctttgcctgctgactggggtgcacagccaatgttttctatgggagcttctgttccaattagttcgtattttattgttcctatgagtcaacaatcggtccaaattggtgcttctaggccagagactccgcgttcttcaggggcacattctctaagcagagtatcattgaggccaccccagcaagtgctaagtattcgaacatctttgccaacaatggttggatcacaacactctcctgctggcaagaaactgcaaccgacaattgcttctccaaaggttcaaatactgaaatctacacagtcacagtcatcgaacaaacgttctgc

SEQ ID NO: 1340 - DNA, 1501 bp, Oryza sativa
ccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatatagtccatgggaaaaaaaagaaaaaaaggaataaaaaaacgtcacaacgccaataaaaaaaaagaaaaaagaaacatcgcgtctacacgggcctccgtttggcggcgtcgtaggcgcgtatgcgctagatagcttttccggacatgaatacctacctgaagctcaatcctctcactctttttttttcttttttgcttattcatctaaatactaacaagttgaataaactagatatcatgaccatccaaatgtgaaatgatattacaattaggcaaaaatcaacgacctcttccattcttcaatcaagaaaaaagaactgaatttcattctgccacaaaaatattgcattactgaactacaggcccaatactgaatgttgg

SEQ ID NO: 1341 - DNA, 1501 bp, Oryza sativa
ctatctactactccctccgccctaaaatataagtgtttttaattagatgagacacattctactatgtggatagattatcatacaaaacataaggcagcaagatcatttgaaccaagggactagggtagtacatagagaggaacggatcatgaagttaaccaagccataacaactttgtcacacataaatcgacgtatacattcaagacttcgggttggccatagcttcgttgaaacaaaagtagaaataacctaagtgagcaatagtttaactgattaggtttcttgtgatagaatttccctctgaatttctaaatgtttaaatttatagctgattattttttttattgctaggcaatgtaattgttgacaatgagatgtccgtgttgatttcatcaatattaagatataccaatccaatcttttaatatggtgtgcatatgtgtatttatagaagtgagtatatgaacgtttacgtttgtactgtgttctaaaaaatcgaaataaattttactacagtattaaaaaaaacttgtggttgtacgcacatatagcctagtcataccagccggcagtggctcgtcggcaaaaactccatcaaattttaatattgatgtgtaaattgatggtgaaatttatagagtaaatactatgaatccagttactctgcagtaatgttgagcaacattggtgatgtgaggagaacagtgaacgaatgcattgagcatcagcgctctactgtagctacagtatagtagatgttgctttacagcagaatttactgtagcagatcatccgaaccatcaatcacacaaccaacgatacacagtatccctaatgccatatattgtacctctctgccgtattacatttacatgctactcctataatatattaatatattatagtaacataatatcggatgagacatttcatattataatgtagacaccctcttatctagtatattcgttgtactatgaaatatctcatccgatactagtttattatattatgggagagagagagagtactgtaatagaggatcccaatccaaatacgaagttatattgaaatctattcgggttaaaagaaaatcttaagcgacgggcgccttcgtgactcctcatttgcatccaattttccccctgacccaaccgtgtgcccgcgccgccgaatacaatagaaacacacgcaaattaaaacacacctccaaaaccacgcgacgcgacgcgacccccggttcccctcaaaccaaacggttcgccgcaattcccaccccccccccccccctcccccaaaacactgccgcaccacgcctcgttcccgcggactccgacctctcccgaatccctttctctcctttgcccgcctatttaaacctctccctctattcccaaaccccaacatctccacttgactaatccacagttccactctctgattctcaattttcaatttcttaatagagaagaagcgatcggattaagcgatgagtgatg

SEQ ID NO: 1342 - DNA, 1501 bp, Oryza sativa
aaagatgctaatctatacattaggtttccaaccatggctgtgctgtttaactctgtttatgctttcctgatcaaaagcttgacagtagaattcatgtttgtaacttgtaaaaaataactggtgtttacaaaaccactaactctctaaaaaaaagaaatttatatttagaattatctgcttaaatcatgtagttcaggaattcggtaagacgatttcaagtatttgcaagaacagcttgatgggagttgcttaatgcttttgtatgggatgatgcaattcctatgaaaatcttgtagaaaacttccaaggaaagacttagctactattgccagttcaacgtactctgacaaaaaaaatagtaatataaagataatctgcaatcaaatattctcagttggcgaacgcctgaacgggatatgctgatgcaaaagatatatattctccgaactcagatcatcttatggaaaaaaagaactgatttgccatatgattggttgcttcaaacctctaattgtgtgacacattgccccatagtgcttgatgtgccattgagatgatgtttacatccaatatatggattattggatgctggggcataaacaatgagtcactgaaaacaacatcttctgaaaatgtcaaaataatatttacaatcggtatgtaaattcaacttcaattgagctattctatctctaactttgaatcatgcacgcctggtttaaagagattaattgaactgtggttcattttgcttggatatgataccaatgagctatcactaattcggtggcaggtcaccttaatgaatattaaccatggattgtgattgatgaattattagaagtttagaacagtctaactaatctaaaatctgcacctgaatggatcaatggaaggataagggctagccacttttatggtctgaaattgatatgttttcgcactaactgcagatatatattagcctgcatctttacattcccataaaccatatattattatattttggagtcagtatgaatgcaaaatctgtgatatgatataggagtatatatacttttttcaaaagtagtttttctacctctgcacatcttcttacacattaatcttcagaagctgaatcttaagcctgtaaaatatttgactacaattactacttttttttactgttaaatatttgatacaccaaactgaagcactacagttactatctaagggcctattcggtttggaggatttacgcgagaattttggaggaattgaactgtcctgtgaaaattctgtaaaattcctacattccgaagatggctaggttccttgtggtggaaccagtccacctgggttcaaatcctagatttgacacgggtgctcgcatttacggttaattattcttttagtaatagaccatgtacctatcaacagcgatgcgtctgtggtaactttgttaatctcaagatacgttgacttagtcttccggaggtgctcatatggatagggtgtg

SEQ ID NO: 1343 - DNA, 1501 bp, Oryza sativa
ggaggagaaggttgtgtttgtggcctgtgggacgccggaagggaatgataggatagagagggagaaaatatgaacattggggtttgcagcaccttatgtgccaactgttcacaacacgaaaaactcttgctgtggcaactgaatctgtgatatctgcaatatttgacatgataagttttatcaagagtaattttttagataaggaagatatttaaaattatcatttgtaatccaaagctagacttagatcatgcctagctagatcattaacatgcgcatgttcacacgcatttttttccttgtcctagtatgccttatgatgtattctgataagaaaaatcaccatgttaacacttatgtagcacaatttcctgtgggttaagaatcaatacaccatcgtatcgttgcatgttgttattatgaatacaatctgtaatttcacatcatacactaaatctattttgtaacttcacatcaaaattttaatctattatgtgttataactagctaaaattttgtgaggggggatgagaactctaaagagatgaactttgccttgcttctatggttttgaaagtgtgagaacatgtttacaaatgtaaaatacagaatgccatgcaatgcaactactcaaatagaccaacagtttgggtttttccatccatggaattttgttgcccttcatgcacattaactgcactacaaattagcatgtattctgatagttctacatattgctacagtttttttccccttatagtatatatcgttctgtacttcttttgtatacattagcatgtttcaaaatcactagctacttgcttcagttggttttcgcacaatattaccgatgattatattatcaacaactgcttaactagactacaaaacatgcacttctagtagttgcctttttctgctgttgttttattgcattaggataaaaacagtctgacatgcatgtattttcttttccaaaatccagacttgcttttaattggttggtggtagcatattagcatcagttagaagggtgcacatacctgcccaatgagggtgcacatacctgcccaatgtgtactgtgaatattcctctgcatcctgtaccaccagtttaactagctcacaagtcggtggttattatcttagcttctactagtagataccagcatgcatgtgttccccaattataatgtactatgttgtcttcttactgtgacaggaaaatggtataggatgagcgacgctgaagagagtctgcctccgcgttctcaactgcactactccaagaaggagaaggaaggggtatttaatatgaacaatattagcacaagttataatgatgtaggtggccataacattgaagtaggcagaagggcattcaagaattgtcaccaatccctactcatggcagaagagttggtcagacagaagcgcctgaaggaagaacttgggtcaggcccattgagtctgccggtcgtgaccatctcagaatccatcc

SEQ ID NO: 1344 - DNA, 1501 bp, Oryza sativa
tcagacacaagtatcataccttcaatttggacttgctctggatatatgcaatatgaattcgtgattatgggtctattttctatgctcaaagactggactatttattattccccgtaagggttatcaactgaatacttgcgccagtcgggattcaattgttacatctattttggagtatcccataagggataatcactcagatcagaagcgattgatatgagctatacttggtctatatcacccgttccaaatttattactcggaagcatgttacatgcgtcatcctttaaagggtgtcgaaggcatattttttggcctaggcctaatatgtctgcagcccatattttcaggtgtggcctgtcacgttcttatagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgactatatattgtggtctttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggagggttcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctgattcgagagaagattatcttttcgactacgaaggtctcaggggctactgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcata

SEQ ID NO: 1345 - DNA, 1501 bp, Oryza sativa
gctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctgcaagtccaggtgtactggttgaattagatagaaatattgtagagcacctaaacatgtgctgctgggtagctacaaccaaatattgaaaatcaaacctttccaaaagagtacaagccaaatattgctgtgtgtggagattatgggtaccccatacccacacggcatggttatccgactagttataggggataacttgtatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcataca

SEQ ID NO: 1346 - DNA, 1501 bp, Oryza sativa
gaaatgagaagttctacagttcttaaacctccaaaacaagagccaagaacatccacagttcacactgccagcacctgaagaccctacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagg

SEQ ID NO: 1347 - DNA, 1501 bp, Oryza sativa
gcttttgttagatttcaaagtggatcgggtgttttcaaaacaaccttgaaattacacgtaaaaccactcaaataactaaagattaatagggcaaatcgatcaggtcaatgttgtttaattatacattataaaaaaatttcttctagtgaattttagaaatataaatcttataatgttacactatatggatttatagaaactaatagtagtaaaaaaaatgctacttacgacaaaggttaattatcgttacttgaaaaggatcaggaagtgtttatattaatgtataaacatgcgcttaaatggtcatccttttaagtggcgaacactgaacacacatgcatgattaaatataggtgtgcttatgaaataaactagtaacacaatactatcgactagagtagatggtttgggcatgtttcgccattataccatggggactaaaattcatgagggctttatatcagggcttttattggttgattaaattaccattattactgtaagtaatcaaagaaatgatttagtttagttaaattcaccaaactgtctaactaacgtcttgtcgtatatgggtgaggcctagtgcctgcttgcaagactcggactggtggtcatggcttacgtacgtgaacagcgcgcagtggattagtaggcttaattactcagataattaactagtactccctcgttttggactataatcattttgtctttgttaaagttaaattattttaaatttaattaaatttattgaaaaaaataataacatttttaacccaaaataaatatattatgaaaatatatttaattacagatttaataaaattaatttggtgttgtaaatattattatatttatgtataaatttaattaaacttataatagtttgattctaatcgaattaaaaacgatttataatttaaaacggagagagtaatatataagacggattaacgtgggtcatgcagccccctgtcgcgtccgccattctcttttgttgtaagaaaaaataatctgagattgcaatgatgatatgcacagtcatttaaaattttgtctcaaaatgcatcataaaaagaataaaaaacacacgcaaattaccatgttcgaacaatattttttacaacttatttgcatgtattttgagttgaaaacttagtacgtgtgatgcatatgttctcactcaatcacaaaagcacgtttgtgcctgatcgaaacatcaaccttagttgtccgcaaccagcttcaaactctttccagattgacatcttgtgcctagctatcatctatttactggtattatgcttacccttggtagccctgcttggtctggaactggaggcctcactatcatgagttccactccttggtgcaggtaatgacatcccctccatccatcggagaatgccaagaagtgcagccatctcatcaatggacatcgtgctaaattcttctggaacactattgttcaacaatccttcagaaagcgtgccccattttg

SEQ ID NO: 1348 - DNA, 1245 bp, Oryza sativa
ggcgaaggagtatgcgaaaacaggcgaagaagaagagcttaagcatgcaggatgctcagagccgcctcctccggcgagctcacctttgccaaatcctgcacgccacacgtagtctcttcctggaaagaacgaaccagcggtgtggacgtcgtcttgtccacggtggtggcgtgctgctccttgacgacggacaggaggaactccacggcgccgggcgcgccctggacgcaccgctggacgggagcaaggtcggaagaactccacgtacgcgaacgggagcaaggtcgccgcccgcctcacccgccttttccgccgttctcctcgccgccccggtgcgctcgtctgccgtgggcccgcagccgctccgcccaccggccgccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaattcggccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaatgtaaaaagttagggtggtgggaatcgaacccagctggccaaagcaaagtttcactccgctaaccaagttggcaagctgctagttgtgttcaataattcaatcaattaatacatattctatatcaatcgtgattttgaagtagattgaaaatggtccgactcgactattgagccgattaaaaatgattttagcaacgtttgaacaggatgacggacggaaaaaaaatccggaaaccttacgtattttttattaggggtgtgtgtgtctatatatatatatatatatatatacatatatatatatatatatgtatatatatatatatatacatatatatatacatatatatatacatatatatatatatatatattgtcagggttacggataaggtataccctctatccttagacgtacgatgagtattgata

SEQ ID NO: 1349 - DNA, 1501 bp, Oryza sativa
tggtttttctatacctcattcctacaaaccgaatggcacttgtagtagttaatcattaggaatctaaattctttgtttttcttcaaaccgaattggtttagatagatccttaatttgcagcccttagaggatgcaatttttctttttgctatattcaatgaatgaaatagcaccgtctttgtgtctattcatttaaaaaaaatgattacttttgactggatctctacacgatatgcattggtgcagtacaataatagagatcatcttgcttcttattatattcagcttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgttagtcaacgcttggcgctaactaccaatcaacgacagaccgtggtttagtttgcagatgatggcatgggtctaggtccggtcaaggaagggtgggctcctccccatcccagagaagaatagtagagtcaggtgcatgtggtttcccttgaggtataataaggaggaccttgcccaccgaaaagggggggaccaagagaaaaaacctgagctcaaggagaaaggaagtaagggcactctctggggcttaaggacctttgtaacttgagcctaaatcccatacacagcagtagggtattacgctccttagcagcacgaacctgtataatcttgttgtgtgcacattagctggtagtctaggggacggatacgtgatttccagaggcgggccttttcccccggccgaactcacgaaagggggatcccacgatctcccgctagagaggatcattcctcgacagctggcgcgccaggtagggggatttcgcgcgcttcgaagagaagtcgtttccttccgctccaagccttcctccggccccaacgatcatggtggaggttt

SEQ ID NO: 1350 - DNA, 1160 bp, Oryza sativa
ccgcgcccccactgctgggagacgccgcccccgcgagacaacgccgctgccgccacaccgccgccgcgcccccacactgccgggccggcccacggcgccggaccgcgcccccaccgccgtgaacgcgaatgaaacatgaacgaacgtgaacgaacgcgaacgaacgtgactgaaacgtgaacgaacgtgagtgttagtgaacgaacgtgaacgaacgtaaacgaacgtgaatgaaacgcgaacaaacgtgattgaaacgttaacgaacgtgaatgcacttgaactaaaagtgttagaacgaatgcgagcgaaacatgtacgaacgagataattaaactattgttgaacttagcatatatatatgattatatatacttgaaaacgtgaaatacattatatgttcctttgcgtttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttagcatatgtgagtgttagatattattagattattagactagcatatttgagtgttagagatagttagagatttaatacaagattattagaggtttaatatacaaaacttaattagacttagcatatgtgagtgttagagatttaatataagattattagagatgtaatattcgaaacttagttagacttagcatatatgattatctatcgtacaaatacacgacacttagacttagcatatttgagtgttagagatagttagagatttaatataagattattagaggtttaatatacgaaacttaattagacttagcatatgtgagtgttagagatttaatataagattattagagatgtaatattcaaaacatatttgattgttagagatttaatataagattattagagatgtaatattcgaaacttaattagacttagcatataagattatctaccatacaaatacatgacacttagacttagcatatatgattatttgagttttaatacaagattagtagagtgttaatattatgcttagcaaatatttcttctatgaacaga

SEQ ID NO: 1351 - DNA, 1501 bp, Oryza sativa
tgggtacgtcacctacaactgaatgcacacacacatacctacgactatttccgaaagactgggcctgcatattttgagattaaagaaatcaccacggatgcctcactattgatgggtacgtcacctacaactgaaagaacaattaatcgtaaatgcaagcacccatatcaagtataggacttgaacccaggtggcaagttccagaacaagaaacctaaccagttgagctacgcttgctttgcaataatgttggatactaaaacaactataattttttagatctatcttattaaaaaaacaagtgtgtattcatggtacatcacatttcaaaaatgttactgcgcaattatatttcatcgttatcgtattcatgttaagctgcgtggaggttctgacccactctacatgaaatgttcatagatggatcacctctcaaactacatcaattataagagtctatataaacctatacatttagtggagtttcatgtctaacacaattcatcctctaataaaccatgataatatatgcaactaagaaaagaaaaacaccttaattttactttacacttacttttactttcgttaacatgttttcttaagaaaagaagtctaccttcttttcaattgcttatagatgttacttaattatgatataatataaagctaataggttagaaaattataaaagcaattaatgccgacgtaaacaatttatggagaaatcgtggcagatgttatccgtttaatatttcactcttataagtgtcttgaactaagcgtaagacacatgtccgcgtgaaagcgtgggctaccttcctagtttcttttaaaggcagatcgagttggtgcaggtatgacgtattgtacgcggtagcttgcagaggtaaatttggactagaaaacttagttaaccgagatcgatcgatcgagctgagtcgctagctagctagggaactcatctatatattacactaccaactaaatatcaccatatataatactccctccgtattttaatgtatgacgccgttgactattcgaccaacgtttgaccatttgttttattcaaaatttttatgcaaatatgaaaatatttatgttatgcttaaagaacatttgatgacgaatcaagttataataaaataaatgataattacataaattttttgaataagacgaatggtcaaacattgaacaaaaagtcaacagcgtcatagattaaaatatggaggtttctttctgtggagattatgggtgccccatacccacacggcgtggttatccgactggttatagcggataacttatatctatggaatatgtaacggatcatgacttgggtattacgtttcctttatattatggaatagcctaaagttctggtttgattatgttgtaaagtagatttaggaaaccgataccgtattggttaaggtttctatcttgtaatcctgccccccatcctatataaggtgggcaggaggccctctagggggca

SEQ ID NO: 1352 - DNA, 1501 bp, Oryza sativa
tattgaaagatgagtttagagtccacatagaaatacaattagaaataataaaaattcagaaataaaaataataatattagaagaagagcctaagtatatatagaaatacaatttacagaaaattcagaattaaaaaaaatattaaaagacgagtctggagtccatataggaatatatataatctacaaataattaacatttaatattaaaaataattaatagctaacacatatatgaaatacaatatgaatattacacattagtagtttcgtaaagatagtacaaaatttaaaattatgtcgctcattttacatatttgaataatacattgagaaaatatatatgctcttatagagagaaaatataatgatgctagccgcacaatctgcgcggaccaccatactagttattaaataaagagaatacctgcaatgtgactgattcctgagatcctgtttcatacaaaaagatctttttgttgttcggtagtttcaccgactgatattccgctaatctccagtctccacagttcaccatctcccttcccacctccgaatgctcttcttccatcatctccattgctcactgcctcactctcgtcagctctctctctctctctctgctagtgcttctaggatccatcatccatggctgcttgcaaagtctacttcttgtgcagcatattgtaggattctattgtttgagaacattttagggagttgcatgttacaggtaaaccgcacttctttttcctgaatcaattctacatatgagctttttttcatgcacaaaaaaagtatataggcattgaatgaatctacttgttcttttttagtagtgagaggtctttttccacttgacaaaatgagaggtctgtttccttaattcagttaaccttcgttctgcaaaggatggttcagtgctttctgttactttgtttgccgatgtactggcgattattccctgaactctgtcttaccttataatgaaaaaagttcatgaaacagagtacaattgttcaaggttatttctgttttacacttcacttcttagttctgtgtttttcgtttatttattttcatgattgattttttttagacaatggcttttatgattgaatatgacaagaaacaggggtagctctaaatctaaatatccaagaaaaagactgtgatagttgacaaaaatatactcatggatgctcattactttttactacagttcaatgcatgtgtaactatagatatatgctttccttgtctacaaagtagggaatctgagggagcaaaaagtttatcacatggagggagcagatgaggagaggccactaattcatcacctgcctccacaggtactattctattaccttaagttggtaccaaatatattgcatctccatgtgacacatgacatgtaaagtcgataattaatttggcttcagtttatcagaaagaaacaagaaatacatgagttctcgcagcaaatttgcacatacatttaa

SEQ ID NO: 1353 - DNA, 1501 bp, Oryza sativa
atgccctcatggttatggatgatgggatggtcgaacgcaagcagcactgtggttggcgtcatggcactaagcttgtccataggcgacagaacgatcttgctgccggaagtcttcaccggcggcagcgttggccggacgaccaccggcgccgacttgctcaccacaatgctcatactttctctatgtctaggctctagctcgatctgagaataagttaggacaagcattacggatcatgtatatatagaaccatacatgccggagttagcccttttaaagtgctatcttacctctatgccgccgtaagagaatccctcgccggccacggttatattgatacaagatttttcctataatgtggaaaaacagaaggttgtattgacgacagatttgcctctaatgtgggaaaaacagaaggcctagctgatcctctacacggctgtgtcatcagtctgcaggttaatatcctagacgaccctcacgttaggaggggttttcggcgcacttgatgaagggccgctgcccaccaatacgagggccgccggtgcaccagatggacggtcgctggcactatggatggaatgaaggcggcgcgggagatggcgaatgaaacggcacggacggaggattggaggcgacccagtggaaatcctaagtggcgaagtgacggcggcgtgtgcgagctagcgtgagaaagaaaatgatgacgagagaaggggaaaaaaggaagcaggcagaagaaaaaatggtgccaatagaaagaaattagcatggacaggtaaaaaagtggcgcgataatcgagtgtcattgggagggcgtacatgttcccaagttctgggcgagattggcactgcttttaggtgtgggtaaattttaggaccttggctgggaatctgttagaggcctgattttgatataaatcctaaaatttacattttagaaaacctgtttaggcctctcttgaatagcaagatgctcttgtcttttcaaatcgatattaactgttaacaggtaattgtttttttaatttaaaatttatttgcttgtgtctattaaaaaaatggcttgaatgaaaaagaggaatacacgtaatagcaagtttaatagtagatcagctaaatactagctatagctcatctgaaaataatatctagctaaatactagctataagctcatctgaaaataatatcgtatatctatataatctaatactaaaagtccattaaattttttaaaaacactcataaaccaacatgtgacactcttacaaatgctcatatgccatcacacggtactctaataaattagagaaaccttacaaatctataaaaaaacatacaatccttgattttaatttaattagtgaatcttttatattttaaattattagattagatttatttaaaatacatccagctaacctcccttgaattttagaaaactgaattgctcccgtgagtagtactatgtagtacgtagcgtacgtagtacttcacgga

SEQ ID NO: 1354 - DNA, 1501 bp, Oryza sativa
tacgctacgtactacatagtactactcacgggagcaattcagttttctaaaattcaagggaggttagctggatgtattttaaataaatctaatctaataatttaaaatataaaagattcactaattaaattaaaatcaaggattgtatgtttttttatagatttgtaaggtttctctaatttattagagtaccgtgtgatggcatatgagcatttgtaagagtgtcacatgttggtttatgagtgtttttaaaaaatttaatggacttttagtattagattatatagatatacgatattattttcagatgagcttatagctagtatttagctagatattattttcagatgagctatagctagtatttagctgatctactattaaacttgctattacgtgtattcctctttttcattcaagccatttttttaatagacacaagcaaataaattttaaattaaaaaaacaattacctgttaacagttaatatcgatttgaaaagacaagagcatcttgctattcaagagaggcctaaacaggttttctaaaatgtaaattttaggatttatatcaaaatcaggcctctaacagattcccagccaaggtcctaaaatttacccacacctaaaagcagtgccaatctcgcccagaacttgggaacatgtacgccctcccaatgacactcgattatcgcgccacttttttacctgtccatgctaatttctttctattggcaccattttttcttctgcctgcttccttttttccccttctctcgtcatcattttctttctcacgctagctcgcacacgccgccgtcacttcgccacttaggatttccactgggtcgcctccaatcctccgtccgtgccgtttcattcgccatctcccgcgccgccttcattccatccatagtgccagcgaccgtccatctggtgcaccggcggccctcgtattggtgggcagcggcccttcatcaagtgcgccgaaaacccctcctaacgtgagggtcgtctaggatattaacctgcagactgatgacacagccgtgtagaggatcagctaggccttctgtttttcccacattagaggcaaatctgtcgtcaatacaaccttctgtttttccacattataggaaaaatcttgtatcaatataaccgtggccggcgagggattctcttacggcggcatagaggtaagatagcactttaaaagggctaactccggcatgtatggttctatatatacatgatccgtaatgcttgtcctaacttattctcagatcgagctagagcctagacatagagaaagtatgagcattgtggtgagcaagtcggcgccggtggtcgtccggccaacgctgccgccggtgaagacttccggcagcaagatcgttctgtcgcctatggacaagcttagtgccatgacgccaaccacagtgctgcttgcgttcgaccatcccatcatccataaccatgagggcatccgatcatcctgcatt

SEQ ID NO: 1355 - DNA, 1501 bp, Oryza sativa
acgccaggttcatggtttcggtggccctgccaccttccttctccgttggaaccatcaccatctgggacggcgacttggtggcaccggtgagatatccttccatacgtgcgcccctgatcacggtaaggaagttgctgtgggtaagtttgtctaggatcgcttgcctagagaggggattggaggtggcactactgatggaggaagccatcgcccatagatgcaacctcggcgtggcagataggccctgataccatatagaaattatgtaagcattatcacctcgtctcgaggccgcgtaattgtatttatatgagttgggaatagctcccaaacgtggcttacaagaatgagatcggatcagccagagttcggttgtaacagcccaaccttatgtcaaccaatccatatcacatgtgatatttcatgtaacaaactaatggctaaacattatctctaacagtgccctcccctcctccagatccgatgggaggggatacggcggtggcccggcggcggcggcctctccttacctcctcgtcgtggcctgtgaagactagctctacccccccctctctcctctcacctcagtggccactagcgtggaggtgggccaccggatctacccacttctgcgatgttgtcctgctgcttctacctccggtgagtacatgtgccgacgcacatcctctttctctttccatccatctctttctacccgcaccatttctttcccttaacattatcttgatttctagatttggaagaagcttttctctagtagatccaaccgacgacgcgcacggagggatggaggcggagcaatttttgaattttttttaacactaattttggatttattttttatggctgtgaagcatctgctcggcccaaattgagttgagctagttttttttttcaaatcatatacatcaaaggtgccggttcttaaactgacacctttgagtcattctcatcagtgtcgtctccatggtgccagttgggaaatccggcaccgatgggggttacccaaccagcaccaatagcccattctttagtagtgcgaatatcaccatcaatactggttttatctgttagagaagtcactatgcccggttttacggataaggaatataaataggattaaacttatatctgagagagttatattggcctttttccttagtaaaatgcccaaaacagaaaaccctggtcttaacctctcatccgttacgctagcattgctcctattccataaaaagataaaaatgaagaaaaaagtttaatcacttctaaataacgattatacccgttcaaacttttttttataataatacaccttcaagtttatactgccactaactagagtggtaatataaatagatctaaatccttctatcaaatgagatcgacggtttagattgcttcttactaccagtacagagcatgagcatcctagtgggactataattaagtgagggtgtgagatggagtccaggcgttg

SEQ ID NO: 1356 - DNA, 1501 bp, Oryza sativa
aaaaaagtcaaataagtcagtgctatgtttcatattttaagctaaacccttagccatcaacatctggtgttgaacttgaatttaattgtttgcaaccggtacgatcaacagccattcgcatcattatctaaaacaaatgatcatcaggcattgcatatgttgagtatgaaaactttcttgctactgaaaaattaacgcagaatacttccaagaaagggtaagaaaatattaacatataacaaaatctaaaaaataatattactacctccatctcaaaatatagtaatcttatactagatgcaatggaatctactttcctccgtttcacaatgtaagtcatcctcacttacattgtgaaacaaagtgagtatctagattggaagtcctaacatgtattacattggtcctaaaagtgatatattttaggatggaggagtaacatgcattattaaagcagctcatcaatgccactctggttcttgttagagcatgtagcccagctcacacaagtagtccaacttgtcacattagatccgctccaccatatatctaatcggaaccataactttaggtttcgagactacacatcccaaaagacgttatatatagtcgcctcgcgttgtccatggatatacttcatctatcattgaaagtgttggcaccttttttggcaagaagacaattatgatcgggacacctaaacatgttgtggtgatatggagtcacaaccacctcgatctagaccaagaagggtttttttaaaactaaaccggctagcggagccggtttagagatcaaaatcagcctctaggtcgatttagattgagatggacgaactattaaaactaaacccatctcgtgggtgaattggaaagtttaaagaacaaacctacaaagggcatcacactctcacagcgaaggcggacaatttatggcgcaaatcaacaaatatggatgaactattactaggtagaagataaagtagaaagcatggctaaaaagcaaagataaaagaacgattcaatagattatagggattgtggtctatggttagaatcgaaccagccatagcccttataaaggggtcgctcttgccatctacggaccctttccatgtcttacttggggtagagaccaattagaactcaagaaataccttccgaagcaaggaaacctgagacccgacaaaattggactcggcgtcagactgagccagtctgaccggcccaacaccccggccttatgacggcggttagaccggccccgtgaaggataccggatcatttccaaattcgtccatattttcctatttttgttctaggtgccaaatttgggtgttaacacatgccccctacctttttggcgaacttgcgagccgaaaagcatacaacacatggtcttagggtgacaatctatattggccataagggcttccaagtgcctagtagatctttctctttagagcactgctcccgtcctgcattttgtaccgcatggtaca

SEQ ID NO: 1357 - DNA, 1501 bp, Oryza sativa
acctttcatatattggaatgcactataaaaatagagtagttgattggaggattgaatagtaaagagagtctcacccctaaactttgtgtttctattttctgtagaattacgggaccctcttggactgcttcgtgtagcaggagggttgcgtaatacccctgaccctaaaggttccacaaccctgactagggtatcattattacgaagtagagaagaagatgaggcactggaaggctgttatatgtccaagaaacattagctgccaccatcactttgggatggagagaaaaaagattgaaacaactaccatgtcaaacgaactctgaccatcgttgctactcatttgtacagttgattggaggattaaataataaagagtctcacccctaaactttatgtctccactttctgtagaattacgtgaccctcttggactgcttcgtgtagcatgagggttgcttaatacgttatcgggtacgaagctctactggaccctcttgaagtgcttcgtgaatcctctttgcatcttgtagattgaatttagaaaaaaggaaatctttgcatgttcctcgttccgtttttgtaactcccgatgaaaaccgccgtcgccgaggtggagtcgtcggcatctagttgattggggttttctcggcatcatccatcatggcagagacgaacctcaccaatgcaagcacggatcggagacacgacgcagcatggcatcacgttgcgacgccgaccacgccgccgcaccgccgtgagccgccgccggctgtgccccgcacggcaccgccgcccgccgtcgtagcagccgttcgcattgccgcgagctgccgccggccgcgccccgcccggcgtcgccgcacgccgcgcgcggctgccgcgagcttccaacagccgcgccccgcacagcgccgctgcccgattccacgcccaccgcacagcgcctctagcgcccgcgcgcgcaccgcaacgccgcaatgtcggccgcgccccgcatggcgctgccgcatgcgccgccgctgccgcgcgcgccaccacgcgcagccgcgcaccgccgccggccgcaccccgcatggccccgcaggaaagaagaagaaagaaggaaatagattggcgattttgcagaaaggctcctagattttctaaaaattacgcgcataactcccagcgtggaaaccttttgcgcataggaccgtagaatttcggaaacgttcatttttatccattccccgcatgtaaaacttagaaataggcccttgaattttacaaatgtcgcttatattccatatttaagcattttctgtcttataaaatttgaatttaaatttattaaggcatttattactgttaatgaatatttttaatttttcgttttcagtatttatatgaatatatgcaacttttgcaccttttctttttgtatgaatatttgtatgcattttaatatgaactctagtatttatttatttaatattttgcactttttattcgcattccc

SEQ ID NO: 1358 - DNA, 1501 bp, Oryza sativa
tcctcccaaacgaatacaccctaaaccaaacaatccctcagtataaaaggaagaaaaacatgtgactaaacatggttgaactcaagcaagcgcttcactacagcgcacatccacattcttgcgctcgtcgtggcctatctccttctcgaggttttgactcttgacactatagcctataatcccatgtgaatgcaaccatggtcagagttcctttgacatggtagttgtttcaatcttttttctctccatcccaaagtgatggtggcagctaatgtttcttggacatataacagccttccagtgcctcatcttcttctctacttcttaataatgataccctggtcagggttgtggaacctttagggtcaagggtattacgcaaccctcctgctacacaaagcagttcaagagggtcccgtaattctacagaaaatattggagacacaaagtttaggggtgagactctctttactattcaatcctccaatcaactgtacaaatgattagccccctcctctctttatatagtgcattccaatatatgaaaggttcgttgatgggcccattaagtgtatttgggccaggccttcatcggccaagcctaaagtttcttaacactcccccttgggcactcaccgcgtgatgtctatgcctcgttaaaactccataaaaacccagtgggaaaaattgcagaaagagtacatagcatacgcatgtatgtcacatagattgccttattaaaaaccttgataagaaactgcaagaaaacttatctaagggaaaaagagtacaatttacccaaattcttgtatcgattttcttaatcgtttttgggtacttgattctttagttcatgcttttgttaatagactggcagaattccccccttgaattttgcatctcttttaagtgtgaaccatcaaaactcgttgctcttatgttttcaaaagatagtccgagtgatgcttcaatggtcaaatcttgcatgatttttccataacttgtagagatcatacaatctattagtgttggtgtgacgcacatatcattatcttcttgataatgattttggggtttgggcaaagctcgaaccatgttacttgctagaaatggtgaactatatccaaggaacctatgtattctcacattctgatattctatggttcacttcttcatgtgttgtaggtttatgagccaaagaaacgtaggtttctacctattttatctcaaacttgttcggaaagagtgagctttctttctttatgcgatgatattaagatcatcaacttggtttgggacttttaatgcttgtatgcgagtgcccaatccaaaatttctttaaccattcattgtcaactacaggtcagctttgcgggttgatcttttagttgattttaaactccaggttgactgccaatgatttgctgtatgaagagaatatttcccatagcaggtctcattaccaattcctattggttgtatgtgacacttatgtgagtat

SEQ ID NO: 1359 - DNA, 1501 bp, Oryza sativa
gcgcgagtcaatcttgtatgctgcttggtagtattacagaacacagcaattaagaagagggtcatcaagtgcaagaggcacccacacatggaaggtggcaagggcatgcatgcattttctagctgcacccatcaggtactgtcatgaggccaacatgtgggtcccactgggcagtgatataagctaggaaattggcattaatttgggtagtactgaggaagttatttcaaaaaacatacaaactctgaaggctagagaggaggctcaagccttgatctgtgtggctcaagagagattgaaaaagaaagaggtagaagataggttaccaagtgcaattgaaatagatggctgtgtgtcacccccaaaaaatgctaggggcaaagagctgtgtgcaaatgggggtgacaaacagcaacaatacagttgtatcatgatgaatattctgttttcgaatgtgaggggtttggggaatcctggtagaagagagcagttgacagaaatattaaggaagaataaagtagaggtggtttgtttgcaagaaacaattagagtgagttttgcagccaatgaattggatagattctgtggggggagggactttcactggttaactaaaccggctgagggtcattctgggagtttgttaatgggggttaacttggagatggtggatgtagtggaagttgacctaggggagtttttcataagtatgttggtagaatcaaaaagagagaagaaaagatggaggattgttaatgtatatgggccagttcaaacagataagaaagatagatttctccatgaattgactgagatggtgctggtggagcaagaggctgtaatgatagggggagactacaatttagtaagaagtgctgaggaaaagtctaatagtataatcaacaagagatgggctgccaaatttaatgcttttatttctactgctgaattaagagagttacatagagggggaggcaaatataccaggacaaacaaacaaacaaatccagtgagggaagttctagatagggttttggtgtctgcttcctgggataatctggaccccttcactgttgttggcggtatggcatgaggcccttcgaccaagcctgccgaaaccatgcgaccagcgaggattcaagcccgaggcgtcaagaatagtcaaggcgaagctaacatggcgaagactatggaacaacgacggcgaggggcggagaatcgcgcggatctcgccaagccgaaggcctcttgggcgaaggatgtatggcgaagagtgtacgtcgaagggagacaacttcgccatagcaagtttggcctcacgggggccaatgaggccgaactatctcgacaagcctagtggccgttgggccaacaacagcctgacggcccattaggtgcccgtgaatctcaattacactgtatacccatgtaaattcccctgtgtaacctaaaccctagtagtaagaacctataatgagcctataaatagtcccatagggtc

SEQ ID NO: 1360 - DNA, 1501 bp, Oryza sativa
atttatgagtatggagggagtatctatctatccatctatctatgtatctattatattattaaaacagccttgaaaggaggcaccacattcactgtgggggctagaaattcccacattaatcggaggaaaagaaagaaagaaaaagaaaaaggagagaccaaatagaagtacaatttaaaaatagctgaaattcggaattaagaataagcaatattgaaagaagtttccatataagaatccaatacaagattaatcaaaattcgaaataaaaataaaataaaatccaaaattaaaaaggaaaggagagtccaattagaggtacaatttaaaattagctgaaattcggaattaaaaataaggaatattaaaagaacccaatacgaaattaattaaaatttggaataagaataaaaataaatccgaaattaacaaaagaaaataaaagaatagttcaagtagaaatacaatttaaaattagcttaaattcgaaactaaaaataagaaatattaaaagaagagtccatgtaagaaaccaatacgagattaattaaaattcagaataaaaataaaaataaatccgaaattagcaaaagaaaaataaaagaagagtttaagtaggaatacaatttaaaattagctgaaattcggaattaaaaataagcaatattgaaagaataatccatatgaaaacccaatacgagtttaattaaaatttagaataaaaaataaaataatatccaaaattagaaaaaaataaaaaagagttcaagtaggaatacaattttgaaataactaaaattgaaaataaaaaataaaaacaataagaacacaatacgatattaactaatttttttcaaaaacaattctgaaattagaaaaataaaaataagatttcaattcggaatacaatttataaataactaaaatttatgataaaaataaagactattgaaagaaaagaccatttaaaacacatgacgagataaattaagtaacaggactataaaggagtagagtggtagcggttgatacgacatataaaaactgttaataaaacaccaaatcgaatcctaatgatgattaaaaggagggacgtcaggcaggccgtgaagcaaacgagtaaggcggttgccaggacttctagaaagtaaaaaaaaaaaacccattgataatcatattcgatttttaaaatctcaatgacaataaaaaggagaagcagcgggcggggtgtataagagtatagttacagagccgccgacggttaactggacttctagaaaataaaaaataaattccaacgatggttatgttcgatttttaaaatcataatgacaataaagagtaggcagcgaacgggctatagaggggcatagtggcatcatttgatgggacttctaaaaattataaaaaatgaaactactagtccaatttttaatggttcggaacttctaaaaagtaaaaaaaaaaccaatgataatcatgttcgattttaaaatctcaa

SEQ ID NO: 1361 - DNA, 1501 bp, Oryza sativa
caataaaatagactaactatatctagtcaacattgacaatttaattactactccctccgtcccacgatataagggattttgagtttttgattgccacgtttgtccactcgtcttattcattttttttataaatataaaaaacgaaaaattgtgcttaaagtactgtagataataaagtaagtcacaaataaaataaataataatttcaaaacaatttgaataagacgattggtcaaacgttgcaagcaaaaattcaaaatcccttatattatgagacgaagggagtaattgttggaattaatggatgggccttagcccattcgaagattaattctttggaaaattacaaaagcccacctcatgggatgacatgcatgtggagtttagtatcaccttgcttattttaggagagcgggacctccttaaaagggaggatgccctcctagccacttgaagcatgtgtggtggagagaagaggggaaacacacgtgtgcgctccctggcatggcctggcagggcaggcggcgcgcgtgcacgacgtacgcgtcgaatggtccggaaaattggctcctcacccttgctcagatgcagcctccttttgcagttttgttttgctgcgggattcggatttgttttgttttggaaacattccgaaaaatccgctgcgtgaaaacgacatggagtctggataagttacgcgcgacttatccggttcggtttacgcgggcgccctgattaggcgatctatctctatataaacctagtcgccgtcttcacgcaacacacacgaaatcaatctagggtttgcctcctactctgtactgcgccgtcgctcgtaggctactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcatccgtgacagctcgccttcctctccactcgtgtgcttcgcaacttcgtcgacgcttacaaccgcgagtagttcctaccgagcaaccggtctttccgccacctcggtacgtgttcgacatgttgcgcatatttgatctgtccatgttttacttcttagtttacatgtgtagatctaatgatgcgttcaatctagtttacatctgcaatgtcatgatttatttatggaataaattaaatcattatgtgcttataatttcaacagtaattaacaacaaaattgaataattatcgcaaaccaattgctaatgatcaagattagcaaagttggatatcctcatcctatagtgcctgatgacctaccaccaacacaccttttatactactttattccctcacatatcacctgtcgatgaatgatcctctctagcgggagatcgagagaccccccttttgtgagttcggctgggggaaagggcgcgttgatcgagaacgtgtgtccgcctagaatcttccgagaccgcgcg

SEQ ID NO: 1362 - DNA, 1501 bp, Oryza sativa
acatatacaactgtaatgtaacgtacagtttaaaaatataaagtgcaaaaaacataaaaaaaatcaattacttatatcattaaaacgtacatttgcttccttcttctctcctcacgtatagatgaaatcgtaattattattagtgataataaattttaagaaattataactttataaacataaattatacatatcatcatatatatgtctaattagctccacaatgtttggaaataaattttataaaactatattattttacccatgatattaacaatataatattttttttgtttacttaaaccgttgtacctattatatcaaaccattattttgtatcaaaaattttaaaaacacgctgtttaaaataaatgttatgcaattatgttttgtaccattaacttaccaatttatgatctatattaactaattttaatttaattagtgaacactgtattttatactatttttaataaaaatatcttgcccatcaataattttcaaatacttatagtttcatttattaccgttatatcttatattatctcagctatagttgtagtcctgtagatgtgatagatggacgcttaaagttttttttaaaattttctattaaagtggaaatttctagagttttctctaattaatgtgggaacctttagcttttgtgttgttgaaaactgatgttggggattcttatacaagcatttatgaaaatctatcaaagcttttagaattgaaagtttagcttgttttctaactagttcaagcaaatttcaattgaatgtgaaactataaattatttgttagtgatcgatcgtttgattgtaggtatttgtcatgctaatatttcgtcctctagtaatgtgattaaaacttcaaagatctttgaatttgagttattttctctaaagttatgtgtatcatttgaaaaattactaagacattatctgttttcaaaaaaggctcaaatttaatctaaatgtgagtatttgaatccttcgggccccattgtatatatagtattttatatatatctttgttactgcttggccagaatataaatgttcaataatatatattttttaaaaaatggaacagggtatgaacccactcgaaacaggcagaattgttctaggtcatgtggcaatatgactattcctttccccttcgggctccaagaagaatgctccgcaaatagaaaattccttctgaattgtacttccaagcaagcatttattggaggatcatacacgcaatatcaagtgacgaatatttcactagatcaagggcttctgtttgtcaacttttctcagcacgaagaggcctactcagaattggtagaaataagcagagataacatctcacagtgggtggagtcctggattgacgaattcaacgattttgacgtctctcagcattacggtatttggaagtggtttgtgaccaacatgacttgtgaaaaggctaaaaaatcatctgcttatgcctgcattagcac

SEQ ID NO: 1363 - DNA, 1501 bp, Oryza sativa
atacttaacactccaatcagaatctagtttgtgttagtttgagtaattcactttagtgctttgctaaaaaaaatgtattttttctccaaatataaacaaatgtaatgctaaacaccattacaatttaatttgttggtgatttgttatctaaattatagtagtcatcagggataacaatgggttgggttaggcttggccagagcatgaacatgtttgatttgagacctcatacctttcagttcaaaccaaacccaatggtgttagcgtcttagagcacatatataatggatgataccaacttcctataggattttgtaatgacatggaacaagccaacgactaatttatcgcctggttgtatggcgcatcctaaggttgtgggggcatagatggaaaagaaactcggctgcctcctgcatccgccatggatgccaccctcactagtgttcatcgacaattgcgaccatcggagtcctgtcctcatcctgctcggctgccgccgtctctcacgtcctccgcacaaacgtcctcatccagccctggtcgccgccgccgcatgagcgccctcgtcaagcctggccagccgcaagatcccacaccatctttgatcgcaggagtcatcaaaggtaagaaagagcaagttaaatagtatagtcaattaatagctctaagatttaaccaataaccaatcttatggactaagtagtttgcatataaatatatactatacgattaatacctggcacaactctcatacacgcatgatgtcttggaacccatgttgcagttggctataaatctgtagtttgcttttctttttccccctcctctatcctgtatctaaacatagatctgatggatatagtttttaaagttcgctaattacttcacttatgggaaagtgatttcatccctcgaggagaaatccctcatttcgtacatgccacctaaatagtcataaaaaaatttgaaacaaaatggtaagatatattaatataaaatatatcactccacaaatatgcaagttaaaattttacttctacaagttataataaaaataacaaatatatctgcgaatgtacgataactattttcagtttattttcagtttattttgttctttttgttgcaactcgcaaaagttaaatttggtcttacatatttgtggagtgatatatttcatattaatctatgttgttaaatttttaattttttataactatttcgatgacatacaaacaacgaggagacatctcctcaagagatgaaaatccatttctatcgcttattatactcgctagaagagcatcggtatgatagtactcacatgtgagggtaaccataccttggaggtgataccacctctctgtaccataaataccccacccaacaacaaaatcttgtgtacatctacaccacaataccgtaccctacatctctcacacaggtagcagtagtacgtagccagccagtagttacacacgcgctctgctcctctcgc

SEQ ID NO: 1364 - DNA, 1501 bp, Oryza sativa
caccgacggcgcgatcaaacacaagggcagagatgtgagacgatgtgcgacggaggcactggagaatggagatcaggaggtggaggagaagagcggagcatctccaaccgcctctctatctcctctaaattaaaacttagtaatttcggataaaaacacactccagcagactagcatggctatccagctggccaaactcctcctcgcactggccaactttagccagctaaaattgcctagccaatcgtgggccccacgccttttcccctctccctctttcctcccgtctcatattctctctccctccgggagcaacatccccctcctcctagattgaccacgtcagcgctgccccttgtccgccacgccgtcgaccgctgccgaggccgccgccgtccactgccttgtcgttatccaccgtcgctcgcttgcatcctctgcccgtgctcgccatcgtcgccgggtcaagcgcctccatcgctgctcactcgcatcctccgccgtccgctgcctcgtcgttatccaccgccgcgggtcaaccgccggccgaccagtgcaacgagcggagcggaggcggcggcgcaacggtgagggagggagggcgcgacggcgagggagtagcaagggaaggagggaggctatatggcggatggctgtcgaggaagacgaggctagcaaggaacggatctgccattgtcgtcgcctcgcgcgcatggattcgacgtcgccatagtcatcgctcccaccggccttcgctgcctgtgccgctcccattgtcctccgccacctgtgtagctcccgtcgtcctccgtcgctcgcgctactcctgccggcgccacctccatagccgtgccgcactgcagagaagagaggaggagagaggtgggtgaagaacaacacagagactgacatatgggacccactattaaattggagagtgtaatggacatgttgttggagtaaaacgtacttggctctctaaatttttggtaagttgccaaataggacatttggagagtcaaaaatagccacttccttagagatgcttttatgttaattacatactatctctgtcctataatataagaaggtttagagttggatacggttattaagaaagtaggtataattgaatagaaagaggttgtgattggttgagaagtggaggtaggtgggaaaagtgaatggtggagagttgtgattggttgggaagggaatgttggtggagaaatcgttatattttaggacaaatcctgagtgctaaaaattgttatattttaggacggatggagtacttgttagaattgaataaaagaggagggtgtgttaagcaaagcatgttgtataagatcttacaacaatctttatgatcaccgggtttattttaatgaaagcatatatataattcataaatatactaatctctattatttttctcgctataataaattaataatcaagcataataagtatacattttattccattatcaaaaataata

SEQ ID NO: 1365 - DNA, 1501 bp, Oryza sativa
tcaaattcgggagatgatcattggcatgctcttgaaagagtaatgcgctatctaaaagggagaatgagctatggaattcactacgccgggtacccaaaaatgttggagggctatagtgattcaaactggatatctgatgcttttgagataaatgccataagtgagtatgtgttcacgcttggaggtggcgttgtttcctggaagtcttgcaagcagaccatcttaacgaggtcaacaatgaaagcagaactcacaactttagatactgccacagttgagaccgaatggtttcgtgagctcctgttggacttgccggtggttgaaaaaccagtaccagcaatcctgataaactgtgataatcaaacagtgattattaaagtgaacagttcaaaggacaacatgaagtcatccaggcatgtaaaaagaagactgaagtctgtcagaaagccgaaaaacttcggagtgatagcattggactatgtccagacggctaaaaatctggcagatcagtttaccaaggggctagcatgtaatgtgatagactttgcattaaggaagatgggcttgagatccacttagagttgcacaatagtggaaacctgtccattgtgatcaaagatcccgtgaatttggatggcgaaacaaactattgtgtagctgagagaagagaccctaaaatgggcttatattcatgatgcacttctcttctattctgtatggaaggagggtatacaccttaatgtgatctgagtacttctcataaagcagagatgttgatctacagaacatcatagaaggaatacacctatatgagtccgactgctagtcacagtctatgagatcttggtgatctctagatattcatgaaaaggccaggattatgacttaaacgctccaaacagaggggatgcaaacggcagcccagtaccctttaagggtttgagtgaaacctgattgcacaagactaataattcaaggcatagtccattgttcagttgtggtctagtgtagctcttttcctaggtggaagttcaacttaacagtctccaccgaaacactggtataacaaacatgatcagaatcgagagcatttcgtgtgagccatgaaatttggtagggattgttagattaatgggctaggcccaattaaatcctaataaattccattggcccacattaagtgctatgggtaataatactaccttggaaatctaagtgaaaaggtctcaagtgaaatacaaagctagtagagagtctttgttgaccggttgagatggtgggtggatagccagacgggacggggcggggcaaggcaggcaggcggctgttgttgttgctgctgttgctctctcataacggacggtaataaacacggagagttgattccgtattaatgagcgcatcggttacggaacaaaacattgtgaattgattccgtcagttacggaattaaacgccgtgaattaattccgtcggttacggaattaaacgccatgaattg

SEQ ID NO: 1366 - DNA, 1501 bp, Oryza sativa
ggacgaggaattatacctaggtttgtgcgtcattgtgtattttactcatcctgcttgctgcatagttgaactgtattcatttcatcatacaataccaaattaatatcatcaaatcaaatgttaaatatatttgaatagtatttccgtttgttgttgaaaatattgttttgttttcctataaatttaataaattgactaagaaaaaaaatcaaaatgtttcataatacaaaacagaggagtatttataaggaaaagaatatttaaagctcggtaacaaagagattgaacctaaaccaatcagaatagacaacattattaagaataatgcttatgcaaaacatggacaaatagcattcgacactacttttaatcagattttaccatcagcataatagttggaatatttttagggtgacggaccgtatttttcatataactcatggcaattaaaaaaatggccacggtactctctttttgtttcaaaataaattaatggttaaaatataacctttatatagatttttcttattgatgtatatcgatttattttgggacgaattgcgcatagtatcacatccactatatagtagtgtcaccacctctcgttctcgttcccaccacaattcaaatcacgctcccctctccatcgatccacccccaatatacgtggctctgcttcctcttcccctgttcctcctcccctgtttcctctcgttcttctccaactcaccctgtttctctcaccaaatgcccgtagtacgctgctaaccatgtccatgtccatcgcgctccacgccgtcctcccccccgcagccgcaactccccgtcggcggcccacccgcctccgagcgagctcgacggaggcgccagcgagcggggagaaggggcaagaggacacggacaggaagagtggaacggggatgaggaggaggaggaggagagcgaagaaggtgcaggaggtggggctggaggccctctacgacgacggcttcggggaggccaccgtcagggactacttcgacgcgctgagggccacgccgctcgacggcggcggcggcggcggccccccgcggtggttctgccccgtcgagtgcggcccgccggcggtccacgcgccgccgctgctgctcttcttgccaggtctcggtcacggccccgccgctctccttgctttcgctgattcgctcggtgacacaatcaaacaaacactttgtgtgcacaacacacacagaaacaaaaaaaataaccatttactttcatttacactggaaatagcttaacaatggcagttcatgttcatgttgcgaattctgaatttccgatgcgacaagttcgtgttccaaactgattttaacagttttgagttgtggctggtctgtgctgcactcttcttcagggttttaggattgttagaaatccatagacaaaattaaaaggttttgtcatatgcctgtgttcatgaatgtgtttgtactaacgctgttattcgaattgactgaat

SEQ ID NO: 1367 - DNA, 1501 bp, Oryza sativa
ccagcatgatccttccccagtcctgttcacctgcgtgcacaggtgcacgggacgagcaggtgcctccagaactccgtccgcttgcgtacttgcacggataggcggacgatcaagtttttgggagcgctatgcgcaattgctcctgttcgtcttcctctacatcgtctttgccaacatgtcgaacaccggagacgacagcaacattggagacaatgagaaggaggttcccgtcaacaccaacggaggcaatactgcctcaaactccagtggagggccatcctcagtgtataacctactcacgttatttcctcaagttctactgttagtcgcaatgttattgcgtttttatgtctatgttgatgcttattttatattaagcatgctcatgatgattcactttatcaattgcactagttcataccctatatgtgtcatgtttattgtcttaatattttgaattaaaatatatcgaattatgaccatatttccaacacgcagcccatctcccgcagcatctctggcgacgctgtgctcacgtgtcggcggcagccgacacacagcacccagtttagcttgcaggtgatggcggcgacgggtgggacttgtaggattgcaagtgggatgggttgtgggccgtcccgccccgccccacaccagccgcaaactccctatgcgggcaaacggcagcccgccccgcacggcttggcagatttttcagcccgacgggcaccactggacagcccacattggcataatattcatcaatcagcaaacaaaactgtactattttcacgtgaaaatattcacacaagcacagaactactccctgtcccaaatttagctaggattaatcctagcaagagaaggaataaagctataaaattgcagattaaacctaccaagagagggaagaaaatataaaattgcaacatcaagaggacagtgaacaggaaacagattcagagctactagctcaagaaacatgtcagagaactcacaaattcagcagaggtactagctcaagaacatgcaagagaactcacagattcagcagagccacaaacactaataatgctaaatgacctgacaagtgattaacaacatcaaactggtacataaggatgttagtattaacatgtgttcaacacttcatttttcaatgacataacaagtatagtccaagccagtcctggcctgctaaccattcttagcgacttgatccaaaaccaaatctcacccaaatgcttattatttaatctgaagttcttattcaataatccaaatgagtagaaatcacttctcatcaaacaaatcccctgctgcttgaagaacaaacaaatcttgaaggaggaaaaacaattgaccggccgtcgtcgctgcggcacaaggtgtggccggccaattggaactgcagccctcttccatggcagctcgaagttacctgctcccagtctcccaggccgatggagccagtgatgggtagagagttggaggcagcagc

SEQ ID NO: 1368 - DNA, 1501 bp, Oryza sativa
gcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatggaatttatttttgaagtggttttggagatgattggaatttacaggtgaatctacaggatactgctgttatttcatgtgaccggtcagaccgggctgtgtatgccggtcagaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaagtttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagt

SEQ ID NO: 1369 - DNA, 1501 bp, Oryza sativa
cctctccatccacccccttcccatccccatcccctcctccccagtgcagccatgctggtgaccgacggtggagctcccggatagcctcccgcaggctgttcctctacctcccgtgggccatagcctccgcgccgccgcttccgacgccagcgctacctgctactgctgctcggtcagctggtgactggtgagcggcgtcaggaggaggatgaggaggaggaggaggggggggggggagagcgccgacgagggtaggctcgcgccggcagagagttcgaacgacggcgttgagaggaacagcatggccggcgcggcggcggcagggtgggccctgcctgggattcctctgctttggtggctcgcgtcatcgtcgtatccgcaccccggtggatgggatctggagcttctggtagtcggtagaatggtggagatcgacgggacccaagtcatggcaagatcgatttgatttgatttgcttcttttttttttctgaatcatatgcggcatcatattgtagttcttcatccgacttacttcgattcattgatcttgtatggagtacttatttttgtgtgattaatttttttttgttgttcatatgctgttatggttagttcagtctatgaccgagaccgaaccgaactaaccgaagaccgaagtgctcgaagtgctcggtcttaagttttcttgaaaaccgatcagtcttgtgattctgaagaccgaattttccaaaagaccgaagaacctaaccgaatttatcggttagaccgaatgcctacccttacccgcgagagagtatgcggcgcagcggcggtggcggccggggaggtgggagacagcggggtggcgaatagccgcgacctacgaggacaccacgtcacgacttacgagtgaaaagtcgaaaacttgtactacatacctttttttattgaaacttctggccctaattttttagggtgaaaagctttgacgtattacgttggatatacggacacacatttgtagtattaaacgtagactaataacaaaacaaattacatattccacctataaactgtgagctgaatttattaagcataattaattcgtcattagcaaatgttcactgtagcaccacattgtcaaatcatagagcaactaggtttaaaagattcgtctcgcaatttacacgtaatttctttgcatgcttgcaagcgaccaaggagggccgcggggggatgacttcagtgcgagcaccattaaagagcatgatggcccaacaagtgtcggaggggttggaaaaattcggtgttcgtggccgccttcacgtacggaatccggactcccacctaggggtgcaagtggggcgggctttttttatggcccgcagtcccgccccacaaaaaagcccgtaaatttgcgagcgggccatcccgtatggaccttgcaaaattgtttggcccatcccgcatagcccgttgggcgccaccacattagggcacgagactgggtctctgggaga

SEQ ID NO: 1370 - DNA, 1501 bp, Oryza sativa
gttcagtgtagtgtgtggtgtttcagttattcagagacgtccatacagtttgtaccttgtgaccacacgtcttaatctgatgaagcttagaataaatcacatgttagcaatgcaatatcatctgcgtcttctctcactttggtggccatcaaattctgtgtagaagtgtatggttggtgtgctgttgcaaatgccgtattccgctctgttttgtggaagttaagaagtccctagttgaaataccgatttttcatgatctcggagattgatgcaactctgattgcagcatttctttttattagaatgtacactccatgctatcatgatgtttattgtttagtactacaagatttggttaaccattattttaatatcataataattttataaaatcttggagtaacaagttcataatacatgatagcataactttttgaggctagtctatgtatattgtctcctttgtttttaaactaagcactcaataaattattgatggctgtaattttctgaaggtttcaccggtttcggcccgtgctttataaatagcttcggcacaaaagacaaaacggtccctccaacacataaatggttgagtttacgttttcattatctttggtaaaatcaagtccaccacgtagacactcataacaaaagtttgaatatcctcagaaattttgacttgagtctatcttaccttgaatatcggacatccaaccctccctccctccctgaactttatattattcatattacacctgaactttatattattcatattacacctgaagtggttttcatttaattgcatacatgctgaaatagtttgacaacgtgagatgcacaaaatctacacgttcgtcttaagttgcaatcattttatcccttttctttttctctcttacataggaatatcaatagtactaattcacattacaatatagtataaattggtgatcgattattggcaatatactatattaaatattcaaaactagtcatttaagctgccaaataagtaaaccactatcgaaaaccacaatataaatggcattacaaaacttagggggttgaatatccaattttaaagttcatgatgctagaggaatttctatcaaaagtttatgggtacatatggactttttcctttttaaaagaagctattcttatcgtaaacgttaaatattttttgtactttattttttatgattgaaaaaaaaacttagttttcaaaatgattggtctgtatacaagcatcaattagacttaataaattcatctaacagtttcctggcagaaactgtaatttgtttttgttattagactacgtttattatttcaaatgtgtgtacgtatatccgatgtgacaaccaaacccaaaaattttccctaactccatgaggccttacagatatatttgatgggtgtaaagttttttaagttctttgggtgcaaagtttttaaagtatacggacacacatttgaagtattaaatatagac

SEQ ID NO: 1371 - DNA, 710 bp, Oryza sativa
  unsure (1)..(710): unsure at all n locations
gaatttacttttgtatgtctaagaagtaatttagtgatatccaaaagtgaaagaggatcggatgtgaaggaggaatcgagatagagattgtcccggaaacagagtgaaaatcggctgaagtccgaaccggctacgactaagatcgcagagttcgagtcgaacgggttagccattgagccgaatccgacaatatgacccagcatatgttgtcggtttaggttcacgtgcttcatgatgatttccacgcatggatagagtcctaacaagtcaattgtatctattccttaggatattttatgtaatttccttagagatatgtttgggcaaaagtgtagtgcaaagacttatggtatgttagagtttgttagaaataagattagtgtagatatggaacatattttgtaattntggccccccccccccgaaattttttatttttgttttatttgtttgatatttttttcatgcttagggacacacaagaaccaactatagaaaaattgaactcaaatggacgtaatatgtgacatgtagaatttttcctctcctctcctctctccgaactagtgcagaggagagagatgtgcaacttttttatttttattttattttgttgatattttttacacacttaggaattcacaggaaccaaccacgtaaaaaataaactcaaacggacgaaatatgtggcatgtggaattttccaaagc

SEQ ID NO: 1372 - DNA, 1501 bp, Oryza sativa
tattgctaatctgggatcaaaattatttcattttaaaaaaagacatgaaagttattgtcaaaaaaaactatgtgaaaatatgaaaatagaggagaacaataggagagagatgtgacttagctatatatagacagcaaactattttacgtgtagataaaatgtaagtgttaagtctaaaatgatattgcgtgctgttctaaacgttaagttgaatggcaatggttagacatgtcgcggccttttacagataaaaaatagttcattcgttatatttatggtgtatcattctttacatatttatatattttttatggttaagtacagtacctaagtgccaccattttgctgaacagttttttttttttgtatatatcatatgttattgattttaagaattttcgtaatacaaaatgacccaaaggccgaaatgaataagcgatgaatggatcgaaagcaggtctgcttggatgatgaagtactaatgcacgttactaaggttccgttcttatgagctgtttaggtgagctttatactaaactgatatacaaatacgtttcgtacaaggaatttttatgtgaatatttcttaaaaaatcaaaccggtgaacagtatacgagcaacttgccatgagcagaatgtttgacttgacgatactccgctagctcgtcaaacttccaattcaaactcttatcaaattatcatcaaatcgtcgctattccatcaacagcactagcgcgaatcttcagacatcggcatgtattgctattccatcaacagcactagtgcgaatcttgagacatcggcatgtatttttcacgaacgtcagcagtgcttgtactaaggtggtattaggatcagggactaaaattttagttaacgtcacattaaatatttggacactaattaaaaatattaaacataaactaataacaaaatacatttcataattctggactaattcacgagatgaatctattgagccattagcctatgtaatgccaataaacatatgctaattatggattaattaggtttaaaaaacttttctcgcaaattagtttccatttacgtaattagttttattactccctccgtttaacaatgtaagtcgtttctatatttatattgatgttagaatgacttacatcaatatgaatatgggaaatgctagaacgacttagtgttaaacagggtttattttagtttctaaatccaaacaccacataaatagttgcgtcgattttttaaatttgaagtggaatatcgtcaaattccaaacttcttttttaagctttgcgtcttcgaaacaagcacgcggagtgtataaaaaaagcgacccgaacagttcaacctcgctttgttttaaaaacggcaggcagtacaatacgaaacggcggccaattcattcgagcccgcggcgagagcgagacgacgacgaggtgatctgagatctccggccgccgccgccggtttcgggtttcgcggcgcgcccccatcatgg

SEQ ID NO: 1373 - DNA, 1501 bp, Oryza sativa
ccgtgttgcaaattgttcaaataataaatcacactttttttcttctttccaaagtgcaaatcatgtcgattatacacatgtcatgcatgcagaagtcttctcttcctcatatgtctgaattttgattctcgatagttcggtccgatgatatcgttaacacaaattggttttatatgtaagtttcacgttttgaacgaaaaccaaccagaaaccacgaaatgtataggtgttttgacacgggatgagagcagattttcgagtgaaatttgaatggtttctgataattcaaatattgtgaaaacttgaccaaaatcttatcaaaatttgattaaaatggcgaaaaccgtcatattaccatcagaagtccgtatctgttgctcaaccgaaaaggtgaaccaatccttgtgtgctcgctctacagctcagggtttttgcaccgtccatcactggtaccaaacttgggaacttgtcttgatgctattctacacctgtttgattaatgcaatacagtactagtagtagctacccgccgatcaccaggcatgtgtaacttttttttaaacgagaagatatagaagtgtcaatttaaaagaatataggaagaaaagggcattattcatatatatatatatatatataagagataaaaactaagaaaatagttagattgtacaaggaactagctagcagcctaaagtaacatctctgttagatacttggcttttgccgccgtttaagttcttgcctgttcctctatcctcgctatactacctgtcgtagggacggatctaacatgagagcggcgggctctctgagcccccactactggcgtgatgactatgaaagcccccacgaagaccctactaaaattttttaccatatatagatgggagggggattgtaactctatctagtttgctcagaccccactgctattttttttgatctgccactgatctatcgtggttagctcttacttctctttggtctataaaagctaacctaggtgggaatggaatataacctcctctgttcagatttgggttttttttttacggagaaaatatgtcggaaaaccattcattactagaaaaaacatttttctaggcgggcaaaagtagtttttccaggcgggggaaaggagcgcatgtacgtaaaggcttgcgaacgcccaacggcacctacaaaaatcattttcgtaggcggttgatccacccgcttgtaaaaatatttttagcgaaaataaaaaaaatgccactggtggcctcccccttcggcttctccccattcgggagacggctcctcctccatccgccggcgctgcccgaggggcggccgccgttggttcctcctccgtcaccgccgcatccaccacccccgccctcccccgtcggcccctcccttcggccgccaactctcctccccctcccccagtcagatatgggaggaggaaggagggagcgttgcctccgtcgctgatggccggctcccctcatctggc

SEQ ID NO: 1374 - DNA, 1501 bp, Oryza sativa
cccaaatttatgtaagcaatatccttgcatgacaaggactggccgaaacgggatcgagttatcacaagcgataaacctagctagtactatctccgtctcattagaagtgtagatgtgggtttacattttgaccgtctgttgtatttaaaaaaataagtcacacataaagtttttttcatgtttatcatctaataacaacaaaaatactaataaaaaaatttaaataatatagacgatcaaacattgaacaccgaaatctatatccgtacttaaaaaaatgggacagaaggagtaatagtttagtataaccttgggcataaacattttaacacttaaaataagatttaaccaatcacaaactttaaccatgaatatagtttccatatggttagtttaaaaaagaagaaatggtatacacagatttgtcttgaaaaagaacagtatgataatattctaagcttatattcttttttaaaattttttctaatataaaattgatagtcaaagttttgaattttgttgtaaatcaaatatctgtgacaatcgacaacttattttgtggtagtacagttaaaacaattgcagagtctttttctatatatatttaaataccgttgattattagttattgctgttgctatcaacacaataaattgtggaacatcataaatcctattgcccacggttaatgatcactttcgcagcctatcccagattgttaaagatcacactttaagagcacaactccatcatgctcccattaacattcataccatgggtgaaatacagtgtacatgcagattacacgcaaaatgataagatcaagttgataattgttcatccataatccattcccagtttgtttgctctcttatcatctaaaaccagggtaaaaaaattatctttacaaaagtttgtgcttttggggaatattttggcggctgatgggacctccacgattaccacacaagtcaacaatttctcccaacagattgatcattctaatgtatgccgtcttttgtacgtgatgttgttggccaactctgccttattatctgtcagtaaattaattaattcattaattacctgctcttttattctcttctcatcaccttttattttttagtgtcacatcaaccactgtctagctagccactactatacatcaagcagctattgctctgtcccaaatggttacctcagttttcttcggaagagtataattgaatatgcaccatccacaaataataacaccctcaaaccatgccacgcttgaaataatgttagatatatgataaatccacttttagtcctccaattatgactgtggtccgatctgtattctttaactatataaaaccgattgttattgtttttcaacttttaaaaccgttcacattttataaaaaaagtttttttttatgatggcactatatgtagaaattgaaccctgcagtgctagggacacaaccacaccgtctggctattatctggccgcagg

SEQ ID NO: 1375 - DNA, 1501 bp, Oryza sativa
gtggcgagctgtatttgtttagctgcctcagtttggttattttcttgtttttaattcttaaatccaaaataacaattaccatgcactatatgacctatacttttgtctttatatgtatcatcgtaattctgtcttttttctcagctgatataagaatttttaaaggtctaatttgtattgctagatgatagattgacaaatgtagattttttaagagttaatgatagatagcagatgtgctacttctctttgccccaaaatataaacatttgcatgaattttttttctataaaataagagcagatacaatagcaaactattagccagctataaacatattttaaaaagataaaagatgagagataagagcagcgagctacagatctgtagccagctgcagcacggactctaagacacaatgtgtgtatgacaggtgggaccatatattaatagtatagtaagcaactattgtatgaattgactattaaattggctatacatgatttagagctagtagttggctatactattaaacttgctctaagtgtgtctgatacactgattccaatgcaccgggatccatacattaaacaaattaggtttatacaggagtaatttaaaatttaaccactaatatgattgaaagaaaacaactttttcttagcatttactacctccatccagaataattgcactcctagaagattaaagacagattagcaacacacaaacgattgcagtaaccctattttaattaccacattatatgcatacatttcatgcttaaacttgattaaaaagaaggttagaagttggagatacggagtcaattatttttatgtaattaattgattgggtctgacatctcaataaaaacacaatcttttcatgataaaatttgaattatagatatataactattctaggatgaaggtagtaacattaaaaaggcctgttcactagcttttcagctcagtcccagaaagaccttagttttgactgtgtatgtttaacgcatgaccgtctattttatttgaaaaatattatgattagtatttttattattagtaaaagataaaacataaataaatattttatgtgtaactaaatatttttattttttaataaatttttaaataagaggtcaaatgttggacacgaaaatacacaaccgtacctaaaatggacggaggttgtagtatttgattttaaaagaaacttttatataaaaatctagcgaaagagcagagacgcttatctatgcgcgcgctaattggtggactcacccgcgacacaagtcaagcccgaagaagagtgtgaacgcaaaataataaaataaactcacgtatttcgaaaaccgtgggccccaccgactcccccccgcgcgcgcctatataaagcgcgcgccattaaaacgcttctcccacttctccctccgaatttaacgcggagcgaagctcagagcagagcacgccggccatggcgcgcgcctcgagctcct

SEQ ID NO: 1376 - DNA, 1352 bp, Oryza sativa
atatatatatatatatatatatatactttaaacttcttgcgatgaactaaaacttttttcccctcaaaccacagcacagctagcaaaaggcaagcacatagaaaatgaggaaaaatgaggaggagctagggttttactataggtgcatacgaggcggccgtagagggcgatggggaactcgcagcggcagcagatgtggacgcgctcgccgagggggcggcgggagcggcggccgatggtgcgggcggccgcgacggcggaggtcgtgacggcgccgaggctctttgccacggcgaggtcggcaatcaccaggtggtcggggcacgcgaccgtaacggactccggggccccgcccgcggccgccgaggccgacttcggcgggcccccgccggcgcggcgccggcgccgcctacgccgccgcctccgaccccgccgccggccccggccgccgcgccggacgcggcggcgccggagtccgacgagccgatcttgctgaggcgaatctggagcatgtcgctagggtttcttgccgcttctcttctctccagttgggtgggggattttgtttgtttgcttgcttcctcctttcgttggggcctttcgttgccgagtttgggccttttgggctgcactttggcctgctagaatgtaaaaaaggctttcggcaaaatttaaccattttgggcttgtttggcagagctccaactctttagctctagaagttggatctatagtggagttgttgagcaatctaaactcagctcaactcatattttaggtggagttgaaactgtttggctgggctttagctccataagagttgaagctagagttggagccgtaccaaacatgcctatttttttataaaaaaaatagggttagagtcgtaattgtagttgaaaataggggtgtcggacacaattgacttaaatatgtatatattttattttgtttggaactaaaatcattggactttggttaccctgaactaatccatttgtcctaaaataagttcattaccaatacaaaccaaaacaaaaattagaatactcctactttatcaaatattatgtgattatttttcattttatttatttccaatgcaattattcctaattgcataaactttggtgtaataattactcaaaatgcacctattttggaacaaatgggagggaaatatgaactaattgtggaataaagggagtatataaaattaataaaaaaagatttgggattgtcataggaaacttaacagggttagttttctaacagtgaaagtacatgtaccaacctcttcataaaaaaaagacagccatttcttttccatgacatgagagtatagatggcca

SEQ ID NO: 1377 - DNA, 1501 bp, Oryza sativa
tgctaccacggggtgcctcagtaggaccttatgtcatgggttcaactcctcatgggagcgaattttctaggaattagtggcattgtgcttttcaacggtaggcgacgtaccggttgacaacgaggcgcctgtgatgacttcgtcaatttcaaggatgatttgtcggcccaatcttcgaagattataggggtagggtttgcgcacgtgcgttcataagggtgagtgtgcatatgttatgagtgtttgcgttatactgtataattctaaaaaaacaataatcatcccataactttcgacccgaaaacgaacgtcaattcgacccaaaagtgcgtctaaagttatcccctttcacatccatggtaaatttaaagtttatacattaatgtgatttaaaatttaaaattatttgaaatgtgtataaaataaattatctaaatattgtcaaggtagtcatagatatagatcatgaatttatgttgctagaaatatccagcttataaaaaaaatcctagatacatggctgtagcaaaagagatttagattttatctcaatttccgttagcattttttcaattaataatttgttaagtttgtaataatttaaatctaatcaattatgtgctaatgaatttctgttttacgttacatctatttcaaacatcaccttagagcaggtagaatattgaattataagtcagctataaacatatatcgaggagataaaagaagagagagataagtagcgggctacagatttatagccagctgcagcacagacttcacgatgcaatgtgcgtacagtctaacatatacctttacatataactattgtatgaattgagggtgtgttcgcagttgctagttcccaactagggacagtacgcacgtgattaattaagtactactccctccgttttatattataagtttttctagcattgctcacatttatatagatgttaatgaatctatacataatatctatataaatatgggcaatgctagaaagtcttataatataaaacggaggaagtattagctaattttttttttaaaaaatggattaatttgattttttaagtaacttccgtttcgtgtagaaacttttttaaaaacacaccgtttagcagtttgaaaagcgtacgtgtgaaaaacaagaaagagaggttgggaaaaggggcatccgaacacagcccgagtataaatgatttggagctggtaccagtaccggtcacacgcggacgcggtgcgccgaccgtccgacccaaccccagccccagcacgaatctcaacgcgacgccccccccccggcgggggcgcccgccccgacgcggcgaagcaagcaatcctcctcctcctcatcacacaacacaaagacgactgactactcctgtggacggcttccaacttcccccaatttttctctcttttttttttcttcctttccttcgccgcgaagcactccaccgccgccgccgcccccgatctcttcctccggcgg

SEQ ID NO: 1378 - DNA, 1501 bp, Oryza sativa
tgccggaatgaccgaaggaggtcattcaatgtaattaagacggaagaaaagattacaagaaaagttttacatcgacagttggctgtcgagaaaggatgtgcaccagagcacacgccccgaaccatgtgccaaccgcctaaacacacgctacagagagggaagtccgttacccaatccgaatccaccatctgaacatcggcggcacatggcttccgccacacccgaactgacgcccctccgtcggccgacttcatcgaaccaccatccctgagagctgacccaggacccctccgttcaaccacccaccggcctcctcgccagatctggccgaaggagaacctgggactaggtggcattgcttcagcagcctgagcttcccccactgacaagctgccgcctcaatccagcttagaaactccccacaaagaaggggaggagctctaggaagggcgagggtgccgatcgacaacgaggaaaacgaccaaccgccgccaactccctttgcattgccatctgggcctgcaccaatgccagaaacgctgccgctccggctccggtgccacccgccggcgccccctttgtccggcctccttgccccacctagccgtgccgcgccgctactggccgctaagggcaccgcggcagcccagctgcccgaccgtcgaggcctagccacgccatagggcccggcggcagcgaaggcagaggcgggggcgggggaggcggcagggtgttgaccagcttccgccgccgctcccaaccgccgccgccgccgccgcacggttcggccgcacgccgccgccatgcacctcgacggcatccgcatccgcgtccaggccggcaccgccgccacgcaaccggagccgccaccgccgccgagctgccaccgtcgccgagccgcgacagcgccgccgaggcgccaccgccgcccctagccgcctcgcgccgagattcaggcgaggatggccggatccggacttggggactccggatccgccgcctccccgcaccgccccaacatcgacgtcgccaactccgaccgcggtgggggtcttcgtttgttttagttcgagagaataaagactattattagtgaagttttatttcaaaaataaatattagttagagcattgagttgtcatcttacaaaaattgactcctgtattatcttctgcttggatagtttctgctgcaaataggatcacactagggtcagatgctgacacttaccatgagaaaaaattggatggatgaattaatcaatacaaaatcttcaaatatttattatgtgtagctcttttctttaagaatttagatggtgagatatcatggataatacattcactgaaatgaacatggtttaacccgaaaagcattgttatgtcagtaaattgcgttaccttgttgaaatgtatattttgaaatacccttccaaaaaagtgattttctgaagcaacactgaaaattgcccaaatgccaaatggtaatctacaacagccaa

SEQ ID NO: 1379 - DNA, 1501 bp, Oryza sativa
taaaacgtgcacgcacgccctatcctatatcttgaagaaaatatattgagattgataaagtaaatataaagtcatacatgtctcaccatcgtaggcacatcatatagcatcgaaagaataaataaccgtaaatacgagtagtaaccatatgttttcagcctaatataatgttgaaacaataacaagtgaagaaaaaaatacattcatttaagaagaagattacacagatacaaagaataatttcatgaatgaagaaactacaaaacaaatctaaaggaaaaaaaaacaaaatcaaactcacattccaattttcataccaacaccatcttagtttggtgagtcaggcgatctactcccgtaggccttattcgattaattccgagtaggaaaaaaaatagagatgttttttaaaaaataattactccctccgttttaggttatagtcaaactgtttcaagtttaactaaatttacagtaatatttattatactaaattagtttcatcaaatcaataattgaacatattttcataataaatttgtcttggttaaaaatgctactattttttcctacaaacttggtcaaacttaaagtcaaaacggcttataacctgaaagggagggagtacatactacaatagacatgaaatacattcctttcaaatcctcttacagcccgtttggttggagggagtttttagaagggattgggagtttagagggatgatgctattaagtgttttgtttggttagaagatatgagaattttagtgggatgggatgaggaattaaggaaggaactccctctttttcaatacctgggtaggggcaggtaattgggagggaattcctcctttactttgtctaatcaaatctcaaccatccgtttttattaatgatctaatctctaactaaactccctatcaatttccatcccctctaccaaacaagatattgagattaaaaatcaaattatcagtccattaccagagggattaactgaacaggcgaacaatgccttatcgggctaccgggtcagtacccgtagctttctcttctcccccattccctccttcctcccccgtgggtgcgtgacgtggggatgagattgcgttgttgctgcgcccgacaaggcaacccctcccccgacgcctagagagagaaaactaacctcacctcacctcacctcacctagagagagaaacacagaagccaaagcaaaccgaagcccagtttctctctcctcctcctcttcctcctcgcatcagtccgcataaagtctcctccccttccccctcctcctcctcctctccaatcttggcagcagcagcagcaaaggggcggtgggttctttgtctctctctctcgggcggatttcggtttcttcgtgtgtttgttggttgcgttggcgtttggagcggcggcggtggcggtgagtgtgagtggtgaggaggaggaggccgccatgggcgcgggcgggaggtgggtggaggagtacgggc

SEQ ID NO: 1380 - DNA, 1501 bp, Oryza sativa
attcgagacaatatcaatttgactgcttttacataaatattttgcatgggtacaatgtaattaatttatatgatactttgaagatatggatcttaattaaattgattgaacatctattttttgtggatctttcagatatagtttgttaataagtgattctcattcgcatatggctttatctaattattttgtcttgcaatcataaacagtgaacatatccagcttcttctatttcgggttataaagatcatgctccattcagacatgagtggtctctcctaaattcaaatactatagcgaattcaaatatggcacaaataggatacaagcataaccgtgcgaatttagacaatgttttgcttttatagatgacaatgagaagatgtggattttaattaaaacaataggacatccatttttgtgcatctttaagatagtaatttgttaataaccgattattccatttaaccatttcattgcgtgttcatgagcatctatttttattttatgaaatctgtacatcattctagcatgagttggctttcttaaatccaagtacttcagcaaaatcaggcacaaactagatacaaccgtaaccatgtgacatgagttggtcgatgtaagttgccacctggccatggtccacataattagcttgaacatataagttttgttactcttcatttaaaggtccaaaactattagctgtctcaaccataattcgatagaattttttttggttggatggtttaggttggggcatgcatgagtccctcaattagttggcagtacactggccctattctaagcttacctagctggaacttgaatcttgtccaaaagaaagcacaagaaagtattgtcttgtgggtagaattggaattcttttttctgtggaagtcaagtggaacctggcccacccattaatttgatcattccaactatgagagatgatgtgatattggacaagggtatcttcattggggaacacttgtttcattttctttgagaaaggcatttgatcctgaattcctcctagcctacatttgcaaagtgtagcagagatgctgccatccacaataaatatagtggtggtagtgtattgtagcatctttgtttgcatgctctgcgtatttggttattgttttccgccgtgtttagttccaaagtttttcttcaaacttctaactttttcatcacatcaaaatttttctacacacacaaactttcaccttttccatcacattgttccgatttcaaccaaactttcaattttggtgtgaactaaacacagccttcatctcactgcctattttgtgtgtgcctttctggcattccttttctgtgagagcttgcttggagaatgatttaaatagtgtctgccattagtccaatatatagaacaataatccaatcaccaatgtgatgtgtgtacttagggttacacatataagccactaaagcagcatcttgataatactagctagtttctagttttgta

SEQ ID NO: 1381 - DNA, 1501 bp, Oryza sativa
acgcttgggcagcagcgtcagcctgctccggcgccggcgatcgacggcgaccatccggcggcgccgcctcattctccaccggcggatgcttttcttctgtcgcccagtagtttcttcttgtcgccaaccacgatgcatgcgttacaagagttggctgctttgttctaattagctctgaacttctaatttttggatcagaatcacaacagtttgtgcaaaaaattttcctgtaattagggaaaaattagcacgaacaggtgctctgcgctcagctcgccgactgtatgcattccttccgttcttcagcatctgtacatttcttgatctcattctgataattaacaaaaccaatacaatttatttgttgattttgtttgattaaccaatcagctttgctcgttaattagtcgttactactgtattgctaagtagtgcaatcaaataattaacccaagcacacaacctcatgcgcaaagagaggcacgatccttcactctagatcgtctccctattgctgctccatgtttgtcaatacaggatggacggcatttgaaggggtttttgttgaaggcatcttttccaaaacaacctcaaaatattcctccctaaggcgattttgataaacatctttttaggcgtttttaaaaagagtcgtgcatcactttttcctgacgcaagtaaatatagtgtttctcaaactgcctctgaaaactattcatgttttttccttatcaaagcattccaaatcgcctcctaaattatatcatttcgtactatatattactgtcaacaacagcggacggtgatatacaatggagaagttttcactgttagctttcatcgagcaaatatatgggcccaaactttagcctggaaattctgagagttagagctaaaaggttgacctaaatcttgtaaatgtactttaggataaaacaaaaaatgacttaattaggctgtgaaagggcatgtggactatggttcattaccaccctagctagcgacatgtgttctacagtactatcccggcccactgctatgtaggtcgtacgtactctacgctatatatggttccgatcaaatagtgtatgggctatattgaccacattgtcatactggtccaactgaaatagacactgaccaagtagttgtgttggacatgttatgtaatcgacatagccataatcacttcgtcgcggacaacgacaaggaatgtgactggcggcgaaagcaacccagcgatgaacagttggagcatgttgcacactaggtgtgcctcatgacatgttgacgcctgcagccatgcgcgaaggctccatagcttattgtcacacaccatcgtggcgcccacgccgctagcgccaacgcttctttttgttgtttttgttcttcttcttcttcttcttcttcttcggaaccgagccaacattgttgctatttatattagggaaaagtccattttacacccttgaactcttatgcttgtctaaagtacaccccc

SEQ ID NO: 1382 - DNA, 1501 bp, Oryza sativa
ttgggtcgtggaaagttggtcttgagcggaagaagctttgcagggacaaggacggtgtccggatggacggccaggatgcagcggttcgggatgattggacggctaggatattatgcctccgtcagttgcctgtctgggtggtgcggtggtgcgcgcgtggacgggaacgaccgaccaagagacgggacccgaccggtgtaatgttcagtttttgaaaagaattgatcaaatcatgtccgaataaatcccatcaccatgtgtatgcgtctactacactttttttatccagataaattagatattaggtgatccaaattttagttgaccattacaacaaatctcgctgaacgtaacttagggtatatatcttctgtcaattgttttgcattgccaaataatatgtttttaaccactgtatgcttgttgccttatcattcgttgctaaaatttgaattttagcatttgtattggcaaaggcatcgctttggacttccatccatctctggattctctgcatatgtgagagttcattccatattagcaacatactctctccggtttcgattttattgatgttttggacagatctcacttaccaagaagtgatcaattaggttgcctatttcttgttttacccttattaaaaacttctgtgtagctcttttatcaaaaactcccatacgacctgtgtggctatagcctttagtttcaaagctggagttaatgtgtcattgcttgggaagttgggagccttgctatagttgatgagctactgaagacaagccttgcatgcatgcaaggatatagcagtccaaagtgacaatcaaataccaaaacgtcaataatttgcatccaaagggcacaacccacaaacatcaatatatttgatacaggagggaatatgtttcaagcaccccacgaggcatacccactctgcagcttgttccaatcataataggcgttgtcaaagcattggcgtgtagaacgatagatgctctaaggacgttaccaacaccggctttcaaaaattggcgcttgtggtcacacgccatgaaaccccgtcctcctcttctagtagtcatgtggaatgatccacccgcattcagctatatgtatcaagcgtcgaaggaatccaaccggcaactaaaccttgtcaaactcttgcacataatgataagtaacttcggctttgtactctccactctcattcgggaattggccttgttacgagccgaccaccatctccaaactaaacaaagatttttgtcggtaatttgaaatcaataccccaaattttccttaccgtctcccctacatgacatacattgctctaactctacctgggtttgatgaagatccatggatcaccttcttgcatataaagtatataaatgtacgtggttctcatccaattacacactcggcaggttgtgttcagcttgattcctgtccaccaatatcacgacgtactcgcgtacagaaaaaggttgtcatgagcaag

SEQ ID NO: 1383 - DNA, 1501 bp, Oryza sativa
tcgtgatattggtggacaggaatcaagctgaacacaacctgccgagtgtgtaattggatgagaaccacgtacatttatatactttatatgcaagaaggtgatccatggatcttcatcaaacccaggtagagttagagcaatgtatgtcatgtaggggagacggtaaggaaaatttggggtattgatttcaaattaccgacaaaaatctttgtttagtttggagatggtggtcggctcgtaacaaggccaattcccgaatgagagtggagagtacaaagccgaagttacttatcattatgtgcaagagtttgacaaggtttagttgccggttggattccttcgacgcttgatacatatagctgaatgcgggtggatcattccacatgactactagaagaggaggacggggtttcatggcgtgtgaccacaagcgccaatttttgaaagccggtgttggtaacgtccttagagcatctatcgttctacacgccaatgctttgacaacgcctattatgattggaacaagctgcagagtgggtatgcctcgtggggtgcttgaaacatattccctcctgtatcaaatatattgatgtttgtgggttgtgccctttggatgcaaattattgacgttttggtatttgattgtcactttggactgctatatccttgcatgcatgcaaggcttgtcttcagtagctcatcaactatagcaaggctcccaacttcccaagcaatgacacattaactccagctttgaaactaaaggctatagccacacaggtcgtatgggagtttttgataaaagagctacacagaagtttttaataagggtaaaacaagaaataggcaacctaattgatcacttcttggtaagtgagatctgtccaaaacatcaataaaatcgaaaccggagagagtatgttgctaatatggaatgaactctcacatatgcagagaatccagagatggatggaagtccaaagcgatgcctttgccaatacaaatgctaaaattcaaattttagcaacgaatgataaggcaacaagcatacagtggttaaaaacatattatttggcaatgcaaaacaattgacagaagatatataccctaagttacgttcagcgagatttgttgtaatggtcaactaaaatttggatcacctaatatctaatttatctggataaaaaaagtgtagtagacgcatacacatggtgatgggatttattcggacatgatttgatcaattcttttcaaaaactgaacattacaccggtcgggtcccgtctcttggtcggtcgttcccgtccacgcgcgcaccaccgcaccacccagacaggcaactgacggaggcataatatcctagccgtccaatcatcccgaaccgctgcatcctggccgtccatccggacaccgtccttgtccctgcaaagcttcttccgctcaagaccaactttccacgacccaaaaacctcctcccccccttctcattctctctcttctc

SEQ ID NO: 1384 - DNA, 1501 bp, Oryza sativa
gacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaataatacttacatctttccaaccgcgagctcttcaaacctgtgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttataggggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccggcccgctacagtagccgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggccc

SEQ ID NO: 1385 - DNA, 1501 bp, Oryza sativa
gatttggacggagtcgcgacacaaatcgatccggcttcttgaacgcgcacgctcttgagccccgcaatcgcagcaccacgtctcctctggttatcacccgtgtcgaaacgcggatgacctcgccgagaaggctaattcctgtttgccaatcgaagaacacaaacaagaacgagatagaaaaacaaccaaaattgcagatgaatgattaagctcacgagttggggtcttacaaaccgatctagcggcgaaactgttcttgatagattaatctaagcaaaacccaaaaacctaaagacggcggcgggtactgatatatagagtttagggtcgtgcaaacccctcttgacgtaaccctaatgggttccaacacgatacacgggccaaaagcccaaatacggtgacgcagcaccggaacagattctggatgtcaacttgttcggtcaattcccgttgactcggaaagaatttggacgtgggaccaaaaccattggaaaggttatcttcttagcttttcatccatataaagaacgccccaatccgagcacgtatgcgacctgggcgtccattttagtgcagactggtcctggactccgaattacacccgacgtcgacttggtttaggcctccaccttgacttggacgtccccgatgatcctccatggctctaagtccttctccaagtgtctccttgtcccctccattgttcctaatcacaatataattattaggtagcaatctattcttgaattcatacaaagaagaacataggaatgaactcacctctaaatttaattgtcgcgcacgagctcttgttatcggtccttgaatgaccgttggaggattgttacgtgtatccgagacagtgatgtccgcatcaattagcgcttggttaatcgaatattaattgttgtaaacttgaaaatgatttatttgatttctttacgcttttttatatagaaaacttttatataaaacacatcgtttagcatattgaaaaacgtgtcagtaacggaaaaactactgagttgccctcccctaccacttaaatgaacgggaccttagtagccgcgccccgcccctgttgaagtcttcattcgttttcctccagccgcatttcttgctccccaaataggccaaatcacagctgatactccaactgcaaatcaggtttcccgtcttcatatcaaattgcattaaccatccaccaaaaaaaaattgcacttcatatgagagttttgccatacgacacatttcaaaaaagtatggtcaatggtttcatcttcaacacataattgaaacttcttttcctttacaacttctcttaagcaaattatcctttctcaagatactactccttaagaggaacctggtaaaaacttcgatttttagaggaattttcaacttcaaaagtctttaagaagtgtaagggactcattgcaatttcagagctttataaaaggatttgacggtgaagacaccatccattgtcgatttccaaaaa

SEQ ID NO: 1386 - DNA, 1501 bp, Oryza sativa
catgtcttcttcttttttggttgtattagttccaatccgtttcaagcttcgttttgtctttctcgtagccaccaaactgctgcccacagcagcaacaccaacacgttgacctagctagtaacaaaattaatggcttgaatcttaggaactactatgaggcttgttcgccggaaaccaaataacagtcggatgtaagcaagaaaaagaaagcgcatctgatgcagggatcgattgattgccctgttctagatcgatcgggtactgtctctggaagatgcaaattccctgtacgggcaaaagaagaaattttgaaggggttgggaggggggggggggtgaatacctgagatttggtcgatcggcaggattcgtacccgcggcagaggaagatgcagagcacggaagcggcggcgcagccgtttggatgaagaagaagatgatgatttgtatatatatatatatatatatatatattagaagatgatgagcaccgacttgacctccaactctaatccgaaacgaacactgaaccgatagtcaactttcagcaagaggcaggcatagcgccgccggcaacggacagccggatcggtggcgtggggctaggtcgccggccgccgcctggggctcgtctgctcagggatagggcagtcatcactcaatgattcccccccccccccccctctcagagagggagggtgaaaccgtggagaagtgaggttggagaggaggggcttaccagatcttgatgactgtcgtcgcccctgcccgccgtcgccagcgcctactgccgccaccgcttagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacggctactgtagcgggccggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgcccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcacaggtttgaagagctcgcggttggaaagatgtaagtattattcaaatttgtgtattatttgtattgtgtttgtgaattcaataaatattcgaaaatttgtttatgtcggtttaaattttcagaa

SEQ ID NO: 1387 - DNA, 1501 bp, Oryza sativa
taccttttaacaaactatattttctaaaagggcagagaaacagtgcataaccatattatgcatcagaaggaataaaacctcttacaaagtcaagctatataagtacatcctgggaaaaaacgagatgctgccattgcagcattgcccctgctaatacatgcatgacattgtatatctacgttggtggccaacggcgcaccaagcgacacccaacttcttgtatggtcaaggccgccacttggttgcagagccaagaagacgggtcttagagaaatggctcattgaaggtcaagattttgccataaatggctgaaacatgatgtgcacttttaggaacgatttgtgctaactcagagttggtcgggctcagtgaaggtcaagatgttaccataaagggctgaaacatgatgtgcacttttaggaatgatttgtgctaactcaggagttggtcgcgccgtatattcctattgtggatagattctgttgtcttgtgtgttctagtagctgttattggcccatggcatcattgtagttacgagtactagttagacaagattacatgataagacattgaccaaagtcgtctcggttatctttcacctcacagattcctcacggacctgacgacttggttcatgaggactcatggacctcaacaactagaaagaactaggatcagtttgctcgcgccaatacagcaaccttcgttcaatccccacaaagtggggcggcattccattttcacccaggccttaacggcgcaactagagcaaacgcacaactacaaagcactaggattggtttgcaagcgccaatacagcaatcatctttcattccccacaaagtggggcagcattccattttcacaactagagcaaacgcacaaaaactaattgaatggggcgtgtgccatacaaattttgtctgatgcactttttgcacaccaggccaccacccaattctgaagaattgggtggagtaactgggaggggaagcagaccgaaaccaatgactaacacacaaattggacaccaagtccagtcgattgtatcagacagaattggggtcaatccgtctcgacgaggaggctaaagatcccgtccacagcgatcaccgccagatccacctaaacccaccacacccacaccacaccactcgcaccaaaccaaaagtagaggaaccaagagcaaattaaaccccatgccgccgcgcgatcgagcggggcggggtggatgatcgatagtggaagctaacgaaaccctaaaagccttaagagaggcggattaattcattcaacgatgggggaggagatggaaacgacgaagagagagagctcacctcgccgatctgccggacggtcggacgaacacgacgggagggggggatcgtgtggagggcacgcacaggcaccgcggatgcgggaagggagcgcagctaccacgcgacgcgacgcgacacacctccccctacccacctaccgcgacgcgacgggcggcgcggg

SEQ ID NO: 1388 - DNA, 1501 bp, Oryza sativa
tcaaaaatctaatcaagcaaaccctgtttaataaacccatttaatttgcaaaccctgtttggaacgcagtaatcccacttaatttcgtcatggctgtatcaattttcgtagtaattccacacaaaatggatcaatttcagcattgatacaaatttttttaccgcgttccaaacaaaacctaaaaattatagtatcattaggcgttgatcacctgaattaatgcttaattaatcttcttccatccctctgtggctctgtgctagaggaggttaatcaagctatttaagcaagcaaaccctgtttggaacgcagtaaaattccatttaattttgccatagctgtatcaatttccgtagtaattccacataaaataggtcaatttccgtatgaaaataaaaaatctccctccttccaaagaaagcctaaaaatatactactactccagtaagtatgattagtcccttgatcacctggattaactcttaatcttcctcatccatccctatatgctagaggaggttaagcaataattaagcaaccattagccatgaaaaagacttgactaatgactagtacaaaattcaattcaaccttgttgtcaaaaaggcggttaaaaaggaagcaaccccaacccccctctccctccctccatccctcttcttcttcattccttcctcctccctcctcttcaaccatcaccaaatccacacgcttcccaaaaatccaaacccaaattgcaaccccccaatctccattgccgtcgccgccatgatcatcaagacgctcaaggcgcggatcctgtgcgcgctcaagtcctcgcttccggccgccgcgtccccgccgccgtcgccgaccaagccggggcgagccgccgcggcggtggtggtggtcgcgggtgacgcgttctccgacgacgcgtccttctttgacgcccacgagaccccgaccaagaacggggcggagccgatcgatgattgggagctcgtcgacgaggagggtcgggttggggttgccgcggcggcggcggaggaggaggaggaacagctcagggagttcccggcgaggtgcccgccgggaggggagggggcggtggtgctctacaccaccacgctccgcggcatccgcaagacgttcgaggactgcaacggcgtgcgcgcgctgctggagaacctcgacgtcgcgttccaggagcgggacgtgtccatggacaggggcctccgggacgagctctggtccgtcacgggggagaaggccgtgcccccgcgcctgttcgtccgcggccgcgacgtcggcggcgccgcccaggtgctcgccctccacgaggacggccgcctcctcgccctcctctcgccgggcagcaacaaaaacaggagcgccgccgccgccgccgccaagtgcgacgcctgcggggggctcaggttcgtggtgtgcggcgagtgcgacggcagccgcaaggtgttcgacggcgagcgcggtcgcggcgtgcggtgccgcggctgca

SEQ ID NO: 1389 - DNA, 1501 bp, Oryza sativa
cgtactacgggcttcgcttgctccacagcttcctccacccggatctcgtgcttcgcctcgagcgcgggggttgccgcggcacgggtgccggcgccggggggcggagctacgcgctcgtgccggccgacgagctctcgcgtgtgctcgcgaggtgagagactcgctaatggcacttccgttttccatttttttgggctactcggaggggggggggatattggtggatgctagtgagcgcaaaatcgaatttagttcaatcatgtggctaagggggatgatctccattacttccgttttttcatttttggctactcggtgaggggtattgatggatgctagtgagcgcaatagaatttagttcaatcatgtggctaagtggaatgatctggtacatgcattcctgattcctatgggtacatacatgacctttgacctggttgattcagcattgagatctaattagtttctaatgtattgtgagttccatgattttttgaacttcaataagcttgaattctagttaggggaagtgtatttagcaatccctgaaactcgggaatgctccatggcttggtatgtgacctcgaaaggatgaattcagcatttcaagctagattagtgcctcgtttgtaacgtgagggtggcaatcatctatccatactagagccacaacgtgatgctgagggcagggcttgtaggttgtaccagaccatttgctaggtggtgaacttgtttcttgcattgcttgatggttaaatatgttgtcccctttcagtctagacacatatgttttagcccattttagctctatgcctttgctatagattctttcctccaacttttgaacctctaacatagcaatactggcaatttggcatggacagttgcaaacgcaacggacttttaaaactgtagcgtttcatgcagcttcacttctgatttgtgggaagccaggataaattactcttaaagaaatttctctataagctgaagttctcaacataatataattgcatgtaaaataaataaaactgtaagtcatgatatagttacatacttacatttcatgcagggctatgctaacattgttcgcatctccatgttgcgcaaacttggagggtgcagttaggattttttttttgtttggctttcttaggaagcaaatcaaacctgtctcaaaatgattgcttttaataatgcataaattttgcattcattatctagtgagagtttagtgtctcaacagcaatgctgatgggttcatcttcctttctgcacttaagtttgtgctgtgttttcttacttgaattattgctttccaaagtaaggtttctgcaatatgcttgtcaataaaatcatgcatgcatatgatgtgtgttgctctgttctgcatctttttgcaaataggatttactgagtgagcacataccaagtgttgaggctcaactgtttagtccagtagaccccattggttgataggtgcaattttttataaatacat

SEQ ID NO: 1390 - DNA, 1501 bp, Oryza sativa
acgacattcctatggagacgccatcgaattcgggctttcatagcgacgacaccatctctatgttaaggaggaaagagatgaatatttgtttttcagagtaaagagatgcagtttgtagcatttatttaggttgccgagtgggtcaacgggtattatgagatatattttcctataacgtggtccttattgtaaagtttggacagaagtacaaattaaaatgtagtgtaggggcttaatcacgatcaaaggactgaaatgcaaaagagttaatttgtgggcccgttggggttatcacgcgtcctgtttaatattaaatcaggaaatatgttttagttgactttattgaattagagttaataatcaagtacctatagccactaaagtgatttattttattacccattagggtagaggagtcaacggttctatggaaaaaatgaagtcacatcacatgacaagtactccctccatttaaaaaaaaaggcaatccatgaattttcgtgccaacgtttgaatgtccgttttatatgaaatttttttataggtagtattttcattgttgttagatgataaaacatgattaatattttatgcgtaacttatctttttaattttttcataattctttcaaataagacggacggtcaaacgttggacacggaaatcagggtttgtcttttttttttgagacggagggagtagctgagcatggttgtgacttgtgaggtgctcaccaaggcatgcagttcaacctgtcatccatgttatggagtatatatattcgtctatggcatggagtatatgtgttttgtagattgcaacttagaaatggtgtaagaggtaaccatgagaacatatgtgaatcaggaagaaattggcccccaccgaaagctagtcgaacagagaaacctactgtcaaaaggatattgtcaacatcagttaccgattaacttattttaaaagtatgttaatagctctggttggatggtcaactttccccatctcctctcctcccaactttcccctttgctacagtagctccttcttcttctccggcccctcttgccccccaaattccggtggttcaccgccggtgagggttggaggaggggtccggccacctctcctattagtacagtgtagctaggttgtagtttctttgtcaggtttttcctgttcctgtggctatgtctcatttggttacgttcaagcgaagagccctggttgctggtggtgatgattgccggagttggagctgcgacttgaaggacagaatcttcttcttatgctggtgctgaactcgttggtctgcgccgtgtgcagacggcggttgccttggatctctggatggcgctgcttcgtacagcggcggtggcggccctggatctctgggtgccggtgctctgtgtggtggcaacggtcttgaaatttctggcgatgttgctccgagcgacaaccttggcagcccaagtgttgctgctctgtgtggtagtcttcaaac

SEQ ID NO: 1391 - DNA, 1501 bp, Oryza sativa
aatcacaagtgattagcatgatgatgtgtacagtaacagtacatcgtaccttcgtacaataacagctacatgcacaaactgtcaaactgtatacctgcacacgtgaaactgtaaatttcggctttatatgcaggtcgacctactgtgctactgttttttttttctcctgatacattatccgaagcctatcaattagtctgcattagaacagactgaataacagactatagccgactataaacatattttaaatagataaaaaagaagatataaaagtagcggggcaacaggctacagatttatagccagctgcagtataaactttaagatacatgtgtgtatgataggtgggaccaaacattaattatgtagtacatgtttatagataactattgtacgaattagctattaaattaactatatatgatttgaagccaataggacatagccatggtttgaatcaatattgtcaagctagccaatcaatcaggtgaagagaagtaatctaactttattattattgttattttcataagagacaaagtcatgatcttcttcctcgctgtagcggcgccccctatttgaccatttcgagtcgcttccacgatggtcaatatggtgaaggatattgccttatgcatcgtgcaaaacctctcaaaagtagctccagaacacacggtaatgggttgtttgattagcgaccaaaggttgtcatgtcaaaactttggctgccattatcccatatccctgccctagcgtccaacgtcacctccacctttgtctctttacatatgtacactctaatcaatctcgtcgatattaatttgcgataagaagatgctattagaccgttgataagcttgaaatttaattataagtataaaagtgatcttttgcaataaaaaatgttagagatatggaggaaactcaatggtccatacgaaccaaacataactatctattgtaattaatatatactcttgtcaaacatgctgcggagtgcatgggcaatggaccgatggttgcatgaagggaggaactctattatgttgttcacttgatgaatggaggaactcattgtatccagccattttccctttactttgattgttactactagtgcatgctggcttggtcaaaacactgaatagttcagccttatcttctcatcctaatgttcaacttcagcagcaaagcagggcaatttggcacgtgaagaagctgacgtggcacaaccatgcacacacgatagtcaactatacttgccacgtggctagatatctgcccccaaagtcaatggacaaatggatcactgccacttgggcccggatatcgagacaatgggtcactgactcgtgggcccggatatctagttctattgataccgcacgtctcaactgcgcttagctttagtactatttatagacgtcacccgtacagttgtgctgagacaactaagctaagtgggcagtgggcaccaccatgtcgtcgtcgtcttcct

SEQ ID NO: 1392 - DNA, 982 bp, Oryza sativa
tcataatgtaagtcattctagcattgcccacatccatatagatgttaataaattgagacatgtgtttatatctagattcattaacatttatatatatgtgggcaatgctagaatgacttacattatgaaacggagagagtaatagtgtttgtggaagtaaagtttcaaggcaaatctaaaaatatatttttgataaatctgatataattgttttaataaaattggtgttggtcttgctctattccatattacgcgatgcttttggatctatagttaggtcaaatttattcaaatttgtccaagtgtacagtacatacaaagatgtagcaccgtttccaacacaaaacaaatagaccttaagggtggatttaatgatcaaactaattttgatgctgaaaatgttcctacatttttctatgaactcagctaattttttttaaaaaaataacttatgataaatttgaagtgttataatatatgaaacggagagagtaatttttaaagtttgacttcaaacatgttcgaaacagcatactttggtgaccagggcatttgattgtgatcatatactaatagaacatgaacaagacgacaaagatcaaaagctagtagcaaccacacgatcgatcgtgcgtgtacaaatatattcgaatcatcggcgataatttaataattattcaaagcagatgagagagtacgtgcggatccatcagacaatgtacactgtacatatgacagcatgcatgcatgtgtaagaagagaaataaagtcgatgtgcgaatgccttcagatcgactcaaataatcgatagatgctgtcctttcataaatttatacatatactaacttcggctagcttcagtgcttagtcggttcattagttatcatgatacttgtacttaacatcatatgcgcttaattacaacatacacattcacttctataaacacatatacacccaattctataaacacctttgaaga

SEQ ID NO: 1393 - DNA, 1501 bp, Oryza sativa
gttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccaggccgcaacctgggcctgggccgggaaagtggctcgccgtgcgctcccacatgggccgatttcggtccggccgccgtcggccgtccgatcgctagggtttcgatcggacggtcgcgcgggcggatcgggcaaacaaaaccgcccccggccgccggcgccgaaaccctagctcctcttctcttctttctcttgcggttgcacggagcggcgtcgccgtcgccgaaaccctagcacagcgccggcggcggcatggcgacacggcggcgccgtcgcactccccttcgccgatgcgcgcactcactcaagggtgagtgcgccgccgtcgagcggttgtgccgcggcgccctctcctttctcttgcgggcgtgcgccgtgccgagcggcgtcgccgacgccggcagccttcgcgccgccgcgccatggccgacgccctcgcgccgccacgccctctattcttttctcttctcccccccaccgtctcacccctccacgcgagtgaagagtgagagaccggcgacgacggagatggtggcgccgccgcgggccccctcgccggcgcgcgcgtgcacccgcgggtgcgcacgcggctgtcgagtggctcctcggcggtgcctctttgcccctctccccctccgtggccggcgtcaacgacggccggcgacgaggtaagattagggttagggtttcgatcttttcgatccgttggatcgtttgcttttctttgcctttcttttggatttctttccccaaccaatctaaactctagggtggctttgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggccggtcccgtcccgtcactggctgcgccccctcgatcggttagggtttatggggtggagtggcggcggcggcgacgaacctcgttccttgtgtcgttatgccgtcccgtcttccacccctctttatatggcacagtgtgacgggggcccaccagccattgggctgggcgcccccgatcagggcgcgggtcaaggcccccttgagccgttgggctcaaggggagggagatccatctaacagttctttctttttttttcatactccctcc

SEQ ID NO: 1394 - DNA, 1226 bp, Oryza sativa
cccccccgcgcgccgtcgcccgttgcctcgcgcccgcgcaagccgagtggccgaccgcccggtcgccgccgccgtcagctctgcccgcgccagtcgccgctgtcgccgctccgctccaaaccgcccgccgtcgtcatcgccggcccccgccactccgcgcgctagccgccaaggcccggaggccgcgcctcacctccctctgccgcgtcgtcgccccgcgcccaccctccttttcccgaatcggcaaaggagagaattcctttctcctcctccttttccccttcctcctttttcctctcccgccggcgtcatcccgtctgccaccgctttggccgctagccgagcgccagctcgcgctcttgaccgcgcaagtcggttccccaaaccgacattgccgcctccttaaacccccggcctccccttctccttccctccccattttcgcctcctccactgccgtctctattttcgccgtctccaatcgtcgccgcgcgtgtcggaggagccggcacgagcgaggacgccgaagaggactccggccgcgcctcttcttcctcttccccggcccgaggccggagagatcactcccgcgccgtcggcctctcgtcacagcgcctctccttcccgcggtgatgtttcgcttcgttctccctcctcgctccgtctcccccccttagacttcggatttagctcgagtagacctcccgtagttggccggcgccgccccgaccgatgccgttgctcgccatgtgctcgtcgccgtcgccgcccgagctccgaagtagccgcacgtcgccagcccagctcggcatagctccgtccaatccaaccctagcatcgagttcccgtggccttgtagatgctctcaccgccggaaatcgacctctcgtggcctcgtcgccgtttccctcttctcccgccgccggttgcggccgccgcaatccgccgccgccaagcaacctccggcgaatccgagccgttggctcgtctcctctcgtcccgtactactgcccggcgtgctcgccttcgccggtatcgccgtggcccgctctaccgctcgccgccgtcgcccgccgttcatttgcggccggtcgtcgtctacctcctgccagcccacgtggccgccacgtaggcgccacgtcggcgccagctcggctgagctcgggacgggccgaccccggccgatccctccccgtgcgcgcatcccaccgcaagccgtgaggctg

SEQ ID NO: 1395 - DNA, 1501 bp, Oryza sativa
caatcatccatcgcaaatagaaccacccgactagatctaaacctaggtgatccaatagacaaccctaacaatggtatcaaagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgtattatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctact

SEQ ID NO: 1396 - DNA, 733 bp, Oryza sativa
tggttttttttaaaactgtccatttttacagttatagtgctactgaatacttatagcaatttatatatgtttgttttgcaggcagcatggtcactattctactgtaaatatgatccagcataagtgcacttcgtatgtacatactatctagaagcttgatatactatctaccaaagaaaacctaggcttcctatttcagcttgtttagttcggttagcactggggtgaatgaacatggaaatgccatacaatgtctcctatttcagcttgtttagttcggttagcactggggtgaatgaacatagaaatgtcatgcaatgtctctgcgtatgtaatccagagcgctgtgtgtgcttacctctgacgataattttcgtgtttgcctgcattctttcgactattctaattatcacctgttctttttaacctaactgtgcacagacggcgcgccattggcgcgccccaccctctagtatatatgaaaatgtcgtttggaccatgggagcatatgctcccacgtccacagccgttgatatgcgctgagattggtagagcatccttggaacggcacaggctgcaaacagtgaccaattagattggtcaacagccgtcaacagtagctaggcataaaaaacaagagattggaacgcacatttacaattgtaacccctatgcaacatttgtatatataggcacatttaacaccaacgttcccatgttcccattctcagcc

SEQ ID NO: 1397 - DNA, 1068 bp, Oryza sativa
aaaatggagagagcctttgggaaagtgagaaggaatcagggagaggaggcttttccaaagaaagaaagtaacatgcaaaagagcagtatcagtgaagttgttgtttggtgatacttattcccctctctctttctttgcctctcttctaatttaaatttgagggaagaaggaggaggagttgaaggtgaggtgagctagagtgttcttccttggcttggcctccattgttacatccccctccactccatctcttgcttcccttaacccctcccccaaaaatcccccccccccccccttgccttaaccccaaccccaaatccatccttccaagcttcaacttctctggagctttgctgttgatacctggacaaggtaaagatttgcccctttttttatttgcttgttgttgtttttagtttgctattaagccgccagaccattggaaacagcacttcgccttccttctgtgtttcctgcatctcttatctctcttggtgagttcttggttttggctgttgaattgttctcttgtttttctttttaatcttcttggtggtgttttcatggcgtttctttgattcagcactactttcttggtactgtaaaatgctagtagcaaccaccctcttgttctagctctcatcgattagtaaacttgtttcccttccattcgatgaaagccattttcatccaatccatcatgttatgctcagaaaccagaatgtgtaggttttgcctgttcttggtgcaattgctgctcgggccaactttgtccatcggctagcagataattccagttactaagtaactccccatctcttgcggttattatcatcacggagcaatcggttcctgtcagttcttaccaaaatccaaaagtcagcggttgcatttcatccccctcctgcaacacacatacctgacgaactcctccttggattcttggtgttctcctcggccattacactgttttttttttctcttaggagcatagattgtagcaagaattgtttcaggctgcgcagattgcgatgactgaaccatggagtgcgttgtttgcaggattaa

SEQ ID NO: 1398 - DNA, 1501 bp, Oryza sativa
cccacagcaactgtttcactatggaagtataccgatgaacttcaggtactctcttggggatcctaagtgataattggttgctgtgcctgactagtcagcatctgtaaattcttacatttttcttctgtttctttccctgatccctctacagaggaaattgggagattgctaggcaagatctccatgattcccagataataacaatggtgccatcggagcgcgacttcatggatggttatgaggactacttacccattaggacgagaagcagcaccctgtgttgccgaacagtcgccataattgtgagattccttgcatctggatagataaatatcctttaatgacaattatctatcacccagttcaatcctggctaattcttgtgtttcctttctgatggaattctgtccctgtgattgaatagttcatgtcactcctggttcttcgccacactcttcctcttatgattggtggggatggggagtactcgttggccttattctcggtaagatcgatgtccaaattgagtttagatcatcactgcaaaaaagaattatcacacttatcttgaagatcaagctcctgactgagtgtctgtacttctgatgggggtaaaagcttcttgtcttgaggaccgccggaatcctatttccaatcttggtcatggtgagagcattggcaaccttccatcgtcgtcgtcgccagcaggtaattccatcactgcatgatctgccattgttggagcctcctcaggtgcagtgaaatgcagtcctaatcctgctcagttagcttgagcaggtctacacctgagcagagtcctccatcttaaccattcatagtatatgctacaatcttccttggctggatcataactctgggatctagatcacttaaccctgcaggaaagacgggaaatgtatatgacttcgtcagacagcgaagaggaggaggattattcagataccgatcctgcacagccaattcattctcagacacgcctggtaccaatctactgacacgatcaagaacgatgccaaaaaaattcaaaaaaagaagaaaaaaagaagaggaaggtgaccatatgtgacatagtaaatgaagatagtttgaagccactcgcttcaaggtgcccttgcaagaatgtagtggctctgtacatatgagaaaggaacagatcgctaactaacccaagatgctgtaacttgagcttctctagtactgcaagcaagttcagctacccactataagtattgaaaaggttgttattattcagattacttgcaaatggaaggaaatacacgtcgttttctggatccatccacttgcatttttcattttacaatcgcaatcattttcgtctataacagtagagccagaatggcaattaggcattccatggctatcatcaactcagatcgtcaacccatgtacgttattgcctgatcgattggtgaattgttgattcagctttcatagcacagagttctgcatatctgatgta

SEQ ID NO: 1399 - DNA, 950 bp, Oryza sativa
tgtcgactgcatggcatttattctgggggtgaaagcaaatcgatgcatgcatctgtatgtacatgcatgtgcaattcaaaaacctgcaggcgcaggataaattcaaatagaaaagaaaacgtcttctagtaccaaacatgaatccacaaacttccaaacacattaatcaattccaccaaattacagcttggatccatgaactttcaaatttgatcccgctatttccacctggcgtggccacagcagctggcagagacgtaatcagcctaattatgcttgccgttgacattcccaagcatagttggtatcttggttctctctttttcctcggttaaattaaaatataggttgcaaatgtgcgaaaagtctcaaacttttcctttctttaaactaacctttactctaggacgcccctgttttgcgagtggagtagaacacgtcgtcattgccaaatgacactctctcttggcctatcttttcttaaataagttggattaatgtgataacgataagaatgatagtgtttgagccgtcttttcatgaagagacgaaaaaaataatcaattaattaattaattagcattgaaatgaataagtagtactatgtatcattgtgttcttggattacttcataagacgctcgatcgtgaaaatagttttaataaaatttcaacaaaattatgttcgaaacaacaaatatttgtgatcggaagtacttgtatattcacctttagaaaatagaaatagatataccatgaactcattcatacaacagccggatagatatacatcactactcatctagaccgttccatggactacatacatacgtatggtatatctttgctatttatattctatatatatatccagcctatatatagaggaaagaattgaatgagatagatattggagatggcctacagctactacaaacggtagaaaataca

SEQ ID NO: 1400 - DNA, 1501 bp, Oryza sativa
cgccatggagcacttcctcgccgccctcgccgtgccgtgctccttcaaccacaagggctgcgccgccatggtgccctacggcgagcgggaggcgcacgaggcggcgtgcgcccactcgccgtgctactgcccgatccgcggctgctcctcctccccttactccggcgtgtccctggtcgaacacctcgagcgcaagcacccggagatcggccgcacccgcgtcgaccgcaccaccctctccccgctcagaatgtgccacggcgagccggcccggctggtgtacctcgccggcgacgacagggacagggcggtgttcctcctcgccgtcgaccggagcgaggcgccgcgaggctggtcgctgtggatggtcaggctcaaggcagaagaagaagaagaagaagacaagggggagctgaggtacaagatcatggtggccgccaatggcggcgtgctgtcgctggtcggcgagacggagagcgtggggcggctgacggcgccgtacagggcgagctccttcctgttcgtcccgggcgccatgctggatgctccccctgaggctgagggcctcctcgtcttcgtcgagctcaagtgagctcaattagcgctgttgcaatacgtattacaagttcattagagtctactgatagtgatatctccattgatgggatcatgcaagtgtgcaaatagatatacaattgttctgaatcgattatttgaaaaaaaaaaaaagaacaagctcaacagaggctataatggatgccttgtggatattggccaacagggacaagtccatcatataggttcagacttcagacctcttctcctgataggagtttcagatgctgtgctgcatgcaacaaaagttagcagcaattttttctgtattcgtatacatgaatctagaagccgacacgtggatgcgaaggttgtgccaaagaaaatactgtgacaagttgtgtgcattatacgatcctaactactgtatcatggctatatttataggtgcttgcgatcgaataacttgctttgaaagcatgcaagaacccaactatacatctttaggcgcaaaattcccatctttatggtgcttggtgccatgaactgaccttagtggcaatgaatgattattactgatctgagaaagcctacgatatcttcagacttgaggcatcaatatacagaaaatgacaactcaacacgacacactccctcaacatcatcttcttctttgctatgggtcttcagtgcaaaaccaaaagttcatcttttcaagggcaaatcattgagtagtacattgctgataagtgataacatgcgtaatcagtcggcttcttgttatcatcatcaaaagagacacaacaatcgtcagtagcgactgactggcacttgattgttggttgattgcctcatgttcagcttaactgaatcaattgaccagtatgcacgtgttatgttgcttgtttgtaggtagttagttagcaacaacaacacgagttaattg

SEQ ID NO: 1401 - DNA, 1501 bp, Oryza sativa
caaaagtctatttttcctctcttaggttcggtgggccgatttcctctcggcccatctctctctctctctctctccctccctcagccctcctctccctcgtcccgcccgtgcgtcgcacgcgcgtgcgcgtgagccgacgccgagccgagctctccctctttctcgttctcctgctctccctccccgtctctctcttcccggcgagccccgcccccgagttttgaatcccccgcgccattgcttcccgcgcgcgcgcgcgccgtggtggccgaccggccagtcgccgccgccgtcagcgcctgccgccctgtagccgcgcccttccaaaccgcccccgccgtcatcgccgtcgttacgacccggccccgccaccaccgcgcatgctcccaaggattggaggcagagctcctcctcccactgcctcgtcgccctctctctccttccttcttttcccaaagtggcaagaggcaagtctcctttcccccttcctttcttcctttttctccccgccggcgtcatcctccctatcgccgttttggccgtgaccgccgagcgccagcttgctctttgaccgccctaggtcggtttccaaaccggcattgccctcctattaaaccaaggcgccctcccttcctttccctccccattccccctcgctccaccacgccattgccatcccctctgtctctctatcgccgaccgctgccgtcgcgtgtgccggaggagccggtgtgcgctaggacgcggaaggggactctgggcgctcgtcttcttcctcttccccggcctgaggccggagagatcactcccgtgccgtcggcctctcgtcacagcgccctcctctacagcggtagtgcatcctccccgttctccctcctcgttcctcctcttccccttagctttcggtagaagcttgtatagcctccccgtagctagctggcgccgccccgaccgttgccgccgctcgctgtgtgctcgccgccgtcgccgcccgtgctcggtagcgcccacacgtcgccggcctctctcgtagtgtctccgtccaatctgacgctagaaacggattcccggagtcgcgtagatgctctagctcgcccgaatcgacctcccgtcgcgccgtcgccgtttcccccttccctcgccgacggttgccgccgccgcaatccgccgccgtcgagctccctccggcgaatccgagccgttggatcgtctcccctcgtctcgtgcaaccacccggtgtgcccgcttccgccggtatcgccgtggttcgccccgccgttcgtagccgccgtccgccgtccgttttggccggcgccgtcttcaacctcccgccggcctgtgtggcagccacgtaggcgccacgtcggtgccagctcggctaagaccgggtcaagccgacctcggtccgccgctcccctctgccccgctcgcgcgcgcggtccaccatgagccatgaggctgcgcgtgggcccgccgcaaccgcacccccgcgagccgcgcg

SEQ ID NO: 1402 - DNA, 1501 bp, Oryza sativa
aaacaggtaagcacttattctcgtatagtcaaattgtagtatccattcattgactgagattttgttggtctcccaacataatcataatttcatactactacgctcctgacgtcaaaatgcagctgcagccaaaatgacctataaatatccccgccataaaaaaaacccttataaatgagacaggctgcacgcatcatctctcatcaatttgtgatatgcctctctcagcagcttccatcaaccgtgcatcctaccaagttctcctcctcctcgccgccgccgccgtgtccaccacgggcggcgacggcaacacggcgcccggcaatgccaccgccacggcgacgactggcggcgacgacacggagatgtacatctgctacctctgcaccgggcgcaacccgatcctgatcaggaggtgccccatctactgggactactgccacctcaactgctttgacgacgcgccctccaccgccgccgccgccgacgacgtcgccgccgttcccgtggcctcgccggcggcgcctgcgcgacgggtgggcggcgtcccgcgcgagaccctcgaggacgaggagtgctacgtcatgaagctgtacgagaacggcagctacgtcatcgtgaccacgctgggctgctcccagaccgcctcgtgcctcctctcctgcggcggcggcgacctcgcagccgacggcgaagaagccctggcggcggcgcacccggccggcgccgtcggcgtctcgccgccggtgagagcgacggctccccgcggcatgccgccgccccgcgtcgccgatttccagcggtgcggctcacaggcgatgaccgctactccggcaacgagggccatcaccggcggcgtgtagcgaccgctttcggctccgatggacgacgttcgtgcacattaattcgtcttcacatgataaaaaaaaaaagaacagtgcagcaattgtaagatagacataagaatttgcaggaattccaaaggaatcatttcaaattatcgtttctcccgtgttaataataatagaaaagtaaattcaaacagggacgactaaggtgaagaacgtcaatgtaagctggcaaaatcaacatttgtataccacgaaatctatacatttccgtaggttttgatcgcaatttcacagaggtagattccgaatccggccagatgatgggcctggcccgtgtgtcctctcctatacaggctttctggttcgtttgcatatgttgtgggccgtgggcccgtggcccataagccatactgcttgcacgttccatccatcgatcacttgctgcgatccgcggcgcgtcgggactccatttttttttccccgtgagaaatttccaaaaaccaccactctccgccgcgaaccctagtggcgaatgtgggatacaaaattcggtttccctccagcagcgccgcccaccaccgccgccgcagcgcagaaaaatcccaagcggaggagagaggcggaggcggagggggaggtggcggcggaga

SEQ ID NO: 1403 - DNA, 1501 bp, Oryza sativa
gcgctcgaaagaacctcaaaaatcacgaacgcgccccctacctggcgcgccagatgtcggagaatgaactcctccatcagggaaccgtgaggcccccctttgtgagttcggccgggggcagcgggtgagattcagggcttggtgagcgaagctgtgtgatcttgagggcgttcaatccccaaagacgatgagacaaaagagatttatacaggttcgctccgctaagaagcgtaataccctactcctgtgtttggaattatggttgagtgttacaagggttcctaaactccggagagcattctcgctcttcttctcctagagttcaggcctactgagtgtcgtcgtcgtcgtcatcgtcccttttctcagtgggcaaggtcctccttttatagttcaaggggataccacataggcccaacaactaacttcctcgagaagtattaccatctttgcattaaatgcatgtcttgttccttaacttggaagccgcatccacgtcgcctcggtcgtggggcctaccacaccatgccgcctgacacgagggacgcccatgtcattcaccatttaatgggtgaagacttctgggctcctattacatcggggaacgggagcctagctttgaccagagcgggaggaccgactccggctgggataagaggatgagaacctctcaccatcattatttgatgggacatgtcaggctgcacgccgcctaacacacgagcagcgcacaggtgcactagccagttccatcggttattcgaccggtcacagaccggttgagtacactgcacgccggcgtggcgcgaccgctcgggtcgccataaatgcgggtaggtgggcacctgtacgtggtgacctagagaggtggtcgggggagcccgacccctagtcacgggaggtggccgccgccgcccgacctcgggctcgatcccccctcgggggagggccacgtggcgcctggggcagccttttccctctagtctcggccagggagtggccgccatcccacctcgggcctgactctccttgggggagggccacgtggcattggggggcggcctcctccgactagtatttgggaaggagtggccgccaccccacctcgggcctgactccccttgggggagggccatgtggcattttggggggggggcagcctcctccctctaaacatgataaccccgggcccatatcactgacaaagttttattgggaggaaatgattaaattttaaaacccatgataacttctttgcatatactcctctgcagtaaagctcaaggacatccaatcttctcgctaatttagtactatagggtgtttggaaaataggttaggagaggtggaattaggaaacggaaatgaatgaagcgataggatgaaatatggtgagaatgatggatagctaagattaagacttatcctttgaggtgtgggaaatcatatcccaaacctattttccaaacatgaccatagtactaatctctccacctaaata

SEQ ID NO: 1404 - DNA, 1501 bp, Oryza sativa
atatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatg

SEQ ID NO: 1405 - DNA, 1501 bp, Oryza sativa
atcaagggccttcgcctcggcgtggaggagagtgaggacggcccacgcggagcagcagagagtggcgggctcagtgtcgggctcgccggagtccggccaatccggccggttcatgcttcattctctcggtgcgtgatttctccgattttcgtctccatctagtacctgaagcgaggcaaatttaattgcccccttttcggtgcaaactatctcgtcagattagtcgcatgcatgttccttcgttgaattttgcaaagttagttgtagagagaagttcttgggagggtggatgctacggtctcatcttctctcttttcccccaacaagcgagctagcgaaggggaaaatggggggagcagaagaatatccatgttaggttcgcgtgcttgcctctcggctgagctctagctgttacggcgttcgtcaggatggctaatccgtctcgccaattagaagatggataggtcgtagcgttagatggattacttgatggttgatgcgctgcccatttattgttcgtagcaggttctgtcttctcagtccgtgtgagtgtttcatcatattggctaccaagatgatcactcttcgtttatcaagagagtagggtgagatctcaatccgttgcaactgatgagtacttccttcgtctcagaatgtaagtatttttgagttagacacagatattaaaaaagtaggtagagatgattggaggagagttgtgattgatggggaagagaaagtaggtgaaaaaaatggttgtgattggttaagaggagagagtaggtgaataaatagcttcattttgggacaagttactgtactaaaaatagatacattttgagacggagatagtagtatacttcacttactaccgagtacggctttagttttgctacctccgtcctaaaatatagtaacctaggatcggatgtagcatgttactactaatctagataggcagcatgtctaaattaatagtaatatgatgtgactcgtttagtacaatattgatatattttaggatggaagaaatatataaatactgtttttttattcgaagtagttggcccatcatttctgaaatagatgattgatgccatgacgccgcttgctttctagaactactagtaattttaggtgagagctagtactgatgcgtcagtctaagataatggacaaaaaagggctacaggctactattgattatcacattaaaactctgtacgacagatttttctgattaaatgatagccatatgcccaacgtgctgcttgtctaaactgaaacctgacatcactcacagtatgcccagttgttgggtggtctattattatttataaattataactctggcatttttttattgtagggcaatatgttttccattattttccattaaaacctctaatctgcacttccactatctgctcaaaatctcaggctactttctttcctcttcctcaggacattaacctggtttacttgtaagaaagtaaagcca

SEQ ID NO: 1406 - DNA, 1501 bp, Oryza sativa
catactccatacatcacatgcagagagctaagaggtgtcattgtcgaccgacagagttagttcctaccagcacttgaagtcagcatgcgtatgtagaggaaacctgatgacagcgtaactgcaggaaaggattatgaaactaggggaagtgaagctcactgaattggtggcatttgcatggcgctagtgagggcaggtgaaaagcaaaggttgcgttgtggtattcttttctttcagcatttgcatagccctgctaagttggtaactgctgcagatggtattactgcataagctcactttggtagtacatggcccgttgccattcttgcggtactgtcaactctcatgatgtttgtgattttcatctctataggcagtgaccttcttagcagcataaaactgaatattacactcctgcagtagtcactattgtagattctttgaatgacctagcaattttttctaccttaaaaaaaatcaagcatgtgcttcgcttccatccttccagggatggccagtgagcttatgcagtaatgcttctcttccagcaatgtactccatccagcccgattcgtttctgagttcaagtttggctgaagcatatgtccatccagcaatgttgtaccaaacttgaacaaagtttggctgaagcatatgtccatccagcaatgttgtaccaaattcctgccctcattcctcccttgttcaagtttctacaacattgttacatggacatatgctatacactaaactttgattttcttgagagcagggaagccctactgcccgttctttttggattaaaatgtatgtagtctacttcagttttcattatcacgctttttaaaccgttaaacaatatgtttcatgtgaaaaatttatacataaaagttactataaactatcaaataaatccattttcaactttataataagttaaaacctaatcaatcatacgctaatgactttcccgttttccgtaccattacttaatcttcatcttattagttttccgtactactttcactattcactactggagctaaccgataatatttgacaaaaaaaaatcagaatgtgactaggccaaaaagtggaaagaaaacttgcgctggactcaaccccgacccccggggagcgagagagcgctctgatttggatcgtgtcaaaccgaccgacgcaccaaaatgtgggctactactagcctttagcttagctgaccccattatactagtactacaatattagggccacagtacgcctccaccttcctcccccccacccaaccctgaaaacgccaccctctccagatctcccctccgcctcgtctcgtctcgtctcggtctctctctctattaaggagcaagcaaagcggccactccggctcagatctccgcgcgtgcatcccaccacccccaaaccctcgcgcgcgcgctctctctcctcgtcaacgcgcgcgcccccgcccccgccccgacgagagcgatggcctcgccggcag

SEQ ID NO: 1407 - DNA, 1501 bp, Oryza sativa; identical to SEQ ID NO: 1402

SEQ ID NO: 1408 - DNA, 1501 bp, Oryza sativa
cgctcgaaagaacctcaaaaatcacgaacgcgccccctacctggcgcgccagatgtcggagaatgaactcctccatcagggaaccgtgaggcccccctttgtgagttcggccgggggcagcgggtgagattcgagggcttggtgagcgaagctgtgtgatcttgagggcgttcaatccccaaagacgatgagacaaaagagatttatacaggttcgctccgctaagaagcgtaataccctactcctgtgtttggaattatggttgagtgttacaagggttcctaaactccggagagcattctcgctcttcttctcctagagttcaggcctactgagtgtcgtcgtcgtcgtcatcgtcccttttctcagtgggcaaggtcctccttttatagttcaaggggataccacataggcccaacaactaacttcctcgagaagtattaccatctttgcattaaatgcatgtcttgttccttaacttggaagccgcatccacgtcgcctcggtcgtggggcctaccacaccatgccgcctgacacgagggacgcccatgtcattcaccatttaatgggtgaagacttctgggctcctattacatcggggaacgggagcctagctttgaccagagcgggaggaccgactccggctgggataagaggatgagaacctctcaccatcattatttgatgggacatgtcaggctgcacgccgcctaacacacgagcagcgcacaggtgcactagccagttccatcggttattcgaccggtcacagaccggttgagtacactgcacgccggcgtggcgcgaccgctcgggtcgccataaatgcgggtaggtgggcacctgtacgtggtgacctagagaggtggtcgggggagcccgacccctagtcacgggaggtggccgccgccgcccgacctcgggctcgatcccccctcgggggagggccacgtggcgcctggggcagccttttccctctagtctcggccagggagtggccgccatcccacctcgggcctgactctccttgggggagggccacgtggcattggggggcggcctcctccgactagtatttgggaaggagtggccgccaccccacctcgggcctgactccccttgggggagggccatgtggcattttggggggggggcagcctcctccctctaaacatgataaccccgggcccatatcactgacaaagttttattgggaggaaatgattaaattttaaaacccatgataacttctttgcatatactcctctgcagtaaagctcaaggacatccaatcttctcgctaatttagtactatagggtgtttggaaaataggttaggagaggtggaattaggaaacggaaatgaatgaagcgataggatgaaatatggtgagaatgatggatagctaagattaagacttatcctttgaggtgtgggaaatcatatcccaaacctattttccaaacatgaccatagtactaatctctccacctaaata

SEQ ID NO: 1409 - DNA, 158 bp, Oryza sativa
gatctaagccggcggccggtgggcggagcggctgcgggcccacggcagacgagcgcaccggggcggcgaggagaacggcggagaaggcgggtgaggcgggcggcgaccttgctcccgttcgcgtacgtggagttcttccgaccttgctcccgtccagc

SEQ ID NO: 1410 - DNA, 1501 bp, Oryza sativa
ggggcgggggcgggggcgcgcgcgttgacgaggagagagagcgcgcgcgcgagggtttgggggtggtgggatgcacgcgcggagatctgagccggagtggccgctttgcttgctccttaatagagagagagaccgagacgagacgagacgaggcggaggggagatctggagagggtggcgttttcagggttgggtgggggggaggaaggtggaggcgtactgtggccctaatattgtagtactagtataatggggtcagctaagctaaaggctagtagtagcccacattttggtgcgtcggtcggtttgacacgatccaaatcagagcgctctctcgctccccgggggtcggggttgagtccagcgcaagttttctttccactttttggcctagtcacattctgatttttttttgtcaaatattatcggttagctccagtagtgaatagtgaaagtagtacggaaaactaataagatgaagattaagtaatggtacggaaaacgggaaagtcattagcgtatgattgattaggttttaacttattataaagttgaaaatggatttatttgatagtttatagtaacttttatgtataaatttttcacatgaaacatattgtttaacggtttaaaaagcgtgataatgaaaactgaagtagactacatacattttaatccaaaaagaacgggcagtagggcttccctgctctcaagaaaatcaaagtttagtgtatagcatatgtccatgtaacaatgttgtagaaacttgaacaagggaggaatgagggcaggaatttggtacaacattgctggatggacatatgcttcagccaaactttgttcaagtttggtacaacattgctggatggacatatgcttcagccaaacttgaactcagaaacgaatcgggctggatggagtacattgctggaagagaagcattactgcataagctcactggccatccctggaaggatggaagcgaagcacatgcttgattttttttaaggtagaaaaaattgctaggtcattcaaagaatctacaatagtgactactgcaggagtgtaatattcagttttatgctgctaagaaggtcactgcctatagagatgaaaatcacaaacatcatgagagttgacagtaccgcaagaatggcaacgggccatgtactaccaaagtgagcttatgcagtaataccatctgcagcagttaccaacttagcagggctatgcaaatgctgaaagaaaagaataccacaacgcaacctttgcttttcacctgccctcactagcgccatgcaaatgccaccaattcagtgagcttcacttcccctagtttcataatcctttcctgcagttacgctgtcatcaggtttcctctacatacgcatgctgacttcaagtgctggtaggaactaactctgtcggtcgacaatgacacctcttagctctctgcatgtgatgtatggagtatgcagctcatttccctgacaatttctca

SEQ ID NO: 1411 - DNA, 639 bp, Oryza sativa
ggtctgtgaccggcctgtcaccgtcacatccgatggatagggcaaccatgtcctcatgtcgcccttgtacccggcggagtgggggtgggtatgacccgtcacatccgagcgtcactcgaggaagggctgtcgcaagtcatcgttcatttatgagggaatgacagggctgtcccccgtgtcaggcggggggcggcgccgggttgcactcgagaaccggttgttgcttagcttccgggagaaagcacggttggaagcccaaagtggagtgggatccccctcctatggagggtaggtagaggcagtacatgtggtatccccttgagctataaaaggaggaccctgcccactgagataaagggacgacgcccagaaaacctgaattccagaagtgaggaagcaagtgcgctctctggagtgaagaaacctttgtaaaactcatccataatcccaaacacaggagtagggtgttacgctccatagcggcccgaacctgtataatccgactgcgtgcaagcttgccggtaatcttagggacgagcgagtgatttccgagagacgagcctccgcccccggccgaactcacaaatggggggtctcacgactccccgctattgaggatcttccctcgacagctggcgc

SEQ ID NO: 1412 - DNA, 1501 bp, Oryza sativa
tactttacaatagtccattccatatgaatttcaaaggaattggtaagaatcaatcctttgtttcaaaagatttcataggattatatcctgtagagtataaattctttggaattcctacatttttcctttgtttcaaaggaggcctaatagaagttctccaatgaaactgatggctaatattgagttgtatggcttctttagaacacagattttagaaatataggaatagtgaaaaaaaaacatcattagactgtcacgtaagtacgaatccaacatgggaattcgaaagatgatgtgtttggattgctcatggaaaaataacaaacaaattcggatagatttttgaacgagagaagaaagacaaatagagtagttgcattggaattctcaaatgaaaaataagaagaggctcagcccatgagttgccatactttcctattaaatagatttttttccaatgtttttcttcatctgttttcccaaacaagactaaatttggaattcgacttttgtgcagttgctaagttaaggacacctttggaacacaggattttagaaatatggaaacaggaaaaacgttggattaggatatcatatactcccttcgtcccataaaaaaccaacctagtacttaatgggacacatcctagtgcaacaaatttggacatacctctgtccggattcattgtactaggatatgtcacatctagtcctacattcattttttattggacgaaaggtaggtacgaatcccatgcaaatctaaacacgcgaattcaaaaaataatgtgtttggatggctctaaggaaaacaacaaatgaatttggatggattttagagagagacactagtaccgatccttccatctgtgacggcccctagcaagactagaatttgtgggccgtcacaaggaagtaatctcaatcgggtcaaagtttcgcccaattgagatatggtcgcatagccatggtagatcggcataaaactagagcccgtcacagatgacacttatctgtgacgggccatagttgaggcccgattgagataagggtgccatatctcaatcgggccctaaaagaagcccgtcacagatgagggtcatctgtgacgggctccaactagaggcctgattgagataagtttaatgcccgtcacagatgacactctttttttatgggctttaattaaggcccggtagagattacttgtatgcccgtcatggttgattgttttagggccgttacagatatttgttgcatagtataaataccccccacaacctagtgtaactatatcccattgttcactattttggtgggagggtatagggggtggttctttgtcttttttgcaaggaaaacagaaaattcccaaaagtgattaaaatggagcaatcaagtgagtaatattaatcattaattgagcaatttcatcacgtcttactttagcaatactgatcttataagatgtacctctaatttgttttttttattttgtagc

SEQ ID NO: 1413 - DNA, 1501 bp, Oryza sativa
aatggcggcggagcggcggccggaggtggagagagagggagagcgcggggagagcgtttccggcgacggcggcggacgggacttgaggggatagggagaggacgactagagggtcctttatataggcacgggagctccggatcaagccgacaacgacgggaaaaactcgggaaagtctagggttctcgccggaaaaaggaaggatttgatccgcgaaattggaaagaatttccatagaaaattttggtgattttttggggaaaaggaagaggagattgaggggattccattcccgcaactaatttggaaagaggagcaacgggaggttggattggtgggaggaggcggcggcactgtgcacgagcacggctggctcgcctctgtctggaggaggaagatggagtactgtagcgccagggaggtagatcagactttggctgggctgtgaggaagggagagaatgggctgaattcggcccaggctgaggaggaggatttttattacttttccaaataaattaaccaatgagatgatctttcaattgttaaaaatactttcaatgctcaaataattccaagaaaaatattgaacatacttggacactcaaagtatttaaaaatattaaaaccataccatttaatgattaatttattaattaaataattgctaaactgttctttgtattattaacattaggaattgagctccgaaaaattccgagaaaatttcagagagtataattaatcatggagaatttaatacaacttaaatccatccatgctttatatttataaaattttatttcccacatttaacttcacttgtaaattaatgagcatttaatataaattctattaataatttattaaataatttataaatcctaaaacggaaattcaggctgtgacagagatgttttcttgttcccagccttttttatcgctttttgagtcggacatttttttcctacagacggcggtgatttctcgttcttttttatattattagagatagagattaaaaccgaaacataaaatcaaaactgattcaaacacagatgacataccaaagtactggtaaaaacatctttaatttttatcttacttaactaattaaaagattcatatttttcctttcgtcacctcgttcgtcaggggatttttggtccgtcccccaccccagaaaaatcccagtcagaatcccctccaacaaaaaaaaatccaaaaaaaaggacacacatggaacacactgttttcatcaagaacacatggaatattccaacaagaacacacaaaactttcaaaagctccgccgccaccatgccatccgccgcacatagagagagagagagagagaaatagacaacgtcgccacctctcctgcccccgccggaccgcagtcgcctccaacatgaatccttccgccgtctccatgccgctggtgtcagggttacggttaagatataccctctatccttggatatatacgttgtatgctgata

SEQ ID NO: 1414 - DNA, 1501 bp, Oryza sativa
gggcctgggggagagccgcgcgagcgaccggtgttgagggctggcggcgactcgtgtgggattggggatgaggagtagagctagggttttgatgcatatatggcccttcaagcacatatgggccacaagtccacaacagcatgggctagctacctcagctcattaaggctcgcgagcagctcgcgagccagttcgagctggctcgttatctctaacgagttaaaaggccagctcggctcgttagaaaaatgaaacgagccgagctgagcttggcgcgagtcaagcgagctaacaagccacgagcttttcgtccaggccttttgatgggtgagatagctgggcatggtttgggtggcttggacaccaagcgtccgtggtgatcacgagttcacgacaaggaacaacgtcaggaggagatgaggagattggatcttgtatttgcttgattaggaatgacactgtcgagctccttaaatatactatatatatagagagtatatgtttgaaagttttcaattaaataacttgctataatatttttagatagtcccaaaattttccctattacctccgtcttaaaatatagcgtatttctagcacaataccttatcccaaaataaaactattttttcacctacctcctcctctcaaccaatcacaaccattctccttcacctacccatgacacattaatcaataatacacttcctccaatcattctcacatacttttttaatatccgtgtcaacctaaaaaatatctacattttaggatagaggaagtaatacattatcaacaactgcaaaattaacaccatacgaatgtgctttcgaatgcgaatacgatgatatcatatgcatgccactagatatatatatatatatatatatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggt

SEQ ID NO: 1415 - DNA, 1501 bp, Oryza sativa
gcctgggggagagccgcgcgagcgaccggtgttgagggctggcggcgactcgtgtgggattggggatgaggagtagagctagggttttgatgcatatatggcccttcaagcacatatgggccacaagtccacaacagcatgggctagctacctcagctcattaaggctcgcgagcagctcgcgagccagttcgagctggctcgttatctctaacgagttaaaaggccagctcggctcgttagaaaaatgaaacgagccgagctgagcttggcgcgagtcaagcgagctaacaagccacgagcttttcgtccaggccttttgatgggtgagatagctgggcatggtttgggtggcttggacaccaagcgtccgtggtgatcacgagttcacgacaaggaacaacgtcaggaggagatgaggagattggatcttgtatttgcttgattaggaatgacactgtcgagctccttaaatatactatatatatagagagtatatgtttgaaagttttcaattaaataacttgctataatatttttagatagtcccaaaattttccctattacctccgtcttaaaatatagcgtatttctagcacaataccttatcccaaaataaaactattttttcacctacctcctcctctcaaccaatcacaaccattctccttcacctacccatgacacattaatcaataatacacttcctccaatcattctcacatacttttttaatatccgtgtcaacctaaaaaatatctacattttaggatagaggaagtaatacattatcaacaactgcaaaattaacaccatacgaatgtgctttcgaatgcgaatacgatgatatcatatgcatgccactagatatatatatatatatatatatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggtgt

SEQ ID NO: 1416 - DNA, 1038 bp, Oryza sativa
gttggagagagagggaggcggcggcggctctcaccctagagatgcggcggcggcggaggtggcagaggcggcggaggcggcgacgacgacgcccgcgagacaacggcgagatacgacggcggcgtcggcgcggggatgccctaggcagtggcggcgaaggagaagccgagagagatcgatcggggaaaaaacttctaagtgttggtggagaagacgagggcgcgcatcgggaatatatatatacccctaaatctttagtcccggttgatgagaacaagaacaactgggagtaaagatcttatcaatcgggactaaagataagatctttactcccggttgttctcaacaaccgggagtaaagatatcattactcccggttgttctcatcaaccgggactaaagataatttccctctattttcaaattctttttaaacccggttagggttaagaaccaggactactgataaacgcactgaatattgatttccattacatatgtgtttctaaaatagaaaataatgcactaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattaattgttaaaaactctaattaacatatgtaaatgccacatgtatgatttaaaacttttaaaaatcctaattatcgcatataactagcatatgcatgatttaaaattgttaaaaactctaagtaacatatgtaaatgccacatgcatgatttaaaacttttaaaaattctaattatcgcatataactagcatatgcatgatttaaaattgttaaaaactctaagtaacatatgtaaatgccacatgcatcatttaaaacttttaaaaattctaattattgcatataactagcatatacatgatttaaaactgttaaaacctctaataatcgtacgtaattaacatatgccata

SEQ ID NO: 1417 - DNA, 1501 bp, Oryza sativa
ttttggattcagtaccgaaatattacgtgctgtttgaagaacacaacgtgttttaatgcagcaggaataaaaaacactttggcgctttccaaaagaaaaaaaaaagacgaaatgttaaaacactagtaaatttccctttgaactggcatgattgaaatttcaacattactttgagatcaaaaaaacatctggagtacaattacaggcgatgccatttgcacaagaggcagcaaagttcaatttattcaaactttgcaaaattataatagcatggtttcaatttaccctttattcaatgagacaacaaaaggaactgaaggtctccatgttgaacctctcgggcgtcttctgtttaccaatcacaaagactcaaaaagcatttaccttggaacaaaatgcatcaagctgaaaaccgttgccatgtttcggtcgaataggaggggggggggggggatggcatttgccccctgctacaacacacaaaaccgggtgaatcatttcaggtttttttttttttggaaaggggggggggtgatagactcaaattttcattccaaatttttgaaccatctgtgagggctcccctgcttcctaagccctctcatttcccttgtccccacctccaatggcagccaaacacccccatccatccccatcgctcccgacgcttcggcaccacccgcttatgtctaccacccaccatcggtccttcgctgcccacaaccttcccactaaacctaggaaaaccccatcttcctccgctcccttctaacccacccccaaccctaaagcctatctggtttggggtcgtagctgtcgctgtcattggagttcttcagggtcacgaagacgtacaaagggagaagctcatcacatcatgaatcgcaaagcaaatcttaaggtaagaaatttgcaagattttgccctcgatgttcactcgaatgtgtttagcaattctgttttattttcatgtggctcatggcaatcgtcttgaagccaaaatgtctattactgcctccatttcatattaatattagtcgctttataaatttagtcaaattttaaaaaaatgacttataataagaaacatggagttttttttttgaatgaacaacattttggagtacgaaatgcacatacaaacatttaggtggtgtttggatccagtgactaaattttagtctatgtcatatcggatgtttgaatactaattagaagtattaaacgtagactaataataaaactaattgcataaatgagagttaattcgcgagacaaatttttaagactaattaatctataattaacacatgtttaatgtagcatcacatatgctaatcatgaattaattaggctcaatatattcgtctcgtgaattagtttaggattatgaaatgggttttgttattagtctatatttaatacttctaattagtgtctaaacatccgatgtgataggacctgaattcaaactcatttgtggcgagaaagttcaattatt

SEQ ID NO: 1418 - DNA, 1501 bp, Oryza sativa
  unsure (1)..(1501): unsure at all n locations
gaagtcagccaggctattgcaactgcaagccctcgacaacatcaccgatcctgtcctgtgaccgagatcctctccatcggcagcggccgaggctgcgtgtcagcctatgcagccaacccgatgggtgatggccggcgtacctcgttaaaaccttctgatcctgcagcaggaggttgagtgtaacgccccgattttcgttggggattaaaaatcaattagtaatgcattttctaggaattatattaaaatttaaagtaatttaatcaagggaaattataaaggaaattaaaattttctttaaaaatcattggccggaaatattttgaaatattctctgtgcctaaatatactctccggatttttctgtaaattttctaagaaataattttaatagcacaaagttcatttaaccaattaaataaaaagaaaaacaattaaaatccccctctttcctttcgggcctcctttcggcccaagttctcccttcttttgggccggcccagctcctccccctccctctcccgcaagtcctctttgcatccctccatcggcctcctcccccttctctcgccgacaagtgggaccgcgggcccactcgtcagcttctccccttacctccatccggccggctgcaaccgccatggctgccggtttcgccccacgatgccgcgcttcccgcgctccacctcacctcgcgagcacgtggactcgatccccacctcctcctcccccatttcccccactcctccccgcaaaatcagcgccgaaccgccgccaaccttcccacgtcggcgccccacatcgccggtcggttcccgcctttctcggtcccgatttccacctcccggacctataaaaagcatccccggggccccctctcccattttccccaaatccccgggctcgccgcgccccctatcgctctccccacgccgagccatgcgcagccgcccgccggagctttttagccgcacctcgccgccgccctagtcaccgtcgcgccacgccacttgcgccgtgggcaacgccgtgccaagttctacctgggcatccctcccgtttccccaaaataccacctaaagcacctctccaccgtgttccctctctccaccgcctcccatcgcattcagcggtgccccatcgtcgctcccgtccaccncgcactgcgccgtcgcttttcccgccaccgcagccatcgtgagcaccccgtccaccgctccatttccccaatccactgccgaaaccctaccgccaccacatacaaataaatcataatattaaacatataactatataagctaacattatcacctcacataaatattgcctagatatgtatacgacaatactagacatgaatatatcaaatatacgaaacatagttaaaacataccgacgattttgttctagacgaggcgcggcactcactgcccatacgacgtgcggtacaaaatattgatgacaacacacatcgatggaacataggaaaatgagccacagt

SEQ ID NO: 1419 - DNA, 1501 bp, Oryza sativa
ttcgttcacgatcgttcgttcgttcacgtggcggcagcggagcggtggtgtggcggcagcggagcggcggcgtggcggcgcggctgcggcttggcgcggcggcggagtggcgcgcggcgcggcgacggcgtggcggcgcggctgcggcttggcgcggcggcggagtggcgcgcggcgcggcggcggcgtagcagcgcggcagtggcgtgctgcggcggcgtcgtggcgtcctggcgttgtgccgccgcggcggcgtggcgcggcccggcgtcgtggcgcggcggcgcggtggcccggcttcgtcggcactgccggcgcgacgtcgtcgccggtggctgccgtatcgaggtcggggtcggcatcgtcggcgcggcggagtcgtgttcggccgcgacgacgtcggcggcggcgtcggcaacgaggcggccggcggcggtttggggagagagagagagagatcaaggttggagagagagggaggcggcggcggctctcaccctagagatgcggcggcggcggaggtggcagaggcggcggaggcggcgacgacgacgcccgcgagacaacggcgagatacgacggcggcgtcggcgcggggatgccctaggcagtggcggcgaaggagaagccgagagagatcgatcggggaaaaaacttctaagtgttggtggagaagacgagggcgcgcatcgggaatatatatatacccctaaatctttagtcccggttgatgagaacaagaacaactgggagtaaagatcttatcaatcgggactaaagataagatctttactcccggttgttctcaacaaccgggagtaaagatatcattactcccggttgttctcatcaaccgggactaaagataatttccctctattttcaaattctttttaaacccggttagggttaagaaccaggactactgataaacgcactgaatattgatttccattacatatgtgtttctaaaatagaaaataatgcactaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattaattgttaaaaactctaattaacatatgtaaatgccacatgtatgatttaaaacttttaaaaatcctaattatcgcatataactagcatatgcatgatttaaaattgttaaaaactctaagtaacatatgtaaatgccacatgcatgatttaaaacttttaaaaattctaattatcgcatataactagcatatgcatgatttaaaattgttaaaaactctaagtaacatatgtaaatgccacatgcatcatttaaaacttttaaaaattctaattattgcatataactagcatatacatgatttaaaactgttaaaacctctaataatcgtacgtaattaacatatgccata

SEQ ID NO: 1420 - DNA, 1501 bp, Oryza sativa
gtgttcatcaaataaatattcgaatatatttttgtaataaatttggctaaggttgaaaatgtgactattttgtttttacaaacttggtcaaacataaagcagtttgactttgatcaaagtcaaaacgtcttataacctgaaacagagagaagtaactatttttatttaaaaatatggcatcataaatatatctactcccatcaaccgaaattattaattatggttggcaaagagaagataatatctcataaaaaaggacaaaattgcttatcaccattctatcctccactacgttctcatctaccacatttaattttatctttaactacttaataaaaataaaacttgtgttgtttagtccaccgtcacgcatgacgcgtcatagaaaaatcatgatatgttttttttttgtagaaatggatccacatgaaagaacaaaaagcatacaactacttaaaaaaaggcctccggaaaggatccactatttctcttgctgttatccaaaatcagatggaaattttcattcaactttttagatggtgtctttaataaggagatgacacacaaatgacgatgttgtcgagtccagaagaatcggatggttttcaccacctctcccctcttcacactagtattccatgcctttacatgccccaataattgcatcccatgcaaaaacaagcagacatgagtcactttttttttttagataatagacatgagtcacttatggatgatctagattgctgaacctcatttagtcatctgtggtcggtcttctcgatcataataggagctacttctctaaaggcacccgcaatagttatttataggctctctacaagatatccatgtcagcatatttttctacatagaagagattaaatgaagagagagagcaaaactatctactaacctggagatagtctatagagaaaaacgaggcaatgcattagagagctatagatacccatgtagacatactattgaggtggtttactattaatctagtttattgctgagatgtacatgttttatagagagcaccttattttaccattgcgggtgctctaatcgtcgtccctcgatgattgtcgacaatcaaaggtcctagtaaaaccatctagtagtggttgttcgacaaatgaaaaactaagagccacacgcaatgagaatggtgagccatcgatggagggtgcgttcgaacgtaccaattcggctgggttgaattccagctagcccatgaagctgatccaaatattgtgtttatgggctgaaaagaggatggtccaggattgtggatgtataacgacgtcaaggtccattaggtttccatcgcctgccataccccgtgttgaccagcggttcctcgttattcccattccttcgccacacacccttgcgactgctggtagttgaggaggcagaaggtaatggcaacctcccctacagatttgtgtccccgtcctccttttcttgtgcggctacgatagagccaata

SEQ ID NO: 1421 - DNA, 1501 bp, Oryza sativa
  unsure (1)..(1501): unsure at all n locations
cattttagaactttcacgcgatttctctctcctcttcaatcggaaattattattctaatcggtgcggtgtacattggcaaattaccacttttatttagtttctttcccccaaaagtaagttcgggcggtgtcctacggctaaaacaacacaatagcagtgtcatgtaacaaaatttgcctttatattattacttgaaataatactgtagagacctctatagttctaatggccccaggtaatgttatgctttagggctcgtttggaaaaaaaaaagaaaaagtgaaggatttctagaggatctagatctttagggtacaattaaaacaaaatattgatgcttaaatttctttcgaagatcctatggaaggagccattctatgctggagccattctatgctggtattgaaggaaaacaaacataatgtcttccctgctggaagacctaaattagtagattattagatagtctacagaaagaataatctgtagaaatatcttaaaagcctacctgatagaaaatatttatagtgccatcttattatttataatttatagtaccaccttattagttctagtatagtagacgtctagtcacttgaacaatgtggtaagaattagagaaatgtgcatgctcgtacccctcgtcaggccgggctcaggcatggggctccaaatggtcgcgcatacgccgcttttttctatagctctgctttattgtatttaacgaattatccgatgtttgtttgttaaactcactggatggtctgctgcgtggcgtggatatcatacaagcctcttgatcacacgttgcagtatctctataaataccaaaccgccgtctatatgcaacttacatgaaaacaattgccttctcttttgtattgccccattgctcattgtttactccatcacgcccgccaccatgcacgggcatccgggagagcagctatatgcaacagttgcctttaacatcctgcacctagccagagagggcggataagatttggaagtgctccgcacgactgctcattgttcatccactgtggctcattttcctatgttccatcgatgtgtgttgtcatcaatattttgtaccgcacgtcgtatgggcagtgagtgccgcgcctcgtctagaacaaaatcgtcggtatgttttaactatgtttcgtatatttgatatattcatgtctagtattgtcgtatacatatctaggcaatatttatgtgaggtgataatgttagcttatatagttatatgtttaatattatgatttatttgtatgtggtggcggtagggtttcggcagtggattggggaaatggagcggtggacggggtgctcacgatggctgcggtggcgggaaaagcgacggcgcagtgcgnggtggacgggagcgacgatggggcaccgctgaatgcgatgggaggcggtggagagagggaacacggtggagaggtgctttaggtggtattttggggaaacgggagggatgcccaggta

SEQ ID NO: 1422 - DNA, 1501 bp, Oryza sativa
aaaggaatccattcctatatatacattccagggaaaaatatatgtttttctttttctaagggctcctttgaatcgtaggattgagaaaatgtaggaatagaaaaaacgcaggattttgagatgaatgtaagtgtaaaacagaggattgcaaaacacaggaaaaacacatgaatgaccgtttgattagaccgcaggaaaaacacaggaattagaggagagataaatactcaaatgaaaatttccatgaggtagaatagaacctcatgttaggtttcctacaaaactagtatggcattaggcattctttcgattcaaatggctatataggaaaaattcttataggaatgaaatacactaaaatttctatgaatttcctttgaatcaaatgggcctaaatttgcatgaaggtattagattcaattttttgtgcacaaatatatcgccgtcacagcacagagacagaagggccagttcgtaaatgacatcgcatctggacgagcggcaaactcgtgaggtacttcaccgtggcggcttgtgaaagtgagacgcggacgagttctcgttttttttaaacaagtttcgtattgatatagcaggaaaaatacaaaattacaaccctggggattctaaccaggaaaagaaaaaacaccaccacaaccacaagtttgtagctccttgcttaacccaggagaaggtgctagcaccgaactgaccacagctaagtgtgaccaaatgtcactatacctacaaaggggttgtaaacaccctgccaaagaccaactccacacagaagataatcgacgagcttccggttgtcctcacgtagaatggttgagttgaaggacagggtgagagaaaaggagatccactcgtccctcgctccaacctgatgatgaccaccaagcaactccgacgatcaaactgagagaatatggtaatggtgaggaccaaaagacctcctagacaatggctctaagaagttctcgtattggaaaagcgaactcgcaattgcatgacagtgtgatgccgcgtaattaacctgtgtaattaatataatttaaaggcaacatatttaattaactggtgtaattaatgtaattaaatttatctttctttgtttacaatttcgatattcacgacatcgtgtagcatcatccggactagttctagcagaaggaacaccaagttgacacggttcggacgagttcgcttcaggcatggtgcaagtttgtggccacatggtctaatttggataggaagaatgcgatcccgtggcctcataaaattactttgcttcttgtccatgaactcattgcaaattcgcggtgtccgcacatgatctgttgataatgtctagtttgcaccgttcttttgcaaactggttcttttgaaaaacttatttcgaaactaaaccgcgccaaaaatttcatccaaaaataagtcgcgggctcaacgccagggccgctggcactgaggttagtcaaccgccatggcactaaga

SEQ ID NO: 1423 - DNA, 1501 bp, Oryza sativa
aaacaaattcatgaatatattataagtatctattcagaaaactaaaagaactaattatgctacgatcattaagcttctcctataccttttttttcacgaacgcacaaaagaattgcacgtcaatatattagaagaatagagtttcgatacattctcctatacctagcaaatatgaacatgtctttataaaaaaaaggtatccactggtttgtacgggtagtacgggttgaaacccctcttgttcccctgatcaccccttagacaatagtgtttggttcgagcatgagagctttaatttggcactggagcggagctagaacgaaatggaagagggtgcctcttgcttaatttactctactttatatcaagtttaagctgatgggtgtgtctaaatttgtattaggggggtgcatatatggtgaaaatcggtagttataactttttttgactgggttcctaggcaccccctcccatactctatctccgtccctggcattgtgtacctatgatccatctatccctgttgtggcgctgctgcccatggtgacctcctgcttggtggtaacatctcttaaattctttcttggttcaatttttgaacttttttgttcaattctcttcgccttcgatcataaacaacattctctcttcacttaggaacccatgcattgaaagacacctaggggtctgtttggctcaactccagctctatctctctggaagctggagcttagccaaacagtttcagctccacctaaaataggagcggagctggatggagctctctcacaaaatgaactagagagtgctaggtttaggctcctccacagcttcactgcagaccaacctcctaaagctaaatttggaagttgtagctctgccaaacaaaccgctagacttcatcctcgctctctctctcccccggaggctcatccctaatgtaccgtgcgaatcaacacgttataatgaagtgttgaaaatactcatatccataacaatagcattattgcttatcgatttcacgggcctccttctcttgtatatccacaaaccctacaattctcccatataaaatgccaaagaagaaagataaaacaaaacaatgttcacctcagaagctcatacatacatactcactgcatcatgggccccctttggaagatcaaaacaaagcctcttctctccccctctcccctctcaccccaataggccaaaattgatcactgcaaagtgggccccacctgtcagcttccatggcatgatcatttcatcttcatccaaaagatgcccaatattgccatggcattcagtcacatcactccccgcccccggtctcctttccctcctccatcacacgagaaaaagcagagccactactccactcgctcgacggctgattgcctgcctgcctcccctcacccctgcttctccttctccctccttctcacttttcttcctctcgggcgcctctcctctccatcattcctcccactgctccgct

SEQ ID NO: 1424 - DNA, 1501 bp, Oryza sativa
tttaatcaaatgtatcactttttatttcacagacagcaatggaggcatggagcagtggacactctgaatttttatggcgattggcgacaactctccatgaacagtatcaactgggacatttaatttctgtcttaaatttcttttccaaatacgttactcttatggtgttattggtcacttcggactgtttgtctaacgagctttgttaccgtccatcatcctttttaagtacctcccggtacttgcaattggggctatccgttgagcctgatccaacggttcagaagcctcggtaccacaaggtacaagaatttggaagcctcggtactgcatgcacttgaacaggtggaagggcaaatttggatttttgacatagtgcatccgttttagtagagtccgtacggccgccggcaaccagctcctcccgatcccctccctggagcatcatctgcacagcggcgcggccaagctcgccggttgatccaagttagctggacacctctccgcctcccttattgcaacttgccgccgccacccaaccaacctagctccattttctgatgttgggcccaaaaaatcggtccgtcttcctcctgatgcagatggccattgaagatgatacaaactgctgaatttgtatcgtcaccatgagtcccgagggacaacccagaagacacttcatgcgagccttatgttttcaattttttacgcactctttcttttcttcctcttttttcattcctcccaagcaaaatctctagggagggtttgttttcttactcaccgtatcttttctacaagcaagatctgggccggggttgccgcaccaccacaactgaccggcgaacaacgtcaacgtccctgtgcgaaggccaccgcgtcggggtcactacgccaccgcagccgctgaacgaaatcggtgtcgccgttcgctgacgcgacacgcgtgagtgggaggataggaacgaatcgactagcagtcgccaccccgcccacactagtaactcgtttccttctttggaataccgatcatgaccctgatgacttaatggcttgatttcatttggtacctggcagtactagtaccttgaggtaccacttgatgatggaccgtagaaactctcctctaacatcttgacaacagaaactagaaagcaaacggcaaatgacaattagaacatttttatgatagtatggtaacgtccagaagaatcaacctttttttaagggaaaattgctctagacacacacttgagtgtccatctctccactttagcacaaagttgattgcaattgttattttgccacacactcgcggagtcatcgttttgcggaataagcaaaatgacatatttgcaaacgaaaagtaatttatgaataaaacttttatacacgtgttcttagtaatttaaaagcaaaggttgaaaaataaacttcgatgaaaaaacctcaaaattagctccaaatttaaaatttaaaatttaaattttggctgataagt

SEQ ID NO: 1425 - DNA, 1501 bp, Oryza sativa
agcttttgcaggcacaagtttaacataatatgtctgctttgatctttatttggaagttgtaattaaccatgtttgtaataacgagataattaaacgagagtatccatgtgtcaagaggtcaagcgtgacctctcccacaccgtccatggcttccccgccgatgagcaccacgtccgggaggtgattgcgctcacgctccactcctgcgcctgcgtcgcgtcgctgtcgcgctgcctgggcgtcacgctcaagatgctggtgctcgtccaccgtctcctcgccgacggcgacccggcgttcgagcaggaggtgttctacgccatgcgccggggcacccgttccgtccacccccgccccccagcgccgccacgatgtcgcccgctccagccggcctcctcgttgctcggccgccgtgcgccgttccagccggcctcctcgtcgctccgccgcccatgagcgggagagagacaagagggagagagaggggacagagagaagaggttgtgaggatgacgtttgggtccacatgggcccacctttttttattaatttgtgtgtgcaactgacatgtgggcccccacaagttttttcggatttaattgccacatcagcgccatgtcaataacacgttggacaaaaatctagtcaaaagaagccacgtcggcgccacctcagccaaaaccggagtcaaatactgacgagggaccttatttaaacggtttcgtaagttgggggatccgtcgtacccggttttgtgattaagggacgaaaatcggactgggcaacaaataaaggaacccaaagtaaacttattctaacctaaaatggccgccctggcgccaatcgcggatcacagcccaaggcctagtgcccacacgatactgggccgagctttgccggattccacagcccaccattagcacctacccaagaacaccgtttacaaaaagaacaaaaaaaaaacacacacacacacacaaacttacaaaataatcgattttatgatataggagttagggaggaggaagaagagaagaactagaaatagtgttctcttaactcttaagcatgaatgttagtaaatttgggctgttggcccaggtgacacctttagctagtagacaatccatttaattgaagacgtcatcacgttccatgtattcactaagtagagaaggatcaaatcaatagttcaatataactggaagttacaaatcatacaaggacagcctcatcgtcaaaatcgttctagctaaccaggcacgaagcatgcgcctggggcacaatacaaacaaccatgccaacctctacaacctgaacacacatatgtcggactcaagcagagcattctctgcgacagcaagcacactctagcgacagcgagccaacaagaaggtgggcacgggaagcatgctcgggtccggagcagagaagtaggcggcaggaccagcgaacggcagcagcgccggcggcggcttcaccactgtctccgtgtgaggct

SEQ ID NO: 1426 - DNA, 1501 bp, Oryza sativa
agcaagacggtggactcccgagtgctggatccctgctgcgcaatcttatcaccgcattcgctcaccggtggtggcgagacggtggactcctgattgctggattcctgctgcacaactttgtcgccacactcactcaccggcggtggcgagacggtgtactcctgggtgctgggttcctgctgcgcagtcctgtcgccgcattcgctcaccggcggagagacggtggaatcctgggtacatgacgcgcattcctcctcctcctcctccggccgagacacggagcgggattgctccccggcggcgaccgaacgaacagacgggtcgtcactctccacattaccggcgccaacccacgccgccgtagcagcggaaagggagcagcaagaagacccctccgcgtcggcctccgaccgccgccgccgccgctccgccggcttccaggcaacgtcgggggtcgccggcgacatccccgacagagatcctgctccgaaaaaaaaatcaaaacaaaacgaaacggtcacaaaacggaaaaatccggaggaaaattaacagcacccagattccccaccgccactccgtggaacagatatcacagatcaagcaaaaacaaacatcaattcttgcaaacaccataacaaccaacagatttgccccctcaaaaggaaaaaagaaaacacgacgaagaagtaactcgtgagcttaccaggatgatctagcgattcctccgcctccgcccccatcgcgctggctccagggaggggaaatcgtgtacggccgtggagatcgagtagagtttggtttggtgtgggtgcgtgcggggaaaactccggcgtgaggagggagaagaggctacctatccatccggctgcgtctgacaggggtttaaggggagttagttggggggagctatagccgcggcgtagggtacagtacagaatgggatttttttttctttgtatcgagtccaccgcactcgacgaggataaggtaggtataccagtactagtaataaattttacgtttctgactatttcttcttcttctggctgcaacagctataaattttaaaaaaactgtccgtacttgtctctatatcgagtacggttaatgatatttctttttctcttgcctcatgaaatcacatcatcttaactgttttctaatctttaaatattagagcaaccataatatttgaaaagaaatgctccctccgtcccagaatacaacgagctttagccttgggcacagctattaaggaagccaataaatagaccatactaccctccatgatatgctctggcagaaaccagttgcgtcagtcactggcgtgtacaaataaagtggcagcacaaactgaatatagaggctaaagtgtgaacacattaaaaatctactcaataatcacaagcgatagacaaaacaaaatttgaaccgctaagcgccaaatattacagctgaaggcgtgccaaatcacatggcttgcctgcttacataaatcaaa

SEQ ID NO: 1427 - DNA, 1501 bp, Oryza sativa
aatgtcctttattatttattggttgttaatatctataggtagtagtattttcttttgtctttaaaacatatatatagctatatgtactaatcttactaagtatgtataacatactcatatattattattagagtaaattttataaaactacagatactttacacaatctatcacaaaactacagattttagaactagtttcacaaaactatagatttaatgtctttgtttataacaaaactacaggtactttgaataatatatcacaaaactacatatttaagaacttgtttcacaaaactacaggtttaatatctttatttatcacaaaactacatatctagtgtctccattctcacaaaactacacgttttagcaatgtgagaatggagatactagatatgtagttttgtgataaatgaagacactaaatgtgtagcactgtgataaacgaatacactaaaactatatttttgtgaaataagttcttaaatctgtagttttgtgatagattgtacaaagtacctgtagttttatgataaatgaaggcactaaatctgtagttttgtgaaacaagctcttaaatctatagttttgtgataaattgtgcaaaatacctgtagttttgtgaaatttactcttattgagtatattactatttgatgtgcgcagaaactagtcaagatgagatgtcagagggaaatggtgacatgcagacctagtggagagtgtggtctacttagactttagaggtatcccagaggacatacttgcatgctaggtatagggtatcgtcctagtgacaataagttggtaagtgaaccaaccgatgtaatatgcaatatagctggtgaaaaaaaagtaataataataaatggaaccactgtaggtgtctaagctccagttatgatggttagacattgcattttgccttgtatccttatggacatatataaatattagtatatatgcgtataaggatacggtagactgtcacggaaaaaaaatatttgggtcatgacacggcccctcccctctactcccctcgggtcccctcccctcccctccctcctcttgcagatccagcggagaggaggcatgggggcggcggcggcggcggcgggtgcaggtggcggcgacgacggcggcccgtggcttctcccctccctctcccctccccggtagcgatgggagcgggcagcggatccggcaccggcgaccgcgggggcgacggtggcgggcctcgactagggtggcggtggcggctggattagggttagggtttggtttttcttttttttttgatttttcattttcccgtgctggcggcttaagcgcccgcgtcgcccgcacgaaaaaatcgtgattttcgcagacactttcttccagacggtcgaatgctctgcacgggaaaatccttattgtagtagtggttgtgtgttcttatgctaatactccttactcttgttgagtagtgctatgtatctatctatacatacata

SEQ ID NO: 1428 - DNA, 1501 bp, Oryza sativa
ccgttgctagcttgtggggaactagtggtcctttcttgctgaatttcgaggtaaggagattctgatggtaatgttgggttgtgtgcctgcgtaatcttttgacgtagaggatggatatttttctttctgttatcttacaagtattgggcactagtgttttcttgaatttcaatccgtgtggtttcttgtgctttcctttgctagattgtaatcgtaaatttaattatcgtgccgtagtgttcttggtaactcatgtagggatgaactaaaagccatagtcgtgttttggcatcttgaatgctttgatcatgattcatgagtacagccttatatgtgctgtacatgtattaagaagaaaattctctctttcataggaaacatttctcaaaggacaaaaaaaatcttttcatatgccaaagtctgctacttgtagtagtttgtgctgcaaatatgcgatgaagcaggttgtaaggcattatcacttaagcagcaatctgccttggggaagctttttccgcagggttgcttgtagttgttgccctgttgtagaggccgggtttttaatccattatctaaaaaaaaaaagttgttgccctgtgtcttgctaatgctatatgtcctcatttcatttctgtcgagtgaaatacaaattcagatctccttaatttctaccaaagaagaattttgcacaaaacatggattttgtcatcttctatgttctgcaccatgtagaacgcttattacgatttgatatttttccgtcatgcttattatactacttttttttctcagtagacagatcgagttttgtctcaaagttcagtttccttacattttggttgtagtatcaacaggcaaaagctgcttccccattccatgctgtacacatttatgaccattcgattttatgcaagtatttcctttaagtgtttcttttctctggcatgttctatgagttggagaggtctgaagcctacagtcctttccatgttgctttagcaaggaatagagaaacgtatcactttctaaaccagtttcttctcataatggatttgcaccatagcattcgaacataaataatttcattgaaaaacataaataaatcaaatttattccttgattatgaaatcttcagaaggtcaaacaaacaattgtttgtaatcagccaacatctagttgctcctatcttccctcttagcttaaggattatattaggattatttattaatctataggctgtttatctcctaaacttttacactcctagatagttactctcctagacctttggtcttatgtaactccctagtattgattgtaattctgctatatatatatgagagttcacctccccacattggtgaggcatctattccactttctctacatggtatcagagcctaggctcttaccttcttttccgctgctctagcacgctgccatcacagctgcatcccagccatgtcgactgaatcaactcagtcctccacctcctcggcct

SEQ ID NO: 1429 - DNA, 1501 bp, Oryza sativa
aacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatacagagagatgagatgaaaaatgatttcaaatcaagatagaaatcttataataaacaaaatatagaataagctccccctcaagatgtgcatacatatggatatgaaggaacacatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttatagccggtttaggcatagttggttcttaaccagtagtatctccaggtagagctgggacttgggccctgctttctcgggccggtccaaggcacaatggcctagcacgagggaaagcacggcccagcacgacacggcaatgggccgggctagcacggcccgtagttgggccatgcttgggctagcccagcacgaaaaaggctcgtaggcccgaaggccggcccagcacgaaaaaggcccaaaggctggcccgagctctagcctagccgagcgcgcgaggagttaggagtgcgtgcaattcgggccggccgggaggagatcaggaggcaggagcgccgagccgccgagcgcgtgcgtgcgtggtgagacttcagtgatgcgttcagtaactgatgaggtcagccggcggctgcgctgaatactgatcagtaacttatgagcagtgctttcagtctttcagaattcagagagccgtgcatgcatggaaagcatgatttttttggctaattaattctgggatcacttaccattggcgattagtatcgtgtatatccactgtctagtcaattaaatttttgtttgtgttttttcaactttttaaatggctaattacctgtgtccttgtttactgcaatggtgcatgcatggaattatggaaagcatgttcatttgcgtggaagttcagagttcagacgcatcgaacggtcgaggtgtcgactgatgactgatcattggtcgatcagtattcagcacggaggagtcgtttagtcacgtgtcatgggctcatggcacggcatggccattggtcgatctgtcatcagtcaaggcgtcgagccgccgaggagtcgttcagagttcagacgcatcgccggctgataaccgaggaggcaagggagaggtgaagagcctggcgcccagccctagcataccctatataaaccatacccattttttttgatttcaacacacttcttcttctttcaacacatctccccaccgtatctatttttcatagaaaa

SEQ ID NO: 1430 - DNA, 1501 bp, Oryza sativa
ccataccctcctcgaatcaaccccctaccgccaatgttccgaggagtgggacaattgtagctcacatgacccacttgtccacagttgtagcattctctattatcagccacagtgtatgctgatcttgtaggatttgtacctctcatcagtttcaacctcatctcctcctgcaccatagcagaaatagcctcttccatagtgggcaatgtagcctggtagaacatagccgctcttctgtcctcaaactccttgttcagcccctttaagaaatgaatgactctttgcctctgcatctatttatttccaatcacaatgtcctcctcatgcttcaactgtagaggatcatagtgatcaagatctgcccataactgctacaactcactagcgtactcctggactgttctcccttcttgcttcaaattttctactttgttctgagcctcaaccatcatcattacatttccctctcctgaatacatgttgctcaatgtcttccacacaattgctgcattctgaatagtctctatcatcctactaatagaaggagccaccgaggtcatcaaccaagataccacggtggaatttgttgtattccacattctccatgcttggctctccttatcagaaggctcttcacaactctcttgcaaaaaatgatccaccccctttgctctcaacattaattgggctctcctacaccaactcaaataatttttgctccattccaacctcaactcatttggcatcaattctagtttcagttcgaatccccctgctacactcttcggacctatcatgcccatcttcaacaaattctctagcaaatctttcatatcacccttagtaaccaccgaggaggcatctacaacctcctttccaacccctgaagacatttcccctccccctttctaagcttccttagtcctcacctgctactgctctctgctcctgtaatttttcagcacacaagacactaccaacaacaagcaacagcaaccttctcctctcttttcccttctctccacagcagcagtccaccaaacaagcaatagcagcagcaaacagcagtcccttctctccacagcagcagcaaacagcaagcagtagcagccgcaaatagcaaacaacaagcaacagcagcagcaaacagcagccggtgcccttcttgtcgtcctccgtgccggcgcagcaaccagccgcggcggggtagcaacagcaagcaacagcggccagccggctcacctggtcgcagctccgccaccactcctgcgccgtcgcccccacgccacggccgcgcgaccggccgaccaccccggcacgccgctcagccgctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgtctaattttgggggttttttc

SEQ ID NO: 1431 - DNA, 1501 bp, Oryza sativa
gaaattaaatttttaagaaaggaaaaagtccaaattaccctattaactattgcgacaatacaaattccctcttaaccacaaaaccagacatcattcaccttaacttctcataatggacgaattacccccctgagtctctttagagcggttttcgtcttatgtgacacacacgtagcagtccaatcagcattaaaaatttaaaaatagtgggcccacatatcatacgtgagcaatggaggatgaggggagatatgacatgtgggcccactatatttttaaatttttatgctgattggactgccacatatgcgtcatgtggaacgaaaactgtctagagagactagggggtaattcgtccgatataaaaagttgagaatgaaggatatctagttttgtgattcaggaggtaatttgtattgttgcaaatagttcaggaggtaattcagacttttctctttaagaaataaacttaacttgtactaacttataacatgtggtctaaacaatatcgagaatttttcttataagaaaacgtactggctccatattttcatattttttttatagatgaggtcactgatttttaaacatatgtttcactattcatctggtcaaatgaatggtcaaacatctattaaaaattaatggtgtcatctataaaataatagaagaaatgtattttgtagatacatagagtaaataatcaggtgaaagaacggaaccggaacaatcaaactgggacctcaaatatgctaaagatgaagattaagtacggtaaaaaattaatacataattagttgagttttaatattttaaatttgaaaaatcgatttatgagatatttataaaatacaccattttacagttttaaaaaatacattaataaaaatcaaaataaaatctgtaacttaatcaggtttaactgttcagagagtttagcaactactcccttcgtctaaaaaaaataaatctagtactgaatgtgacatactgtagtacaataaatttaaatagagatatgttcagattcataatattatgatgtgtcacatttagtaagttggttttttataggacggatagtttgtggctggtttttcagcaacattggggggagttggggacaaagaagtcaataattcaccgcaacactgccaccggtaaatccagagagagagagagacaggacacagctgaggagagagaaaccactgcaacccaaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacg

SEQ ID NO: 1432 - DNA, 1501 bp, Oryza sativa
gacattggatggaccagttgaaactggcaacagcaacagtagccaaacaagtttcaaagttgatccttcattagtgtataaactgtatgacaaatgggtgattccattgactaaacaagtggaggtcgagtacctgctccatcgtcttgattgaatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggactgctgtttgctgctgctattgcttgtttggtggactgctgctgtggagagaagggaaaagagaggagaaggttgctgttgcttgttgttggtagtgtcttgtgtgctgaaaaattacaggagcagagagcagtagcaggtgaggactaaggaagcttagaaagggggaggggaaatgtcttcaggggttggaaaggaggttgtagatgcctcctcggtggttactaagggtgatatgaaagatttgctagagaatttgttgaagatgggcatgataggtccgaagagtg

SEQ ID NO: 1433 - DNA, 1501 bp, Oryza sativa
ggtaattttatcatttcacctactcctacataataagtaacaagctgatcagtgttggagtgatcatgtacaacagtacaattattttttggagatgaatcatccaagtgaaatttgtccttcacaggacacggatgccctgatgaaattgttgacatctgaagcccaggaagatgtggtgaagagaagggttcagaagaaggccatggtgttcggtcaaaatgtgacattggatggaccagttgaaactggcaacagcaacagtagccaaacaagtttcaaagttgatccttcattagtgtataaactgtatgacaaatgggtgattccattgactaaacaagtggaggtcgagtacctgctccatcgtcttgattgaatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggactgctgtttgctgctgctattgcttgtttggtggactgctgctgtggagagaagggaaaagagag

SEQ ID NO: 1434 - DNA, 1501 bp, Oryza sativa
gtatgtggcagaagtgaagttcataggcgaccagcagaactacacaactttaattcgtaacaaggtaattttatcatttcacctactcctacataataagtaacaagctgatcagtgttggagtgatcatgtacaacagtacaattattttttggagatgaatcatccaagtgaaatttgtccttcacaggacacggatgccctgatgaaattgttgacatctgaagcccaggaagatgtggtgaagagaagggttcagaagaaggccatggtgttcggtcaaaatgtgacattggatggaccagttgaaactggcaacagcaacagtagccaaacaagtttcaaagttgatccttcattagtgtataaactgtatgacaaatgggtgattccattgactaaacaagtggaggtcgagtacctgctccatcgtcttgattgaatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggact

SEQ ID NO: 1435 - DNA, 1501 bp, Oryza sativa
aatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggactgctgtttgctgctgctattgcttgtttggtggactgctgctgtggagagaagggaaaagagaggagaaggttgctgttgcttgttgttggtagtgtcttgtgtgctgaaaaattacaggagcagagagcagtagcaggtgaggactaaggaagcttagaaagggggaggggaaatgtcttcaggggttggaaaggaggttgtagatgcctcctcggtggttactaagggtgatatgaaagatttgctagagaatttgttgaagatgggcatgataggtccgaagagtgtagcagggggattcgaactgaaactagaattgatgccaaatgagttgaggttggaatggagcaaaaattatttgagttggtgtaggagagcccaattaatgttgagagcaaagggggtggatcattttttgcaagagagttgtgaagagcctt

SEQ ID NO: 1436 - DNA, 1501 bp, Oryza sativa
caagtcaagaagtcaatccaagttgatcagtgtaggagtactaaaagtatatacgtagtatactactagtgattaattagtgaggccattggcagtttggcacatggcacaatttggaatctttggggcagctactagagagagatagagatgggaaaagaaaccctaaactgacacaatgtgtagttgtcaggaaaagaaacattagtgcacatacctcaaaaaatactctgtgcttgtatttgtgtgtggttaagtgacaagactctttagccttgactcaactccagtaatgcacgaagtcaaactgatcaaatcataagctcatggtttcttaattattttaccaagatatgcctagataacaaatggcacattgtgcaggccaaggtaaaaaggagaacgacgtgggttgaatatggtttgactatcacgctatatatggatggatcggacatgcatgcgtgaaaacttttctcagttaattatttctttacaactgttgtctattcatgcacacgttagttattaatcaatttgttatactgatctactactatactctgttctttcttccctacgtcaagttctcactattccatggattaataaggatctatggacactataacactttggtttagttgggattagatcactaatcaatgctactggtgtactagtagagagagaacaaaacaaaaaagtctgaattaatatgtttctatcatgagtcatcagatatatattttatcctgtcgcctgttcagaggtacaggactggtctgacgaacgaattaagctcataacatataattagagcagagtcgatcgataagcttgagcaaaatttaatcaatatccatctcagtgaagagataatatcgaactctaataccgtatcatctccacatcaatcaagcatgtcctttaatttgcgccaaaaaatttccttcaaatatatggacaccgtatcttctgtgcgtccaaatagcgctgtatatatatatacctgtctgaactgaagaaagtatttatccaactggtcataatatgtgcaatatttcgtctacatcattctagtttgattaaaaataaaggtacggatattatgtccggccgcatgcgatcccatatccaggatgtcattagattcaaagaaacttcctacagaaagcaactctcctttgtttaattctgctgcagcatcaccttcaagaacccacttgcaattgattcttaaacaatacataatcatcacattagttaagtaccaagagctagctaagtgaattgatagattccaaatgagcataatctatgtgcttaattgattgcagtgggatgatatgtctgaatggttgcttagcaaaaggaattcacatatatgcgtgcatcattggttttgcattcgcagtttgtgctatcgacataattgaataatgagaataatccaagtgcaatataattaattaatttatgtctgtaggccgggtatgtg

SEQ ID NO: 1437 - DNA, 1501 bp, Oryza sativa
ttaagtttgggtcgaaaagagacttgcgtctcaaatcgacttaagagatgcttttcaacagctcaattggaaatgtaccgacctcctgggtcagatcattacttctcggctcccagagccattccacttgattaatcggctcccagagcctttttcattttctcggactcctagagtcctgctgcccagcagcaaagcaatccgcttccactcgggaagcctagtctatgatgcccacagacatcccgaatcacacagattcgtttctgaccactcaggtcatccatctgccacataggctgattctggttacgattcccacaccaaaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaaacctttcccaagccgacccagggatacctcatgccacatagaaggatcaaatcctcacagaaacataggccattttaggcgttcacaaatcaaactccaaccacctcgatcggtaattcagcaagcttctcgttcttgcattaccaggaacccggtttggctccaaccgaccccgccccggcgttcccaatattggcatgcgtggtttccctgaaccgactagttacttagacagggtgtcccattccaccttgtggttgcactttgattatgttcgatgagtttcccacaggaatcggtccttacatgcgaatacgggacagtgccacataggcgcaacccccgcatcgcgagttttcacaattcattttattttccaacacaccgacaccacatgtcgggttttgagggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagtttcaaacaaaataataatgacttttcaattataggggcaattgatcaaagggtgacttgccttgctcaaggtcttcacgaagcttcacgaaccttcaagaaaacccgcgatcgacgaaaatccggtaaccgcaactatacgcaaacaatcaaaaacctaaacaaaagaccaaaagaaggatcctatttagactaattagtagtgccattatatagatctcaattttacggaattactggaagtggaacggggtcaatcggacgagcggttgaggagatatggatttcctaagattatttggattttctgtctaaaggaaaaggatttattaaatcctttggaaaaaggaaatggacgaggga

SEQ ID NO: 1438 - DNA, 1501 bp, Oryza sativa
cgtatttcatccgatttcatgtttaaattatagttatttgtataggaacctttatatatagaagtatatttggatttcatatataactcttagttttcatatttgtaaggtccaaattttatatacaactcttagatttcatacacaactaaaacttctatatttatagatatactagaaaaaatgctcatgtgttgcaacgggtgaaagttattttaatcttattattgttatatggtttagttaagattaaattcactacgggaattcgcttaaatatacatgtgttttagaaaatcatgggctgcaattaggaatccaatcgtctcaagttagcatgctagttttttaaagagatttcttgtacgactccctctgtagttccaaaagtgaacgaatttaaaaatcgactcaaatatgaatatgtatttccaaaagtgaacgaaattaaaaactgacttatatacggatgacgtactaaagtaccggcaaaaacatcttcaatttttataatagtaatgaattatactttacatacaactataccaattaatctatgccattataatccaattataatccatgcccaacatgatttaatggtaaatttttgtttcctttttctcctattaatatgggaatttctaatatacgataaatgtgatgtctcatttcaaggttcttaataatatatagatagattagataaaagtgactactattaacgacaaaggtaaaatgtttgataattagttctattcatgagatataccggacgaaaaaaaattgctaattaaagacaaatcaccagatcttgttaaacttccctactcgttaatcttggtctcctgattctcgatcgtgatctcggtctagcattgcgcatcaccagcttcggcgacgacaatgcccatatggcaagtgtgtgggcgccaaaatttagttgggctgagaagtgctggttggtcttgtaaatgcctgtatgcatgatcacacaattttgtagccgaacgcatgatgccatatgatctactcatgcatgcatgatcaccagcatcccatggatgtgcttgctgcctctgcaaattaagctctctgatccctcctaacatcccaatttagttgggctggagaagtgatcacgtaagtgttgaaggcggctcgccctcctagcatcgaagattcggagcgctggttgattgggcttgatatccagtccaacgcatgttaatttctctcttaaacaagcagcgagctttctccaacctctctatatatattatctttgacttagctagcatattatatgtctccatataaatatataaatatgtaagtatataatctagaggcagacagctttacatgacataaaaatagtgtaaattggtttcagataaacatgtgcctgagtcaacattgatctgcacgagttttgaggtgaaatattacccatgcctggattttttagttgatcatatagttggtattggttattgtt

SEQ ID NO: 1439 - DNA, 1501 bp, Oryza sativa
ccgccaccgcgcctttgttgccgccttgcagctgccgaccctcccttcgccgtcgcgcgtgctggtgaagccggcgtgtgcgcgaggagccgaagaggactccggccacccttcttcttccccttccctggcccaaggccggagaactcgccccgcgccgtcgaccgcccatcactgcccgcccggttcggtagtgcctcctcccgtttcccttcctcgctctccctcgccccctctagtctgcgtgatagctcggtggcactcccgaacacgcgtagacgccgcccctagacccgccgccgcccggcctggcctcgccgccgttgccgcccgctcccggaagccgccgctcgtcgccagccctccttggtgctcttccgccccatccgacgccggaagtggactccttgaaccccggagatgcttccaccgcctcgaattgaatcctcgtcgcccctccaccgggtttgccctttttctcaccgccggcgagggccgccgcgattcgtcgtcgccggtctccccgccgcgaatccgagccggtggcacactttatctcctccgtctcattattgcggtgtgctccctccctctcgaatcatcgcgacaagcttctgagaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtaggcccgccgcctctcggtccatccggcgcaccgcccgtgcgccatcttcaccaaaccctagcgccgcccccgcgtgaacccattcctccatgaacccagccgccgacaggtgggcccgtcccgggaccccgcatggtggacagcggtccacccggttggtctcctccccctcccacgccccattgggccgccctcctcgcggccgtgccggcccattaggctcgcccgagctgcgcaagtccctcgggccgcgccaatgccacccgagacaagtctgattcacatccctcgtccatttcctttttccaaaggatttaataaatccttttcctttagacagaaaatccaaataatcttaggaaatccatatctcctcaaccgctcgtccgattgaccccgttccacttccagtaattccgtaaaattgagatctatataatggcactactaattagtctaaataggatccttcttttggtcttttgtttaggtttttgattgtttgcgtatagttgcggttaccggattttcgtcgatcgcgggttttcttgaaggttcgtgaagcttcgtgaagaccttgagcaaggcaagtcaccctttgatcaattgcccctataattgaaaagtcattattattttgtttgaaacttgcattattagaatcacacacttaacttgcttggcctcggtttgcg

SEQ ID NO: 1440 - DNA, 1501 bp, Oryza sativa
gccacgaagtagtcggactcgatggcgacggtggtgctccccacggtgccgacgggcttgccgtccttgcccctggtcgccgccgtgtcgctccaggcgatcaccgccgggttcttggggtcggacttgaaggtgatgaagggcttgctgaggttgaggaagatcttctcccggaactcggcgccgggcttgaggtcgaggatgacgcgcttcttgttcccctcggggaccttctccagcgccgccgtgatggtggtgaaggtggtgtcgcccggcgtccccttggggtcgatcacccacgtcaccttggcctcctccgccgccgtcaggttcgcgtccagcttcttcccgccgagctcctccgcggtggccatggtgtgcagcgccttcttctccacgtactcctcctggttcatcgccagccacttggacaaccctttgccggagccggaggtgctggtgatgagcttgttggctggctgctgctgcccccacgacggcgccggcagcgtcgccgccaccgccgccactagcagccccaccgcggccacggcgacgttgggacgatccatcgtcatcactttattagttactagttgctgctgctgctgctgcaactgcagcttcttcttcttcttcttcctcgcttcgatcatggcgatgcatatatattatagggtgttcttggtagattaatttggatgctcccatgcatggaaggaagatgaccatccatcttgtttttgtttttgattggatggaagaagcttgtgcttggatggccgcataggtaggacttgctaactagtgagaggtgatctctcgaccttaatttgctgaaatttatttatatttattttttaaaagattgtctgggaggagtgtaaatctttttttaaaaaataaattaataaaattctaatttgcttcggtgataggcttaattaattatctgggctcgattctaaggccttttgtgcagagtttagtaggccgtatttgggtcgcagtttgatgggccgaatgaatttaagtcgctggaactatggtccatcctttcaggaacgtgtagaaaagcataaatatcatacacagaacaaaaacgactccccctgtcgttctaaaataagtatttctagattgttgaacaaagattaaagatgaataaaaatatttcttccaatcgcgtaactggtagaaattcagaattttgaatttcttatctttatgagcttctgattgttgaaaaatgcttatatttctatgcattagaatcattacacgcctaaaaatgtttatatttatatccatacctaattaaaaatatgtaaggcttctgtagctcttttttctgtccgtcgtcgtctctcagtcagttcgttagagctcggcctagccatcactcgtctcggcctgcttcgcagtgcgtgccttcaaatgatgccccgctcttctctcctggtggaacactagcgccgtcgtcacgtcggtctgccctcta

SEQ ID NO: 1441 - DNA, 1501 bp, Oryza sativa
ggagattaattgcacttagtgggggataactttataggaagaagggattagtcccagaacacatgcctcttatctccattcgctcgtcctgcctcccttcggcccaatcgacaagtgaattcgtaggcctagctagcacatgctcccttctctcgttgccaggccagaaccacgcgctacattagcgtcttcaatctccaaaggatagtcctgtgctcctatcctccccatcaaatataatcgaatcttcctcatatctcgaaattggttgagggttctcctctttcagtccccccaaaccggagtgaatctgcattcaatttcgcaaaactctaggataaaaaggatcaggtaagctattggttggtcattgttggcgaccgttaaatagagattaaggctgacgaattaaagccaaattaaaaggaaaaatcatgaggaaaatgatgagggaggagtggggaatcgatttttaaaagcacatagagggcagaccgacgtgacgacggcgctagtgttccaccaggagagaagagcggggcatcatttgaaggcacgcactgcgaagcaggccgagacgagtgatggctaggccgagctctaacgaactgactgagagacgacgacggacagaaaaaagagctacagaagccttacatatttttaattaggtatggatataaatataaacatttttaggcgtgtaatgattctaatgcatagaaatataagcatttttcaacaatcagaagctcataaagataagaaattcaaaattctgaatttctaccagttacgcgattggaagaaatatttttattcatctttaatctttgttcaacaatctagaaatacttattttagaacgacagggggagtcgtttttgttctgtgtatgatatttatgcttttctacacgttcctgaaaggatggaccatagttccagcgacttaaattcattcggcccatcaaactgcgacccaaatacggcctactaaactctgcacaaaaggccttagaatcgagcccagataattaattaagcctatcaccgaagcaaattagaattttattaatttattttttaaaaaaagatttacactcctcccagacaatcttttaaaaaataaatataaataaatttcagcaaattaaggtcgagagatcacctctcactagttagcaagtcctacctatgcggccatccaagcacaagcttcttccatccaatcaaaaacaaaaacaagatggatggtcatcttccttccatgcatgggagcatccaaattaatctaccaagaacaccctataatatatatgcatcgccatgatcgaagcgaggaagaagaagaagaagaagctgcagttgcagcagcagcagcagcaactagtaactaataaagtgatgacgatggatcgtcccaacgtcgccgtggccgcggtggggctgctagtggcggcggtggcggcgacgctgccggcgccgtcgtgggggcagca

SEQ ID NO: 1442 - DNA, 1141 bp, Oryza sativa
ggcgtcgtcggtgacggttgcgtggaagtcggggttggcatcggcggcaggcggagtaggggtcggcatcggcgcgtctacgtcgtcggcggcgtcggcaacgagctagacggtggcggtttggagagagagagagatcgagatcgagatcaaaagagagggaggcagcggcggctctcacccgagagatgcggcggcggcggcgtcggcggcggaggcggcgaggacctcgagacgatggcgaaaaacgacggcggtgtcggtacggggatgcctaggcagtggcggcgaaggagctagaagccgatcggaggaaaaacgtctaatgttggtagagaagacgagggcgcactgggaatatatatacccccagatctttactcccggttggtgagagttatctttactcccggttcgtatcaacaaccgcgagtaaagatcttatctttaacaacatccgggagtaaagatgatctttactcccagttgttgttacgaaccgggagtaaagatatctttactcccggttgttctcaccaaccgggagtaaagatattttcccgctatttccaaattctttttaaacccggttagggttaagaaccggactaaagataatagcactgaatattgaatttcattgcatatgtgtttctaaaatagtaaataatgcattaaaattatttaaagtcgaaaaattaatgacaaaaccttcgaaaaattattgttgtctgtagtaaattaagtggataatatataataagcacgtgaatgatttaaaattgttaaaaattctaataatcatatataattagcatatgcatattaaattgttaaaaattctaattaacctatgtaaataccacatgcatgatttaaaattaataaaaattctaataagcatatattattagcatatgcatgatattaaattgttaaaaattctaattaacatatgtaaatcccacatgcatgatttaaaacttttaaaaattctaataatcatatttatttagcatatgcatgatattaaattgttaaaaattctaattaacatatgtaaatcccacatgcatgatttaaaacttttaaaaattctaataattatatatacctagcatatgcatgatttaaatttgtt

SEQ ID NO: 1443 - DNA, 1501 bp, Oryza sativa
tgactcggtcttcgtcccacgtggcattgacgtgacgcttacgtgactattttatcctagaaaaataataaaaacggtggtcccacatattagctacaccaatttttttaaaggtggagcccacatgggccccacataatcattcacaccccctcttcttcctcctctccccagctcccctttctagtttcttctctgtgtcctattcctccccagagccggcggcattcatcgtagcaccacggcaccctctctccctgctctacctcttcggcttctcctctccccgagattccctgacttggtgccaccgacgaccacatcgagccaccatctgagccccatgggagcactgcatcccaaggcgtcaacgacctgcataatcccgatctataccagcaaggatcctcggatccatacaagcagtgcctcatatttttatccatctctccttccaactattttttctctctatttttcttccgatctcttctcaagatttgttatatttcttctaatctgatctgacatgtgggtctcattattttttaatctgacatgtgggccaaaatattttgttttattttttaaaatattaaattttgcttcgtgtgtcacgttaatgccacgtcagatgaagaccgaatcaaattagccatgtaggcgccatgttagctaataccgccatctaaacggacctatattgcacagttgaaggaccagttgtatctgattttcggttgattgacgaaaatcggattcgttaataagttaaggaactcaaatgaacttattccaatggaatttctgcaagtcgtccgagggaaaagttcgataattttatgggccgatatagatcgacgtggaccaactttgtcaactttgtgggccgatatagatcgatatacatgggctagttagttagccgtggtaatgggctgggcttgggttatactaactgagaatcctttttatctcttaaatatctgtctcttctctacttatctctactattataaaaatttaaaatgctttaactggtactttagtgtgttattcgtgtatgagtcggtttttaagtttgttcgcttttataaatacagatccgtatttgagtcgggttttaagttcgttcgtttttagaaatatagaaggagacgtataagaaatcctttttaaaaaaaaaactcgcatgctaactttaaatgatcataatcctaattacagctcatgattttttagaaaaatatatatctaagtgaattatcatagtgaatttcactttaactaaaccatataataataataaaattaaaattagccttcaactgttgaaacgcacgggcatttttctagtattataaaaattaaagatgtttccgctgatattttggtacatcgttcgtatttaagttggtttttaagttctttcacttttaggaatgtataaggagttgtataagaaatccttttaaaaaacatgcatgttaacttaggacga

SEQ ID NO: 1444 - DNA, 188 bp, Oryza sativa
ccatcagatccactagtctcactgtaccaggaaggtcgattatttgtgtcagagccgtacgagatgaaattctcatatacggttctcggaggggggttcgggctgtgttaatgggggcgtggtttggtaatacgccaatttggcctaccgtaaagtgatcacataccgattcgccacgtgaaagcagg

SEQ ID NO: 1445 - DNA, 1501 bp, Oryza sativa
  unsure (1)..(1501): unsure at all n locations
atcccattcgcccgcttacggcgcatgaagtggatatgcggttgtggcaatcgaaatggattgtatcgtgcgcgcgttaattacgctcgccgtccgaagcggcgttaccgtatctccaggcgagacaaatctgctcacccagattcgcgcgctgctcaagtggtgtggcagtcttgaatagaccgcccattatggacaaacaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccctgagggggggtggggttgtgcttgcncnggcccggagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggtggattcttttccagatttagagcttagaacgggggagaagttggctgacactttgtagctcattcatacaccaatccacaaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcagacttgatccaaaacggacggccgagatcgatcggtccacgaccggctcacgggagacggggacga

SEQ ID NO: 1446 - DNA, 1501 bp, Oryza sativa
ccgggactaaagatatctttagtccaggttgttctcaacaaccgggagtaaagatccgggggtatatatattcccggtgcgccctcgtcttcttcaccaacacttagacggtttaggccgatcgatctctctcggcctctctccttcgccgccactgcctagggcaaatccccgcgccgacgccgccgtcgccgtcgtctcgagctacgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgatgacgcgccacgccgccgccttcgccgccgccgcatgccaacgccacgccgccgccgccgccgatgccttcgccgtcgcgcgcgcaatgccgtcggcgccacgccacgccgccgccgtcacgccacgccgtcgccgccacggccccgcaacgccacgccgccgccgccgccgcgacgccgccgcgccaaccgccgccccgatgccgccacaccgccgttaacgaacgagagcgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacggacgtgaatgagaacaaacgaacgaacgtgaatataatgagaacgagcgaacgaacatgaacgagctagggaacgtgaacgaacgttaacgtgaaatgcaatatatatatatatatatatgttacttcgcatttatcctaatacatctttttgtatcttgcagaaaagacgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacaga

SEQ ID NO: 1447 - DNA, 1501 bp, Oryza sativa
  unsure (1)..(1501): unsure at all n locations
gtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctccgggccngngcaagcacaaccccaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttgtttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgcca

SEQ ID NO: 1448 - DNA, 1501 bp, Oryza sativa
atgtctgaggttgttcttagattttgcagtgatgcatgaacagatataaatgctatattaaagggaaattaataaaggaattaagttggattgttcttaatgaaactgctttgttttagaatatatatagtgttatattatttaagcttcaattgatgattcatctctaaaattgggtaattaatctatagctgcaggacatgtaaacaatgataaacttttggagttattcggtttggagtaaaaacaaaggatttggattttgaaggattaatctctatgattttttttgtttgtaagagcctaagcctggactaaagattccctcttacatcttataattaagaatcataaaattaggttagtatatatactacatgacttactatgaataaatttgcaaagtgctatataatttattagaacacatataaccccgaataataaatttttataatatttagcaaaagttgaacaagctcatgcgagtcgcttggtgggaaactgtgctggctgaaaacaacatgaagaattagaggttgttgtaacttggaatataattacgagtgccagattctatacttatgttactattttctatcctaagttacctattagcaaattaactgtttatacatgataccttgctagcattgtatagttcctataatttgtttcactccaatctctcgccatatacatataagacgtcacatatctcgcataaaattattaaagtcagagcgtacatttcttaattaacatagcatagttaccttatattcactgatctatttataccgaaacattggggaagcatgcatactcctttcatgggcgagtagtcatgaaccgatcatgcatacataatgcttgcaggcctaacaggacaagccaacgcttgtcggcccaattaaacttttttctgttcaaaattttgcacatctgaagagatctattgtcatatataaatacgtgtatatccaaaacaaaaatgacaacaattaactgtacaaagatataaggggcatttaatgctggaacatttgaaatgacagcaaagaaaccttaggctgtgtttagtttaacacaaagtttggattttggttgaaattaaagataatgtgattgaaaaattgtgtgtgtatgacaggttgatgtgatgaaaaatgactgaagtttggatccaaactttgaatctaaacacagccttacacatggaaaagcaattaattgtacactagagatttctgaaggcataaatgcaagaactcatctaaaaacatgagcaaaggtgcacaacaatgagcgcattgcgaaacagagcaggcgcacatatatatatatacatatatatatatatatacatatatatatatatatatatgtatacatatatgtatatacatacacatatatatacatacatatatatacatacatatatatatacatacatatatatatatatatatatatatatacatacatatatatatat

SEQ ID NO: 1449 - DNA, 1501 bp, Oryza sativa
acttaatcttggaataaaacactcgtgaaggatctggaagaattggatgggcttgtgaaatcggtcggcaggcagtttgagagccttgaatcatctgtcaagacattcctgctatcaatgacggagcggatgaagaagatggtttcacagcggcctgccatggatctcgttcaatatatcgagaaggatgcccatgaaatcgtatccgcgctctcccagaaacctccataatcatcatcatccaatcgatcctgcgtgctagctcatatgtgctagcttcttgtggtggggttcgtttaatttgtagagagcggtgatataagaaaattacttcttgcaactgaattctcgtttggctctagaattggctaatagctatatatagcctgggtgattttcggctacgacctcgatgctggcacggtcaccttcgccaccgcagactgtgcggggagcagccggctggcggagcagacaagcggcgagcaggcgcgctgcgggagaggaagatggcactgacagggagcgggatggggagagcgaggacgccgccgccatcgtcgtccacggccgcagatctcgcgcccgcgccgtcagcggcgtcggcggtgggaatgtgtgagcgcggggcagcggcgagccgagcaggcggtggcgggcggagcgggcacgacgccgaagacaacttcttcccgcgccggcgccgccgggcgcctctcccatctcaagcgtcgcagccgtcgccgccttccttcttccgtgtcgccgccgccgcctcccgggcctgtcaaatggtccgaccccgaggtcgcatgcgccgccgccgtcgccgccggcggtggccgccggacctcctccccacccgccagccgccctgtagagaggaaagaagtcagagaaagagatgaggaaggaagagaagaggggagagataacctgacattctgacatgtgggacccgcgtgggttgcacgctgactcagccgccacgtcagataaaaccgggagcaaaaccaccggaggatctaaactaacgattttattagttgagggacacccggtatctggttttgcggttaggggaccattttgtaactcgatgacaagttgagggaccttcggtgtactttttccattagatttcgattagttttgaggttcaaagtgaacttattccttttatctttcgggccaaatattcatgggcctttatggatccaaattcttttgggctattcctactcagtattctacttatttgatgggccaaaaggccgcaaattcgccgccgtgaagctctggatgctgtttctctctctccttcctcggcgcacccggccgccggccatccaccgccgtcgcatccaccggccgccgccacgcctcctcctcgccaccacttcctcctcctgccgcgtaaccactaccgcctccacgcaacaatgccctccatctactctcgccctcctcgccgaccacccgcacccggccgtcgcggagt

SEQ ID NO: 1450 - DNA, 1501 bp, Oryza sativa
aatcacgttcgttcgcgttcgttcacgtcgttcacgtcgttcgcgttcgttcacgtttcgttcgcattcgttcgccacggctgccacggccacatcctccacgtgagcgcatcctccacggtcacatcctcgtacacgttcgggcagccgtggcgacagcgtgtcgcggtggcggtggggcgtcgcggcggcgtggtggcggcggggcgtcgcggcggcgtcgcgcggtgtggtggcacggtggcgtggcgagctcgaggcgggggcggcggcgtggacgcggcgtggcggcgcggcggcgtggcgagctcgaggcgggggcgtcggtgctgtggctatggcagccgcgtggacgcggcggcgtcgtcggtggcggctgcgtggaagtcggggttggcatcggcggcaggcggaggaggggtcggcatcggcgcgtctacgtcggcggcggcgtcggcaacgagctaggcggtggcggtttggagagagagagagatcgagatcgagatcaaaagagagggaggcagcggcggctctcacccgagagatgcggcggcggcggcgtcggcggcggaggcggcgaggaccgcgagacgatggcgagagacgacggcggtgtcggtacggggatgcctaggcagtggcggcgaaggagctagaagccgatcggaggaaaaacgtctaagtgttggtagagaagacgagggcgcactgggaatatatatacccccagatctttactcccggttggtgagagttatctttactcccggttcgtaacaacaaccgggagtaaagatcttatctttaacaacaaccgggagtaaagatgatctttactcccagttgttgttacgaaccgggagtaaagatatctttactcccggttgttctcaccaaccgggagtaaagatattttcccgctatttccaaattctttttaaacccggttagggttaagaaccggactaaagataatagcactgaatattgaatttcattgcatatgtgtttctaaaatagtaaataatgcattaaaattatttaaagtcgaaaaattaatgacaaaaccttcgaaaaattattgttgtctgtagtaaattaagtggataatatataataagcacgtgaatgatttaaaattgttaaaaattctaataatcatatataattagcatatgcatattaaattgttaaaaattctaattaacctatgtaaataccacatgcatgatttaaaattaataaaaattctaataagcatatattattagcatatgcatgatattaaattgttaaaaattctaattaacatatgtaaatcccacatgcatgatttaaaacttttaaaaattctaataatcatatttatttagcatatgcatgatattaaattgttaaaaattctaattaacatatgtaaatcccacatgcatgatttaaaacttttaaaaattctaataattatatatacctagcatatgcatgatttaaatttgtt

SEQ ID NO: 1451 - DNA, 1501 bp, Oryza sativa
tcgccgccgctcgctgtgtgctcgccgccgtcgccgcctatgctccgtagcgccgctcgtcgccggcctcgctcggcgtagctccgcccaatccgacgctagcaacggattcccggagtcgcgtagatgctctagcttgcccgaattggtctcccgtcgcgccgtcgccgtttccccccttctctcgccgccggttgccgccgccgcaatccaccgcagtcgagcaacccccggcgaatccgagtcattggctcgtctcccctcgtcccgtgcaacctcccggtgtgctcgcttttgcctgtatcgccgtggttcgctccgccgctcgctgccgccgtccgccgtccgttccggccgacgtcgtcatctacctcccgccggcccgcgtggcagccacgtaggcgccacgtcggcgccacctcggccgcgaccgggtcaagctgaccccggtccgccgcttccctccgccccgctcgcgcgcgcggtccaccgcgagccgtgaggctgcgcgtgggcccgctgcatccgcacccccgcgagccacgcgcatgcaccgcgccccgctccacaccctagcgccgcgccgcgtactccctccacatggtaagccgagccgctgacaagcgggtcctacccgggaccacgcaaggtggacccggcccaccggctctctctctctcctccccgcccgcgcgcgcgccttgggccgccttcttggaccggccagcccattaagcttggccaagccgcccctttctctcgggccgcgccctagccgcccgagggaagtctatttcccctccctctttcttttcttttcttttcttctctcaaaaaggatttaaataaatccttttcctttagaccaaaaatcgaataaacttagaaattcaaaatcttcccaaccgtaagtccgtttgactccgttcaacttccaaaactcctcaaatctcgagatctatctaatgacacgcctagaggtcaataatatggctttattttcgccgtttgttgagttgtcccatttcgcgtgtagtttcggagcccgaagacccgcagtgcgaggatttcgaagatcaagttcaagatctcgagcaaggcaagtcacctttgatcatcttgcacctataatttaaatctaagtatttcttttctgcaaatattgcatgaataggatttacacaagtaattcggccgcggcttgcgagacggcctgccggccccaatcctaattgctgcaattaccctccttgaattattgaacacttaaacctccttgttaacgggccttcgggtacgcgcatcggaacaccccccctcaaaatataaaatatccaaccatgggtaaaacttgggttttacaaaagacttggaaaacccgacacctgggtcggtgcttgcgaactaaatgaatttccaaaaaatcggggaccggggaacgtaccgggtgtacggtttcccgctcttgcacttaaggaccgtttccttggaatttcatccg

SEQ ID NO: 1452 - DNA, 1501 bp, Oryza sativa
gggcgaggctgtgatgggcgacggcgagcgggaggcgaggatgcggcgcatctggccgctgctccacaccccacgcgcgcggatccagccgcggtggggcatagccggcgcggctgtgacgggcgactggggcgggaggcgaggcggtgatggatccggcctccacgccgcctccatgcgcacggcggcgacctccgtggtggcgagctcggactccgatggataggcaagaccagtggtgccacctccacgacacgccgccgtcgatgtccggagcaagtgtaaacaaaattttaacttttgctcataaattgtgaggatgtatatgttgagtaaaacttttattgtcataccaagttaattttttacttagtaaggataccaagttaattttttacttagcccgccctccaatgtttttaaccttattcagctgcatcccgtgtaaaatacggttttgtaatgaatacgtgaaaacttatacgtgttgggatgtattttttgataacaacaaattacaaaacaatgcgaacaatcctctgaattaaagaaaaatgtcaactctacaacgatatcatcgcaccctaccacacaactgtatctcggttaaattttaactccgcgagacgggttggttgtctcggtcatggggtgtcacgagttaatttttaactcagcagtgaccaggttcaatcacatatcgttcaaaattcaacaacaactaaatttttaactccaaaaccatgtcatcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtgtcgtgccgtgtagcgcgaccgtgtctataaatatatatatatatatatatatatatatatatatatatatatatatatatatatatatatatatatatatatatatatatatatatatatatatatatgtatatatatgtatatatgtatatatatatatatatcagggttatggataccacatatctaatagtagttgattgaatcttgacaggacccaccacttgatgaaaccatgagcacttgagcaggagcatgaagtcacatggaatttcttctttaaaaatgcatggagggacacctctccctccaaatctccttttttttcctagagtgcttcatatatgctatatatatacatcacttgatgaaatgatgagcacttgagcgggagcttgaagtcacatggtttgtctttttttttccgcacttgtgacagcatgaacctaagcttaatctatgtttttttaatgtactgatgtacaagcacaaaagattacagatgggaggcttgtgggtcagctgctgaacctga

SEQ ID NO: 1453 - DNA, 1501 bp, Oryza sativa
agagggaaaaaggaagggagaaagggggcttgccccttgcctctttgggaaaagaatgagggagagagggcgatgaggaggagccctgcctcctttccttggaagcacgcgcggggagaggcggggccgagtcgatgacgacggcgatgacggcgggggcggtttggaacggagcggcgacacgggcggcaggcgcgggctcaggcgcggcaggcgctgacggcggcggcgtctggccggtcggccaccatggcgcgcgcgcgcgggaagcaacgggcggcgccgcgatttcgcgggcggggagctcgcggggatggaggcggggagagggagagcgagggggaggcgctcggcgcggctcacgggcagagcggggagagagggagagagagagagagagagagatgaagagagatgggccgagaggaattcggcccatcgaacctgagggaggcaaaacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattc

SEQ ID NO: 1454 - DNA, 348 bp, Oryza sativa
ttttttttcccccccccctccttcctcccggcctccctcggcccaagccgcttcccctcctctcctcctgggccggtcgcccggcccaaccctagccgcgcccccgccccgtgccgcgcacgtgcgcgcgcgtgcgcgcgctgacgccgccgcccgaccgcgtggggcccacgcgccagcgtcgtcttcctcctcccgcgccggccgtcctcctctctccctcccgagcgagccctagcgccattcctcctctaaatccgctctattcaagccggctcttaccaaattgattgggggcaattaatccccattgattcctcttcgatttcccccgtttttccccttgaa

SEQ ID NO: 1455 - DNA, 1364 bp, Oryza sativa
ccaactcatactaaagatgtctccaaggttagattaaaaagatgtgtgcaataggtgggatggtaacacgtacatgtgagtgctgagatgagagatcgtgagttcaaatcccacattctgcataagtttgttaaaatagaccaggtttgaattatgtgaaacatcacctaaaaacaacggtcgggttgtgccgtgcctggtccgggacaaaaccccatgacatgggtcgggccattaggccacttgccttttggccatctataaatagaggcaatgccaaattccttgatatcaaaacaggactaaaacacaaatattcaataatatgtaagggtatgcatatcattttttttacaaacttaacaccattaatatgaattggcagaataggggtaaactgaaacttcacttcgaaaaagtatggacaaaataaaaaaccctaataagtgggaataaaatcataattacaacttaaaagtataagtagagataagaacacaaatacccctaaattaaacggcgattaggataaactgaccctacatactgttatatacgttactgttggcctgttgcagatgcatcaacgagttagggtgtgtttagttcacaccaaaattaaaagtttggattaaattggaacaatgtggtggaaaagttcaaaatttatgtgtgtaggaaagttctgatgtgatggaaaagttgaaagtttgaaaaaaaactttgaaactaaggctgtgtttagatccaaacatcagtcattttccatcacattaacctgtcatacacacacaacttttcagtcacatcatctccaatttcaaccaaaatccaaactttgccatcaactaaacacagcctaaaccaggccttaggcgaaagttgctgatccacacatcagtttggcaggcatcagaatttttgtccggtcattctcctacagtacacaagtgcatataattgctctcgcatggacccggaccagcagagattgaggtagcgtgcaggcggtgcagctcttcgtctctcaaaatctcccaattaccgtacagaggtacagagttatgtgattgttttggaagatacacgtgcttagtcctatataaagcagctatagctagttaaattaaagcaaccatatcacacagaagatgcaaagctagctagttttcacagatatcctatcttataatattagattaatagtacgtatacacaaagcttctagctacttaatttctcggtcgctgaaagggcactatgtctgcaagctccatccctctccctctcttgtgtaatggtcctcctgtgcatattagggttagccatccgccggctgggcttcttgctcgttcggatggtgt

SEQ ID NO: 1456 - DNA, 1501 bp, Oryza sativa
tatcaagcagacctaaaatactaccaatgtgaagatccatttcactgagaatacctttacggtggtctctactactatactagtattatcactagtggagtgatagcaaccgttaatttgtcagttttaataccagtataaaacatattatagaactacttagtagttgagatggcagtataaatagatacaaactgttggaacataaacgatcgatgggcagtctagatatcgattctactaccaatagagaccatttgaacaaactgtccatcgatcgtatacaaatattccataaaaaatatttgtataccagctctatgcagggccagtagactttataacggctgattgtttagatgaattgccaaaacaaggtttttctggtaataccaaagtagaacatcattgagacatgcatatcatttgatattattatcatgattagctactttttgaaagcgcagagttaattacttttatcatatccatttacttagatgatatatatatatatatatatatatatataccccgtacaacaaataaacacatgcttactgagaaaaatttctgagctccttcaagtggacatgctgcagcaggttaaattctagctttgcaagatccagaagatccacattgtgcccttcttcctgcccatactccagcatataatgcaatgtttctattctcttgtaggctcttggtaatggtaaatctagggcacggttgatttgatcagctagagggggtttgagcccacctccacccctcattaattcaagatggtgtcttgcaagagagattgcttcttcaagttccggctcatcatggatgaggagatgtgctgcattatataaacttaataaccccctcggttcatcagctattccagtattgatgaacctgccatcctctcctttgaatctcctgaatgcatctgcaagacataatcctcttcatataaaggaaaccacttctccaaatcacattaatttcgttctatgtattccctcagtttcaatttaattttgtcctaaattaaatatttgtattgttgaccattgattttttaaaacatcttattatagagatactactaggagcttctagtattccgagcgccaaacatatatcagccaaggcctacctcacctcacgtcccatcatcctgctcccaccattatcagagtaaatgatttacttcgataaaaacaacttccctgcttccgatcccaccacacgtcctgtcatcccgctcccaccactaatggagtaaatgatttacttcgataaaaacaacttctttgcttctggtatatattatatttttcctgtacccaaccaaccactctcacccccacttcattttttcctttttttttcctgatctgaatcgatccaccatcccagcccatagatctatgacgcaccatggatgtcacgaccggaaatcacccaacgggcgttcctgacgtgcgtgtattattccttgtcc

SEQ ID NO: 1457 - DNA, 1501 bp, Oryza sativa
attacttgttttatgaaaaaaaagaaagacatgtgattgttttttatttttttacataataaaattgcatattcttttctatccctgcttcgcgtttcgcgtaagcacaaaccttatttcgtgttatcagtcttaggcattcctacttcctccgtaaaaaaaaaactaggttaactcaatctaggaggagacgtgactcctcctacgacaacgaatctggacaaaagagtagttcagatttatagtcctaggactataaatatacgattcttttttatttttttacataataaaattgcatcttcttttctatccctgcttcgcgtttcgggtaaacacaaaccttatttcgtgttatcagtcttaggcattcctacttcctccgtccaaaaaaactaggttaactcaatctaagagaagacgtgactcctcctacgataacgaatttggacaaaagagtagttcagatttatagtcctaggaagggtcacatacatcccttattaggttgagtttttttggatagagggagtaccgatacagtgttacgcggtactgtgctgggccgttgcttctcaactctatgggctggctgttgggccagcctgctgctgctttgtttgggccgcttgctagctttctttgaaattttttgagaattaatattatttttatggaaaatcgcaaaagtagtggccaaccggggaaaatcgcgaaactaggtccctatcgaacgggtgcaattcgatagggcacctatcgaacgacgggcagtcgacaaagccctgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagctgccgccgagagtcgccagatcatcgccgtgagcgccggatggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagacttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattatcaaaactagttgtttgttactaatagttgtaaattagtacacggcaatatagtataagttgtaatagggtaattatcgaatgattaaatgattaaacgtcagactatttgtcatgttttattagga

SEQ ID NO: 1458 - DNA, 1501 bp, Oryza sativa
ataacacaagtgctaatcatagtctgggagatgttggagctttacctaactataaactctagcagacggcacaacgaaaagccgagatttttcagtgccaatttggattttggagggccgggccacataaaacgaaatctcaaaagctatatatacatagttcgaagaaaacgaaaccgaaaagtttgacgactcacgaagaatcccaaggaggatttgccaaatctcccaacttgcaataaaaccaacgtcttaatttacttgtctctggttcttctgatctgcctatagcaatagcaccattcttttctatcatgtgcacacgtatatgcatactaacccatgcaaattaatagcttattttacatgcaacccaaggtttatttaactgctaatcttgttgattagtcagtggggtcctgtgcctttttgtactggagaagagaggttgagatagagcagcacatatgatccatgccgtgcatcttccgggcacggattccgatgcgtggtcccagccgtggatcgaatttgttgaaaaatataccctaccctatgttgtggagtacagattaattaattagttaacagggggtgctttagaaaacattgttaattatcatggtactatggtagctagagggattagatgtgtagatccactggtgttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagat

SEQ ID NO: 1459 - DNA, 1493 bp, Oryza sativa
tcgatcgttctcgttcacgttgtcgcggcaacgtacgttgacgtgttcgttctcgctctcgttcgttcgatcgttctcgttctcgttcgttaacggcggtgtggcggcatcggggcggcggttggcacggcggcgtggcgacggcggcggcggcgtggcgttgtggggccgtggcggcggcggcgtggcgtggcggcggtggcgtggcgtggcgtggcggcggcggtgtggcgtggcggcggcggcattgcgcgcgcggcggcgaaggcggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcgtcgtcggcgcggggatttgccctaggcagtggcggcgaaggagagaggccgagagagatcgatcggccgaaaacgtttaagtgttggtgaagaagacgagggcgcaccgggaatatatataccccttgatctttactcccggttgttctcaacaaccgggagtaaatatcttatcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattttaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaagatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 1460 - DNA, 1501 bp, Oryza sativa
atggtcgctgatgcgttggccaacaaccattgaatccgcgatctccatggctccttgggagtccaggcaatcctgcaatacttgcagatttggtcgtcgttgtgaacaacaactctctaagagggtcatcctgattctttcatctagaggtgggagagttcggggtcgtactccacccggtcggcttaccttgacctcttctcgggcaggatctcgtttcggcacctgccaatctagcgatcttttgccccgccccgatgtcgctacttcatgtggctggtcgctcaccgacgctgctggacggctgaccgactagagaagcatggactgccgcacccaacctattgtgccttctgcgaccaactggaagagacaatcgaccacattctgattgtgtgcccggagtccctccagctatggtggactatcctttcgagcctcggtctcccttagtgtttcccctctggcactaattccttccatgagtggcactgctcttgccggctcaaagttccgagggagcgtcgtagtgggttcgatacaattgtgactcttggcgcttggtccatttgaaaggaaaggaacaatcgtgtgttcaacaaccgttcccggtcctggcctgaggttgtcacagccatggcgcaagaggccgccctgtggcatcttgcccatcccatgttgctagtgctccctagttagcgtgtttggtcgttcggtcgtcacattgtaatagcgagagtaggcttaagtgcttgttttcctttttctcttttttctcactctctcccttctttgtttgccgtttgtataaattttattcctcttaatacaaaaagtacgcaatccttttgcgtattcccgaaaaaactagagagttggagttgggtttaggctgctccataactcctccactccagacctaactcttggaactaaaattaggagttggagctctaccaaacaggaccaaaagataagcaattataatagcgaatttgttatctgtattatgaatgacttagaatgagggatactgaaaattagaaaaaaaatccaaaacaatttaaaatgaagtttcaaaattctaaaatcaattctaattttggttgcttttggtaagccaacaaaccaaattaatttcagaaaatcatatatgataaaagttgcacaaaatcgaatatagggcttgttcagttcttatccactttctacaataccaatttactttctacaataccaaaattggcacattttcgtatcgccaaatttcagtagcgttggttgtgtttagtttaatgtcttagactttttaatagtgggaacttctagaattattaaagtttggtagtatagcatcaataataatgtgtttagtttgttgttttactaaaatttggtattgttgaacaacaaagtgaacatgcccataatacgacttgtggcataggttaaaaccaccacgacataataatgacttgtggcaacatcaaatattgcggtg

SEQ ID NO: 1461 - DNA, 1501 bp, Oryza sativa
taaccatcgccgccataggtaccatcgtcgacagccgccaccgccactgccacagccaccaccgtcgccagccgccaccgtcagccaccatcgccaccgccacggacacccctgtccagccgccaccgtcagccgccaccgtcgctagccagcgccgccagacgccagccgtccagatccgaccggggtggtgcggatcggaggtgcagcgcgaagcgcgggtcgccggcatcatggaggaaggcatcacgggcacggtgttcacagccggagcattgacgagggcgccgcgccttcctcgtggtggcgaggttcttgacgagggccggcgtcgcggcacacgccgcagtccgccgccgttgtcggcaacttcgtcgttgccacatccgccaccatcgccgccgctagccaccctcctgccaggttcgcggagcggtgccggcgtcgaccgagcccatcgccggtcaccccggccaagcggggagaccagatctggcgacgcagtcgcccgtcgctggagccgcggagagccaacaccgagcgccccaccgccgcgcccaacgccgcgccgtccccgtcaccacgacctcgccgtcccgccgccatcgtcgccacgcccgcgccggggcgaggtggagccgaggaggatggccccgccgccgccatcccagcgcgtcgcccggctttgccggcgacgagctccggcggcggcgaagcacagaggagggaggaggaggggcggcggcggaggctagggttctaccccctaggggcggcggaggctctttcttattggatctctttcatacccttaccattaggtttccttcaggtggctggttggtttgcttcaaaatatccattactagcaaatatgcccgtgcgttgcaacgggtgaatatcaaataaatatggattgtcaatattgcttgcatacttatttaaatgcaataaaagcagatgcatcacgtccaataggaaattgctctgttttttttttaaatctgggtgcatatatgagtaacgtcgagcgagactcttagtatccatactaaatattgggtgcatatacgagtcttgcttgtgttttctgtttttctaatataggttaagaagatgtttgtatcctacttccatgtaattcttattcttggactttgtaattcctgtgttgtaattcctaagctatgtaattgtatctaactcggtttacgcttcaatcaatccttcaacgtgcgcacccaaataactgatcgggaacggtggtggaaaaaaccgggctcaccaaaaaaaaaccgtgaaaagaaatcgccacccacgaaaaaaacggtcggataaaaaaccagtccataaaaaaaaacacttccaagagaaaaccgcgtgcggaaaaaaaaccatcgggtctcgcacatacggacgaaacggagtgtacaaaatctcaaattggtccatacgtagcaaatcttcaaattttataccgctttacatattaggaaacgga

SEQ ID NO: 1462 - DNA, 1501 bp, Oryza sativa
ggcatgggtgcatgtcaccggtgttcctcatgcttggcggcattatctcggtttttgggcacttggtagtgtaattggggctacagaagaagtagacatgctaaccttccggaagttgggagtgatccgaatcaaagtgggcattatggatagggaacatttccctttcactactgatgttgtgtttgggaagcatgggtatgagctgatttacactattgagcctgaagattttcaacctgccattcccaccccatccaatgatactatggatcatgattctgcgggtactgataatggtagcaacatggatggaggtagtgctgatcatgcagcaaaaaagaagaaggcgaatacatcgacaccggagagttcgaatgctgcagtttcaggtccaactcctatgcagttagcagtgactccttttggggatcgtcgccctgtgccacagagacagcaaattatcctgggcactagagtgaacaagcagcacattgcggtcactccgttaagggtgaccggatcgacatcatacggtcggagagaagtttctctctcgacctcaacagctgcgccagccgcaccgacattgattgtgcttctaccgaagtcttcatcatcgatggatactccacccgggctgacaatggcggtgtctccacctacgcctgcacctttggggtggtcgctcacgtcgaccccacccccatccgctcctgtgcagaccctgccggcatccactccacccatgtagacccgttggcatcgtcgaggcaatcaacatcagcgccgacaaaatctccactagtgccgaccctgccgatgcctacttcactcgtgcaaacaccaccagtgcctactacaacaactcaaactgctgcctatacacatgagggtcatgtcactcagcccggatcgagctccatcaagcactcgaccttcgggcatgtgaggtccccatgcactcctttacaggaggaaaagaccgaagggcttcgccatagtgatcgctgcaatgcagccatatcatctaatggcattgcagcggccgatgaggattcaacgacgaaggctaaacgcagggcagcgatgagaaatctggatgggccaatgatgtccaagatggctgacttagcgaagtcatcactttcgtctacatcataccttgacccttctataggtatgcattctaacctcccatcttcttccattgtttatttatccaatgaacaattttcctccaatttgggaaagataggagtttctttgggtagtggaagtgaaaacgtggccttttctgttaatgctattaaacatatgaaggttgacagatggaaagtagcacctaaaactaagatgaaagctaaggttattgatgaagcgaatgatcaaaatccttttgatgatggtgatgatgaggatgccaaacctgatggcatcttactcgctcacttattcaaggaagtttctgaagtagacttggatgatgcggagcttagca

SEQ ID NO: 1463 - DNA, 1501 bp, Oryza sativa
taaatgtttatttttgcctttttcactagccaaacacgtcctaagatgaaaatatctattaacttttggctgaaaaaaaatacttagggagtgtttaattgaatgccttaaatttgtcaaataaagtttagacacgttacttaggaagagtttggttgatgatttgtgatcatggctaggcacattaatttttcaaccgcacaatcctacgagttgatgacttcaaaacttttttttttcaaacttgcctaagaagcggctaacatccctatggtgtttgaatctcctgaagatgaagtgtttcatataaaacgaggtggtaataacgtgtgattaattaagttttaattattacaagtttgaaaaattaattaatctgatgttttagaacaacttttatatagaaaattttcgcacgaaacataccgtttaacaatttgaaaagtgtgacatgaaaatcttcattttcatccaagcccagttacagaatcgaacgggaccaaagatgtagtatgaactaaacatccccttatactaaacggggatgttagcagttccgatcgaggaaggacattataaacggggaacatatcctgcctatcttattccatttccatgtcatctagtacctcattatatagtaaattaattatcatctctttgatcccctaccctagtcaggctagtttttccaccaaagatgtgcacggagtagctaccttctcatgtctcttatttaatctacatacttggatcattagccatgcattatatatgcgtgcttgaataattgttttgaagaactagctaggttgtgcactaactgatgcagtgcacaaatacttggcgttggagtacaaatacataaagtttaaccatttatcttaatcgtaaaaagttctataaatactttaggttgcgtccaattgcatttatcaagcacacttttttactgctaaatgatctgtattttacaagagactttttatatcaagtaaatacatttttaagtttataatagttaatacttaattaattaattttgtactaatcactcactccgttttacatgcaactgaaagactcaagctaactgttgatttgaacaaagctttaaatggttattgtatttgtggagattatgagtaccttatatccacatggctggtttatccgactggttgtagaggataggttatatctctagaatatgtaacggattatgattaaggtattaaggaaacgtcttaaagtcttatttcgacaatattgtaaagtagatgccgtaggttaggtttttatatgtaatcttgcgcttcgacctatataaagagggcatgaggcctctcaagggcacaaccaacaccaagatcgtcaaatcaatacaacacccggtagattccaatccttaaataagagcagagtattacttctcgtcgagagtgtcagggttacgggaaaggtataccctctaccctttgatatacatcacatatcgaca

SEQ ID NO: 1464 - DNA, 1501 bp, Oryza sativa
gtcaattttagatgaattttgcaagttgaatggcccaattcggagttcgaatgaattagatatgaattttagaagttttgagccatttaaataaatttctagaattattactgatttattgcggaattattatttaatttttcaaaggaaaaggcacagccgctgacgtcatcaaaggggaagggcgcgccgataggtgggccccacacgtcagcgggactaggggagggcgcacggtggactcggtccactgcagcctggcggcaccgtggacccagaccacgggagtggtccacgggcggccaaagtacaggcgcggccgagcggcggcgaacgacgacggcggcgcgcggccggacggcgaccaccggcgacgacaccggcggcgcgggtcggcacgcggagagcggcggaaaaagcggagaggggatgctcaccaagcggaacggcaccgaagggaggcgagatggcggcggcgctcctcggggtggcacggcaatagcggtccagcggtgttccgcgagcgggaaccggcggacggcgatcggaaggatctggggaacatggagggaaagttagggaatagggaggaggcgcaaggcggcgggaaaactcggccggaagccggcgacgagggaaggagctcacctctcacagcggggaaaggatttccggtgacggagagcttggatgaggggatgtcgggctccctatcattgctgcgaagccgacgaaggagagcgtgaggttggaggtcgctcgcggcggcggcgaggtggtggtggcttgggttgacagaggggatggagttccggtgaaggaacagggaaacggagcggagaccgagcttgcccgcgcggtggtgaagccggcagtggaggcggcgcagcacagtggcggcgggagtggcgatggcgcgtggctggaggtgacggcggcggcggagagaggtgttgcgcgaggcggcgatgttccggaggcggagaggggaaatggagtaggggccgggctgcagcacggcgccgcgaagccgacggtggtggcggatttgtgcggcggtgggtggagcagcggtggcgggcggccggagctcgccagaaagtggcggtgcgcgggagcggcgtggggagagcgagggagagagtgccgggctcgggaaagagggggaaatggaagaggagagcacggggagggtttatattggctcgggagggagaaattgtggccggacgtggcggatttgaggcggcaacggctggcgaatattataatagataacatataatataattcataaaattatttaaaagttcaaataatattaataggagcttatgccactgagtttatctcagttcaataatttgtcatcgacactgtctatttctataaaataccggcaagtttatcaattgttctgcatatgttgttaggcaaggtcattgtcagggttacgggttaggtataccctttaccctttgatatacgtcgcatatcggta

SEQ ID NO: 1465 - DNA, 1501 bp, Oryza sativa
gggtccagacttgagagatactcaacgtaaaccatatggttgactgacttgacgttgacatggacttgttagagtacaagtcaagaaaataaaattcgcatagtactccttatgtttgtatttactggtcgctattacttttactgttcaaattttgactagtattagattttaaactgttagaacactggtggagaaatcctttttaatcccggtttacaactcctgtaatcccggttatgcaaccaggactaagaatctaaaactaaagatacccatctttagatctggttgaaataaccgggactaaaaatgaacggtatagtcccggttggtaactccaacaggagtaatatttttttttcttttttttcctgctagtatgatttcgaaatacacaaatcattcataaaattatccacaaatcattcgaacaccacaaatcattcacaaaatccccaaatacatcaagttgcattttctatatatccccaaatacatcagaaatcattcacaaaatcacaaaaacatctccaaaatctataacaaaattatccacaaattcatccacacatcacatgtcacacagatcaggaaaaaaaaatccacatcgaacagatcggctgtacacatcgcacatattaaggaaaaaaatccacatcgcacagattttacagatcaggcgccggccgtccgccgcctcgccggcctcccgcccagctgcctcgggctccgccgccgcctggggaacgcgccgcccaccgcctcggcagccggcgcccgcccgctggcgcctccccggcttccctcctcgtgcgacggccccgccgggcgcagcctctgcgcgccagccgccgccctccgcacaccggccgcggccctccgcgtgtcggcggtcgccgccctccgcgcgccggccccgcggacctcggctcgctcgatctgcatgcagcaaagaaaaaaggagatgaggagttgaaggagaggataaggcaaagaaaaagataagagagagtaagaataggagatgaggagttaagaggataagtcctaaggattatatacggtacatcaaattttagtcccggtttgtgataccaaccgggactaaagatcacggtgatctttagtcctggttattaacacaaattgggactaaagatccaaacggaggggcctgacaacccctgacagcatgtgaaccggggctaaagatcacatagccccatcttgcttataaactaggactaaataccatctttagtcccggtttttactgcaaccaggactattgtggtttttggccgatcaggcaaagatggtttcttcagtagtggatgtgataccagaaacaaaagtttatgtgaaggacaaaagtcacaaaacacactttgataatactgttgacagtaggaatcggcaataaaaaaaggtagcacacaagagctaaaataaatgggttgtgagacaaagttttactagataggttcggaccctctct

SEQ ID NO: 1466 - DNA, 1501 bp, Oryza sativa
gaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacct

SEQ ID NO: 1467 - DNA, 1501 bp, Oryza sativa
ctcaattttagatgaattttgcaagttgaatggcccaattcggagttcgaatgaattagatatgaattttagaaattttgagccaattaaatgaatttctagaattattaccgatttattgcacaattattatttaatttttcaaaggaaaaggcacagccgctgacgtcatcaaaggggaagggcgcgccgataggtgggccgcacacgtcagcgggactaggggagggcgcacggtggactcggtccaccgcagcctggcggcaccgtggacccagaccacgggagtggtccacgggcggccaaagtacaggcgcggccgagcggcggcgaacgacgacggcggcgcgcggccggacggcgaccaccggcgacgacaccggcggcgcgggtcggcacgcggagagcggcggaaaaagcggagaggggatgctcaccaagcggaacggcaccgaagggaggcgagatggcggcggcgctcctcggggtggcacggcaatagcggtccagcggtgttccgcgagcgggaaccggcggacggcgatcggaaggatctggggaacatggagggaaagttagggaatagggaggaggcgcaaggcggcgggaaaactcggccggaagccggcgacgagggaaggagctcacctctcacagcggggaaaggatttccggtgacggagagcttggatgaggggatgtcgggctccctatcattgctgcgaagccgacgaaggagagcgtgaggttggaggtcgctcgcggcggcggcgaggtggtggtggcttgggttgacagaggggatggagttccggtgaaggaacagggaaacggagcggagaccgagcttgcccgcgcggtggtgaagccggcagtggaggcggcgcagcacagtggcggcgggagtggcgatggcgcgtggctggaggtgacggcggcggcggagagaggtgttgcgcgaggcggcgatgttccggaggcggagaggggaaatggagtaggggccgggctgcagcacggcgccgcgaagccgacggtggtggcggatttgtgcggcggtgggtggagcagcggtggcgggcggccggagctcgccagaaagtggcggtgcgcgggagcggcgtggggagagcgagggagagagtgccgggctcgggaaagagggggaaatggaagaggagagcacggggagggtttatattggctcgggagggagaaattgtggccggacgtggcggatttgaggcggcaacggctggcgaatattataatagataacatataatataattcataaaattatttaaaagttcaaataatattaataggagcttatgccactgagtttatctcagttcaataatttgtcatcgacactgtctatttctataaaataccggcaagtttatcaattgttctgcatatgttgttaggcaaggtcattgtcagggttacgggttaggtataccctttaccctttgatatacgtcgcatatcggta

SEQ ID NO: 1468 - DNA, 1501 bp, Oryza sativa
tgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgta

SEQ ID NO: 1469 - DNA, 1501 bp, Oryza sativa
gtaaacgtaccgtacttttttttccttcctacttactccctctgtcccaaaatataagcatttttagctataaatctggacaattgtatgttcagattcgtaactaaaagttactatattttaagacggaggtagtagcgatcaatggcataaacgtggcggttttggggatagatttaattggtgacttttaagatatagatctaatggtgataactatgggttcacccgattaaataaaaaccaacgattagatgttttgcttttttaatagaattttaaggatttattagagcgccacgtggcagtttaaaaaagtcattaaatatctaattatggagctcaaacagttaatttaactaaaagaaatacaatggtttaatcttatcataaattggatgttaagtttaaaaggtcatcgttgtaaagacagtttattaaagaacgaacctaagaccaccaatgaacctcatatgtatcaaggtacatgggacatgcatcagaatttcgtccacaaccggttttgcctccatgagagaagtcaaggaattaagttgaccattagatatactaggaatcgtgcacgtgtataaaaaaataagtataaaatgtaaactacatataaaaattaggaagtgtgataaaatgtcataactgcataatttaccaacgtaacagccaaaataattaaaattatctcagtgcaccaataacataaacaaaccaaactttggtagatatatattaaaaaattgagccacatcacagattgaaattagtcaacaagttcagggaatgaactcagaaatgaaccggtacaaccgagaatattaagttcaggtacatcccaggataagatcagaaaatactatagcaaatgttccaaattttgtttctgaattctccttaatccacatgaattgtccttaatacaatccaggataagatcagaaaacaagacctctcttacaagcaataccgcatatattatttgtcaagacaaagccaagtgcataatccacatcaggttatcctctagatgatactccagccatgctccctggtcctccaaaaacaaccaggctcaatagtccaatgcataatgtaaataacagggccggcagaagaatctgaacatggtaatcttaaagcgaccttatataatctgcacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacgaacacaaaatggcattttattcttgcacgaagaccatgtcaaagccttgatatatgcattatgccttcatgatctttaaagtcaatagatacctgcataaagcatcaactaagaaaatacattgtttttgttccaaaaaaactgataaataacaaaaatggcatgataaaagaaa

SEQ ID NO: 1470 - DNA, 1501 bp, Oryza sativa
aagtaaattatatactacatattaagaattttagtacctaagtactccctccgtttcacaatgtaagtcattatagcatttttcatattcatattgatattaatgaatctagacatatatatctatttagatacattaacatcaatataaatgtgagaaatgctagaatggcttacattacgaaagagaggaagtaatgattaaggttgagtaccgaagtacttataggattggccaccccttgtttactgtaagcatgcttaccgaacattgtgtgtgttttggaaatggtttctatataaaagtattctaaaaattaaataaatatacttttaaagttttaatatttaattcttaattaatcataatattcaatgccaatgacctacgttgttttgcacgtcctgataagctcagccaattagctagagcgaatgaagcctaggacataaagcacatcaatactatcaaaagaaaaacacataatatatgaaaaaattagtaatgttatttagttatatcagtatttaacttttgggaatgtttgaatgttatttttatttttggaaatgcaagtctaatttctcaagtgatatacagttatataatctatattttcaatttgtttatattttttatggatgatccgacagcatacagcttgttataatacaactccaaataacatatatttttgcatatgagcttaaattattagttttatttttcatctaatctaagtgagagaagaagaaaagaaaaaaaagacgtggggctgggcgtaaacgtaccgtacttttttttccttcctacttactccctctgtcccaaaatataagcatttttagctataaatctggacaattgtatgttcagattcgtaactaaaagttactatattttaagacggaggtagtagcgatcaatggcataaacgtggcggttttggggatagatttaattggtgacttttaagatatagatctaatggtgataactatgggttcacccgattaaataaaaaccaacgattagatgttttgcttttttaatagaattttaaggatttattagagcgccacgtggcagtttaaaaaagtcattaaatatctaattatggagctcaaacagttaatttaactaaaagaaatacaatggtttaatcttatcataaattggatgttaagtttaaaaggtcatcgttgtaaagacagtttattaaagaacgaacctaagaccaccaatgaacctcatatgtatcaaggtacatgggacatgcatcagaatttcgtccacaaccggttttgcctccatgagagaagtcaaggaattaagttgaccattagatatactaggaatcgtgcacgtgtataaaaaaataagtataaaatgtaaactacatataaaaattaggaagtgtgataaaatgtcataactgcataatttaccaacgtaacagccaaaataattaaaattatctcagtgcaccaataacataaac

SEQ ID NO: 1471 - DNA, 1501 bp, Oryza sativa
tcatggaggacaacatattagcggttatcgatctagagaccgaacctctgccaagcaacaattggtcaccaccaaagctatccatgccaccgagggatggaagagagccaaatgcatgagcgtcacgtcctctccatgcatcctatagcagcatcaccaccttacccagttcatattcgaggatggcataggctccctcgctgttactagccgaaccccaaccccttgtgagtaggagcttggaaccttgctaggttcccatcgactccctactccgccactaggaccttttcactgcctttgaccgcatctcgacaagcatcgttctctgttccagttaaggtgttgaccttcaacactcttgtgaccttaagacaacggctaacttgttgagacctccaatgcatgccattggtaggtgggtcccattgagagagggagagggatttgattggcgaggcacatccttcattatgttagagtaccacatgggaagtcgagaccacttgaaaaggggaggggattaatgtgtacatccccaactatttgatccgcacattaattgcaaattacatcctccatcattgtctagttttgcagttgagggggataaattgtacttttgaaataatttgggggtagaccaaacttaactaaaaaacatagagtcgccacattttaagtaagcttaaaactgggttccgaacactctttaggctgttcggcaatttgggtagggaactaccctctcacgcacgtaaaatggaacaactcattagtgcatgattaattaagtattagtttatcttaaaatgattaatatgattttttttaaaaaaataacttttctatagaatttttttttttaaaaaacacaccgtttagagtttgggaaacatacacgtgcaaaacgggggactagaggaggggagaagcgagaaacaaacgcagctagaggtgttcttcatggatgacttaatggattaggaataattacttataggaatcaattaaaatattactatataatttattttgaacgatttgcacaagacggtgtgaagttatattgatagaacaggaaaaaattacaagattacaatattactatataataaaagctatactaatactagcgtataataattgatttatctaccaacgttgatgtagaaaattcgccaactattacacctatctaaatccaatctaatccatcctatccaaacaaacaaacaaacaataatgccaatcaaacctcacatgcatatgcgaggaatacaagtatacaagatgacaaggaaaccatagttaaaaaaagaaaagagagagagccctactcgcctctctaacacgagcccaatcacgaggagggcgggcaagtgcggcaaccgcatcgcatcacactaaccgcaccaccggcagccggcagtcgagaggatggacagcagcaacggcgagcggccgccgcagggagaggatgcgccggcggcggcggcgg

SEQ ID NO: 1472 - DNA, 1501 bp, Oryza sativa
gttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagatttgggctatctgcctgtgaatattggggagaacagaatgaggcaaaactaaagctcctttttttttatggatttaagccagtggaggcaaacaggagacaccaccaccactcttttttttttttttttgcgatcagtggaagttagtattatgtatagtttctctaaaaatatatatgtttgagattgtgtggtagagcgttcgacgatgtctatgaccatccgtgtttattctgctagtgctatatataggatgtacattatgcatgagaaagaaaagccaaatgaacggtataccttatctcttatatcaattatttctctcgtaatattttttgttacgtacattatgatcgtctccttggatatgaaaaggaccagtgtaaccggctcaaaaacaaattaaagacgaaagagtctatgtaggaatacataatgcatgggtaagggaaacttttttcccccgctatatcatctctagttaatacggagtcgtgtagactgcttgagagacaatcctttgtaactctttcaagtcataaaagtatgttatttttcagaggcaagtataggaatatgcaataatgcatgggctaagggaaactttttttttttctcttgtatcatctctagggaaccggatcctctgatgtaaggaaaccaacgtc

SEQ ID NO: 1473 - DNA, 456 bp, Oryza sativa
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgccccccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagca

SEQ ID NO: 1474 - DNA, 1501 bp, Oryza sativa
acgaaccttcctcaacgaaaacgctctcctccggaacgtcggaaactaaagcgaaagaacaaaataaacaaaacagtaaaaaagaagcataaacagtatatgtggatatttttaacatgtagatctcgattttagatgaatttagcaacttgaaccactcgaatcggagttacgatgatttagttatgaatttccgaagttttaatctatttaatctattaaagaaaaactgaaaaagaggagatgatgacgtcatgatgacgtcatcgacggcagccacggcacgggtggcgacctcgccggagctagggtggtcggccggactaaccaagggcatctacacgtagaggacgacgacgcgatctcaacgatactcaccaacgtgacgaacgacgacggatgacggccggcggcgagcttgtgcggcggtggcgactcggtcgtcggcagcggcgactctccggtgaccggcgacggcgctacggttgacgagagagctcgggagatgggtcaaacgaaagagggcgactagggggtgctatttataggcttggattgaagagatcggctcaggaacggatggatttggtgaaagaagttaggatttatctgagttcacccgaatataaacggccaaaattcgtgagatatataacgaatttgatgggggtttcttcgggattaggtagaggagatagagaggaatccgtttttgcaatcaattttagaaggggatcaacggatgcaccggatttgatggaggaggaggcgacggcagcaggcacaggacggcagctcgggctctgcctggagctggaagacgacactgtagcgagagggaggtagattagactttttgggctgggccggaagggagcaacaaaggacttccaatttaataaattaatcaatgagatgatctttgaattgttaaaaatagttccaacgctcaaatgatttcaagaaaaatcttgaaaatacttggacactcaaagtatttaacaatattaaaatcagatcatttaatgattaatttaatatttaaataattgctgaactgctctttgtatgattaaaattaagagttgagctccaaaaaatccgagaaaattccagagaatataattaaccatggagaatttaataaaaattaaatccatccatgctttacatttaggaaattttatttcccacaattaacttcacttgtaaattaacgaacatttaatataaattctaataataatttattaaataatttataaatcctaagacgaaaatcaggatgtgacaaaccatcaaaaccacatgctcacaacccaccttaaccaggttttaattatcaattaattaacatcacacgattaaccatcgtgagctaccatttaatataaccataattaataatataatataatataatctatatttaacccctttaattagctaatgtttctaagcatggctaagcaaacatacatatagcatttagctgaaccaa

SEQ ID NO: 1475 - DNA, 1501 bp, Oryza sativa
gggattgtgtcttgtgggtacagtggtacacctctgatcaaagtttaatctattcgaatagccgtacccgcggttatgggtgagttgagcaatgtttttcgtgattagtctcatattacacattaaatggtaacggtggtaattaatgtgactcctggtttggaatggtatattcctggtttggaggtttaatttgttcaactggggtaggttgttcaaatgtggttgggcctatgcaacacgggtgtgttgtatggtgtttatttaatattgattaattatacaactattttactattctcttaaatttttattaaatgctgtttatgcaaataagctatattatgccatcctttgttgtcctgtgcacttgcatatttgctgtgtggcttgttgagtatgtcatatgctcattcttgcaatattcaatcatcagaggaggagtatctcagcgaaggtgatgtcctggaggattaagcttgttcttggttaagatgcctgtggagtggagttgccatagctgtttcgtagtttgctttagttttattttccgctgcgtagtatgttattctttgagaggaactatttacctctgtaataatttattatttgcgaatattaaatagttatttatttgtactctattatcaatttattattgtgtgcctcggctgattcctggacgagggtttaacacacatgtaagcgtttggaattttggatagaaattccgggcgtgacatctgacttgatcaatgagagtaggcttcgcatctaaagctgcaacaaagcctctactgacaattcccagattcaatctttcaaattccttgcacaattccaatggcaactgtcatccttccatagcattacaatagcctttcctactaagggcatctgctacgacattagcctttcccgggtgataattgtcacaccctgaagttctcctcccaagcctaaaattttatttataaatgaccctaagaaaatgccggtgcaaagcatgagaaaaccctaagaaagtaatacaaataataatcgaatctggcatgtggaatttttcttgagttctacatgtctaaattcgctaacaagttttttagtggaattttcagagccctagaaataattttaaccaattaaaattgagcaagcaatattttaattccagggaaaatccttttctttctttttctttttctttttccccttcccttttcgaatgggccgccggcccattctctccttttccccctcccagctgggccggccgcaggccgaggcccagccaggccgccccgcctccctcctctcccggggtcgccgacaggtggggcccacctgtcgggtccttccccaacctccggccgcccctccacgtcaccgccgccgccgaaaccgccgccccgcctcctccgggccacttcggccacgccgcgcgtgcccccgccttccccgctcccacccctctctctcccgcccgcgccctcaaccgaga

SEQ ID NO: 1476 - DNA, 1501 bp, Oryza sativa
tggcaagaagaaagaagaataccttctgttctttcaaaacaaactcgatctacttataaggaggcagaatatgttctgctctcaaaccaatatttttattattaatttcgtttgaaagtgagcactgtttggtgatatgttgtatataaacgggcagcacatgcaattgttgatgttatgctcttttcaaattgattttctgctcctaactaactgatgttctgttctttttggaattgattttctgctcctggccgacagaagatatatactagccggcaaatgaaaaaacaggctaaaaatatggtagaagctaatctgcataacataaatatgtatacgcatgcaacagaagctaatctccctgttcctataattatgaatatgtaacggaatagtttctgttccttcaaaaacaattcaatctactattagagcaaaaggccccagcagaaacaagagcagaacatttttgttctggtccccatatcaagttctgcttgtgtaattgaataccagcatggatacgttctgctcctccagaacttcaaaatgcagaacctagaaaatgggcagaatgtgaaccgggagcagaaactagaaaactgcatgttctgcttcattcaaaaagaatatcttcttcccatccatgaaaggtagcagaatatgtgctgcctttttttattattctttgaataggtatatatagagagaaagaacagaacatcttctgctcaatttaattatcttgttcacaaggctatagttggacagtacgtaattaccacacgcagtgtgccagcagaacatcatctgttcattttagttgtgggtgatgatatgctatagatgcgaaatacatgcgtggacgagcagatcatatatatatgcggccgtcaggcagataatgcaaacatctgacgtgcataatgcattcaaaagtttgtatcccacgaaaatagcgatcggcatattttaacgggttaattaacccgctaatgacaaattcgaattagcagaaagctgcacaaatcttgaaagcacgtatagcagatgatgcaggagtagctactcccggtagtaggatataatatatatatatatatatatatatatatatatatatatatatatatatatatatatatatatatataatgattctatactcccaggagtaggtactcccggttccatccaccgtccatcagcgaacaccaccgatcaaatcagcaagcggatccatataccgagcccgttttgatttctagttacgaaaaaaatcctcataatctgaattattccgtactaaccagaacccttttgaatagctcgtattaaaatctcgtgggtggttgtaaacagaatcgatagatcgatccgcaggttatcgcgatcggcgattcgaaggcgacgacggcgcgacccatcggctattcgaaggtcacggcgtctgctgatgtctacgccggcgtcttccattaccaatgccttcagtatg

SEQ ID NO: 1477 - DNA, 1501 bp, Oryza sativa
ctatgcctacctctcaccatttatgctatgtctaagctagacgattttgttatggccatacctactcttaaatttttttatgtcggccttgactcagccgccccaatagaagcgacaaaactgctgttgttgcaagagttggattccttcaagaaagtgatagatgaatctgaggcatcaagggagcagtaatcaaagaaaattgaaagtttgattggcctaaatgctccatattttgctctgaaattttgatagttatgttaccaatcatgtatcattgtcattttcatagccttcatcatggcgttgcgaatattatgaatataccaatggatcaacctgcacgccctaagtgtgcgcattcttaaaaaatgctgaagtgtgatgcatgcatatgtacatattgctcctcccaaatggacatcatgcaggatcgggacttgacaacacattaaaggctctcatgctacacgcttcttgcactgtagttaaacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactggatataagattttttctttgtttctcaattctttcggtcaataacgagcatgtgtgttattcatagaaacggaggtaggtagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcgtctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaat

SEQ ID NO: 1478 - DNA, 1501 bp, Oryza sativa
tagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagctagccatggtactaactcgtctactacgccatagtatgctacaaacacaactaagttatcttatgaaggactactcaatagtacacataaaacaatgttactcgttgccttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcagaaaaaaaacgtgtctaaggtcagaaaaaaaagtacgaaaaggagaaaaaaagagctcggggaggggatagccggcatgcgcgccagctaaattgatttagctggcgcgtacacgcccattagcaatccccggtagccatttgcactatatccataatatacaagtaggcagccattcgcaccttatccataccaggacgatccatttgcaccttatccacattatcacataatgcttctgcctataaatagtagcagcaccttacattcaagaat

SEQ ID NO: 1479 - DNA, 1501 bp, Oryza sativa
aatacttggataagtttgttgtggttttcattgatgacattctgatatactcacaatccgaggaagaccatcagcaccatctccgtctggtgttgggaaagttacgggaacatcaattgtatgccaaacttagcaagtgtgagttctggttgtccgaagtcaaattcttagggcacgtgatatctgctaaaggagttgcggtggaccccgaaacagtgaccgccgtcactgattggaagcaacccaagacagtcactcaagtccgcagtttcttaggtttggcaggatactaccgaaggtttatcgagaacttctccaaaatcgctcgacccatgacacagttgttgaagaaagaagagaaatttgtgtggagcccgcaatgcgagaaggcgttcaaaaccctcaaagaaaagctggtttcctcaccagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagcttgaaatacatcttcacccaatcggatctgaatcttcggcaaaggagatggttagaactcatcaaggattatgatgtgggaatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggttataattattaagtaacaaaaaccattatcaaagtttattaaaaagaacaacctaaaaataaatcctcttcctcctttgggccaagcccagcccaaagtctccctctcctccctctctttctctcttctccttctctccctcctcctcttgggcctcctcccctcccggcccactccctcctccctctctctcccgggctccctcgccctcctctcctcccgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtgaggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttgga

SEQ ID NO: 1480 - DNA, 973 bp, Oryza sativa
cgatttttggcggttctcgtaggccaattagagatgcaaggaatcggggacttaatctaattaattaatgaaatggcaggacagtagtagacccttaatcccggccctctggccaattattcattgataattttgataatgacacaatcgctaaaatttaactttgtccttatcgagtgtcctgatcatagtattatggaagtgttttagacaaatctactagcaccattatatttttcacatatttccatctttacatgcatgctcgtgtatatatatataccacaaattaaaatgaatatttgcttgtggttaattagcacctcaactctcatggttcattttctctcttgataaaaattggggataaattaaccgatattttccataccaaaattaagctaatatcgtcaacaatttttaaaatgaaaaaaaaatcgtcaaatattgcgaatatatcaatggatcaacttgcatgccctaattatgagcattcttaaaactccaaggaaaaaaaagacaaaaaagctgaagtgtgatgaatgcatatgtacatattgctcctcccaaatggccgggagtattaatttagaaccgaaagaaatcatttttgtctatctcgcatttttcatgtaaatccagtgtgcgatttcagttggtgaattgaacttggtcatcaggagcacctttccaaaaagtttcatctttgttcagactctaaaaaaactactccctccgtttcacaatgtaagtcattctagcatttcccatattcatattaatgctaatgaatttaaacatatatatctatctagattcattaggaacattataaatgtgagaaatgctagaatgacttacattgtgaaacggaggaagtagttggcaagtgaagttctttagtttcactactacgaaaaggattattcctaatgcatctagatccgaccacatgaatcagcatgatccatga

SEQ ID NO: 1481 - DNA, 1501 bp, Oryza sativa
tctgcgtagaatttatcgaagaccttcgcccaatcggggtgcctgaatcacgccatgaagggaaactacggggaaaggggactctcagaaggaacgcagtaatgacggtatacaacaatttattccgtaaagcccatttcacggttctgcaataatcttcattggtggctccttacatcgaggagcacttggctctagttcccgccagaaacatcggtaagtccgatgcatggattacacggcatcacattgataaattgcccgtgtggctgcgacaacatctcatgggtaacgagacgattagccaacaacttgcctacctggcgaggggaccatctggctcgatagcgacattccaaggatatgagatcaatgggtacacattctacacgagagaccaaaacataaagagcacgaaccagaacagtgctgctcgtatcgatgccatgggacacgatggtacaacttgcacgtattacggtgctatcgaggacatatgggaacttgtctatggacctctcaaggttcctctgttccggtgccaatgagttaggttgattggtggaggcgtaacgattgatgacagtgggatgacaacggttgaccttaacaaggttcgatactcggacgaaccttttgtccttgccaatgatgtaatgcaagttttttatgtgaaggacatgtctagcaaaggaaagaagggcaaagggcctgatgagccgaagtgccacgtggttctccctagcaaaagaaaaatcatcggagttgaggacaagactgacgaggattatgatcagtttgatgggcaaccccctttcacggtgacggttgaccctagcatcctcctatcaaacgaagacaccctttactcacgtagcgaacacaaggaaggaacaatagtgaggaggaagtacgtgcggtcaaccgtcaccgccgatgtattgccgtaattgttgtgtacacaatgtaaaatattttggatgtattgaatatccatataaatcaattgttgtacggcatatgttaattatgtatgattattagaatttttaaaattttaaatcatgtatatgctagttatatatgataattagaatttttaaaagttttaaatcatgcatatgcttattatatatgattattagaatttttaacaattttaaatcattcatgtggtatttacatatgattattagaatttttaacaattttaaatcatgcatgtggtatttacatatgattattagaatttttaacaattttaaatcatgcatgtggtatttacatatgattattagaatttttaacaattttaaattttgcatatgctagttatatatgattattagaatttttaacaattttaaatcatgcatgtggtatttacatatgataattagaatttttaacaattttaaatcatgcatatgctaattatatatgattactagttacagttaatataagtgtatattaaatctcttgtcctttctcatatagt

SEQ ID NO: 1482 - DNA, 285 bp, Oryza sativa
tcgctctatatatatcgctcatatatatatatggaatacatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagtacaattcatttgctcactagc

SEQ ID NO: 1483 - DNA, 1501 bp, Oryza sativa
tagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggtctcacatggcatgcaagctagccatggtactaactcgtctactacgccatagtatgctacaaacacaactaagttatcttatgaaggactactcaatagtacacataaaacaatgttactcgttgctttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaat

SEQ ID NO: 1484 - DNA, 1501 bp, Oryza sativa
actacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtgttactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatcatggcgttactgtatgtgtgcagtaacaactataacttttaaagtaacactgcatgttactgcaatttcttaatagcattactgcaataagaggtggtaacaaccaaacacaggtacaggacctatcacccactttgaactagtaaaatgtaaatgcaagtgatatcttttgaattcacatctttaaacaataatatctctcacaccacatattatatttttgaaccgtttgcaccgtaatgctttaaaaaaaaagctctacaaaactagatccgtcatgactatattttaactatattttattagtattactgcaagtaaggtacagtgttactgcatagtggtcgtcatgttactgcaccgttcgtacgagacaaggacaacaaataggtggatgtgggaggaagttagcacacgggtttgaccgacatggcagcgatttgaccgtcctttgaccatgctttgactggggtaggaggtgggttttgagcccaataaaaggagggggtagtgggttgggctcttgagggggagggggggtatagaatagtctcaccatatatatatatatataatgattctatactcccaggagtaggtactcccggttccatccaccgtccatcagcgaacaccaccgaccaagtcagcaagcggatccagataccgagcccgttttgatttttagttacgaaaaaaatcctcataatctgaattattccgtaataaccggaacccttttgaatagctcgtattaaaatctcatgggtggttgtaaacagaatcgatagatcgatccgcaggttatctcgatcagcgattcgaaggcgacggcggcgcgacccatcggctattcgaaggtcgtggcatctgctgatgtctacgccggcgtcttccattaccaatgccttcggtatgactatccgcaggcgactggctg

SEQ ID NO: 1485 - DNA, 1501 bp, Oryza sativa
gtgttcttcgattggcaaacagggattagccttctcggcgaggtcatccgtattttgacacgggtgataacctgaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgattagttttttttttcgcaattatcctagagtctacagaaaagccaaaaaaaaattagttgttagttaccttaacctagaccgtgtttagcctttgcatgattctctctcagagtccgtagtgttgagtttgagtcctagtttaagttcatgttgctggtctagtgtgtgttttagtctagtcatgtgtttgtcctttgtaaccctagccgctacctttcaccgtgtgttaggcttcatcctttgagagccgtttccgccatcataaacacccatccagataaccaagcatctccagaacaccctacaactccgctgccaccatatcccaattccaccgcaaaatagactaggttatatcccctctggaaaacctagccggaagccgaaacttcaaacagccataacttttgcatacggactcggaatcaggaaaaatttaacttttcggataagagaaaaaattttatatccgtttatccccgcctttggctggtttggcgaatccaaaattccaaaaattggcttgcaaaattgtctgttcgagctcacaagttcctgcaccttgtttatagtggtttcagaaaaatccataggccacatacctactccaattgagctttaacttggaggtgtgcctatttttgtgttctaaaaaaagaaaaaaaatatcaaaaaaataaaagaaaaaaaagaaaagttgatttccactagtgctttgagctcacgacgcgctccgttgagcttatctgccagttcggttttgtagtttttgctgaaactcgctgaagcttgcctgtcagtccttctttgctgtttactagtgtcatattctttgagccatctttgttatcactactgtctaggacacgagtagaccagcaactaagggcaagtgacttgggatttttattcagcattactatctgtcattggattgtgtaccactcataaacatatttttggccttcctagctccacatattacttctgaacagcacaggttcttgatcactgcaattgctgactacgccttccaggtatcctttgctttgctggtaagaaccttataagaccatggttaggaactccatattgctgagaatcgttgagaggcaccactacacctgcgtagtagattattagggataaccttcaccgttttgtttctgttttggtgtttcaatgtcaggtaacgaaggcgagaagagtccccaggattttgctgactgtgtcagc

SEQ ID NO: 1486 - DNA, 1501 bp, Oryza sativa
tcgcgacataatgaatgcatgaaatagtaatttcatgttttagggtaagccctaaaccctatacaaaaaggtccccgggcattaggggaattgcttttaggtccataagcccacatggcaaacaaagcaattttacaaaaagaaccttacaagatttcaatttcaactaattaaagtccttagcacctaatgaagtggctaaacagccgggcccacatgtcggtgactcggcggcaagagaagcagaggcagcaggagagcaacggcgaccgacagcgttcgtggcggcgtattggcttgatcatatgtgggcgtcgttctcctgggaccaaggcgacgtcagtggcgcaatggtacagctggagatgattcgagtcgactggaatggcaaagtggggcgatggtggcactctggacaccgggaacaccgacgagcgcaccagcaagtgttcgatctatgccaaaaaagaaacaaagaaaatggatcgatcaagcagagaaggaacttcatgaatcactactacagaaacgattttcctggacagggaccttttagattccgtgcgggcggtatctcgttgcttctgggaaaaccagctcattttcgcgtgcggtccattaaagaggacggcacggaaaaatcaatttttccgtgcggtaactcatttcttctgggaaaaatcgatttttccgtgcggtcctcttaaatggacagcacgcgaaaataagccgattttcccgtgcggacctattaagagagccgcatgcaaaaaatactaactccctctttcctctctaacccactttaaaatttcccctctttctctcctctcccctcccctctatccctttttccactttaaaatttccacgcagagcttctcctctcagtcctttctctctcacgcctctcctctcctctctccactctcctctcctctcctcccgacggtggcagcggcggcggcgcgcggcgacagcagcggcgcggtggcggtgggagtaggagcgcgccggcctcctccatgtggcggcggtggagggcgtggattcggcgggcggcggtagtccctacacggatccagcggctgtggccgtcaacgcaagaatcctgcggtggcagccgtccccgcacggatccggcagccagcctccttctccccacgtgggatccagctcccctcctctccccttccttccctccctagatccggcggaggggaggggcgacggcggcgttgtggccggaggggagcttggatccgatggcgggtggcggggaggccggcgggaggcaggtggcactatggccgtcgggcggaagcccaccgccggattctagggtttcgtttttttaaaaaaatatgttatttcgaatttttgttttcccgtgggggtgcgccacccgcacgcaaaaatcattattttcccagacccctaggtgcgtgcaggccgcctacccgctcgcaaaaatcgttacaaaaatcttgcttgtagtagt

SEQ ID NO: 1487 - DNA, 1501 bp, Oryza sativa
tatacattcacaagttcttcacttcatgacttcttcccagtgctggtaaaacctttatactactagctagtctacaagataacaagacagaagggaagattgtaagccgccatgaaggggttgcatattaaaatgccatttcacttcatatagagcacacagttgcttggcaacatgcatgcctgtgcagaaggagcatgtgctgatatgcacacctggagcagaaaagagggatgggactacggaagcacaagcatgcatgcaagaaacgacagggataaaatagtttcatagtataaaactagtaaaaaacaaaacaaactaatccctccaactccatgtctccatgcatgctgggcagtgcatcttggcatgtggcgacggtcgccggcgtcgtggtggccgacaggccgccatccggtccaacggcccagcaatgacttacaagaccaaagagggcatgggcccacaagaccgtcacgcacgcatgctacggcactggatgatggaccaacaaggtgatcgctgtcgtcgcctgcaccaacaccaagttgaatccgaatccactgcaatttttggaggctgtgcgctcatccagtcaccctgagcatagatgacaaaaacgaacacaccaaaagaaaaacaaatatgggcccaaacatcatggaatatattcacattgtcatggaatatggaattcttgtacaagatacaggggaatgacactttttttcaccaactatcaacttattctgccgtagtactgtaacatgaacctaaaacacagtgtctgccaactgccattgacggaggtaccaactaacattttactcgatctctcccttttgtcaggtcttggtgcttcatcatctcctagagaacttggacacgaggtacactagaaagaagcagacgagagcgaagaggattacatgaaaaagatggttcgaaccattctgtatgattttcttgtttattctcctcatgttattcttgacgcctgcctgggcctttgtcagagtcatttgctgcaaacaagtgcaatatgcacattagagaccgagcacaaagcgtatttcaagttttcaacacaaactagtgtacatcttattgcagattctagtctacacatgttctcgacaaacagagaaaggaatatgccagacaagtaattttggatgatctagggcattttatagagtaaagcctcatttcgatggaccttaatctgggtccatcaaattcctggcctataggtgtgctaacatggaaacttctcatgtatatgtggcctagtccccttttctttttccaaaaactatcgaccaacaagatgacaatggagagaagatcagaatgtgattccatttaggcacgaacatcctgctaagccctgatgaatcccctaatgattttggtaaaaatcattaagttaaggtggatacacatcttgtcatatgatcaaatggtttcgcgaaaaatcaataatcagacaacaaga

SEQ ID NO: 1488 - DNA, 1501 bp, Oryza sativa
tttcttcctcctctctcccatctctctttctctctctcgcctttccctcctgagctcctcatgcatggctgcacgatgccgtcgacggcaccaccaccatcgtggtccaccgcgacaagccaccgccgccagcgccgccgctctcgcacccgcttgccgcacatggtcgaagaggtcatcggtgacgatcggcggcgcagtggcgccggccatggcgcagtctattgggaggaggaagcaagcgaggggcggatctggcctctgggtccgcaactccagcggccgcccgctcgccgatgccgctccgtccatcgcctgccaccgttgccgacgccgatccagacgccgctccacacgcacgaagagaaagagggagagatagagaagggaggagagggaggaagaagaaaggataaatagaggatgacatgtgggacgcacatgtcagtgggtcccataatttttttttgtgtgaatggctcccgcatatttttaaaaatttaatgctacataagcgccacgtcaatgccgcgtggtacgaagaccaggtcaacattgtcacgtgtgcgccacgtcagtgaaaccgccctccaaaatcatcaagggagtcaaattgtatcggtttagacagttcggaggtcaagatttctagtattgcggataaggtatacgatttagattccgtgttcatttcagggagtcaaactgtacttattccatatttccaagcctaactgaaacagaatcagcccattatgaagcccataaaacaggtaacaaattcagtgcgctattgttccaactgatgtctgcttttctttcttttcagattcatgccagccatattcacattaactcaaggattcaatgtcaatgactagcattctttttacaagcatgcctatttgttacttttgctaattgtgcagcagcagtgacgaaacaacgcgaagaggttattctaattgatctagcgtacgtaacttacgtgacatatagacaaagaattgatccaaggcaaccaccacatgtccacgtgattgatgattcataatagtaaacaactgcgcattattgttcggttaaaagttgactgctacaaatttcatatgaccacgtcaagctttataaaattataaaaagaaaactttcggcgacgacctcagtggtggttgcaaatatcggaattagattcagtttgtacaagttgtaaaaaaaagaagatttgagttcgtacacatacaaagtcgttagtccacatgagtcatcaaaactcacaaaatacacagtttcaaagcttgttcctagaaccgacaagtagaatgaactggtcataataatgcatccctaatctatttttttaactaaatgcatccctaatccaagcatggcgctgatgaatcccctaatgattttggtaaaaatcattaagttaaggtggatacacatcttgtcatatgatcaaatggtttcgcgaaaaatcaataatcagacaacaaga

SEQ ID NO: 1489 - DNA, 1501 bp, Oryza sativa
taatatatttatctaaaaatttggtttaatttgaagtaatttgactttgacttaaatcaaaacgatttataatctaaaatggagggagtattaaatttaatgtgccaagatttagcattagtgccttaatctttgttacgttgtgtaatttcctacgtcggactcaggatgatcccatctcacagattttatgcgccaatcagctgtaaaataatcacactacacaaatttgtactacttgtagtacacctaaacatattcctttagagaagtgacatatcatagccgattctttgcaaactcagtgaagcttctttccaaggaaagcgacgggtgatacagacaagtagacatacttgtacaagagggtaatcgtaaatttgatgccgattgaaacatacaagacagtagatcaagccagatcacctttgtaggcggatgaaagccacatgcatgcaaacactgtagtgaaagacgatcacaagcagaattctccaattacgagtccaacaatcaagcagaaatgtacgaaatatatgtgaacagtaaaaatcaacggacgcagtgagtaatcagaaaattcagatcgactcatggctgcacaagatgacctgtacgtgtcgcttgtttgccacgccccctccgatcaccgtgcagcgcagaatgccagaatctctcgatctgagcaaccggcccgccgttccaattcgcgcctgtgcgacgtacgcctctcccgaccgggtgcgcgcgccgcgccgcgcgttcttcgccaagttgccacccctcttgcaggccgcgttaccgcatcaaacaagccgcgccacccgatcgatcgcccgcgcgcccgcgtgccgagccccgtccccacggctccgcagcaagcaagcagatcgcgccccgcccgcgtgcgtgcccgtgcccccgcgcgcgcgcgtcatcttgctttgcttccgctctccgtgtaaatcattgcgttttcccttcccgtccccctcgcgcaaaaggccgcctcgcccctcgcgcgtagcgtacgtggcccccctccccccgcgcgcaatgcatgcgtgcaccactgcaacttgccccgcaccgcgcgcgcgcgcgcctctctcggccacacacctcgcgcgtccccttataaaaacggcggcgcccctcgcgtcgctgggcaactcactctttaattcgcctccccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctacgggtgcggaagggactcgccggcgtacgggatgccgtggtgcgacgtcctggctgctgccggcggcggcggcggcttcggtgagttttacggagtggacgagtgggatgaccagctgcaggtcgcctccgtggatgagtgggaggtggcatccaaggataactcggatgcttccacggagg

SEQ ID NO: 1490 - DNA, 1479 bp, Oryza sativa
aagataatgtgccaagtgatattttatcggtgcactgaatgatatttcattgaaacctcacaaatagtatatcatattttatgtttcctcttaccgcactatcaattggttttccattatggattttgagggagccatcagctgactcatgccgtggatatttcagctgaaccttttgcacttgcgtgccatatgtcggtctgtttgtgactaggaattgtcatggatttgtactgcccacctggatttatctttgtgattgatcgatagtagtagtgtttaaattcacatgttcagttctgcatgggtcgtgatcattttcagatccagccacgtatcgccctagcgttggtatatagctttccaattccgtcacacacacatggcaatcactccttaatgaacttttttaagtacaaaagcaaacatcagaaggttcatggccccagatcacagtatctcacacacacaggagggcaatcacagcagcaacacgggaccgtacgaccacagaatccatcaccgcactggctggaccacgggccgaagcaaagagtgaagtgaaaagcggcagaagagcacagaagcaagcaaagcaaagcaatcttaatctatggaataatcggcaactgcaaccatagctagctccatgggaataaaaatatgtgttcccaaaggggacgacgcgacgagaggaggaggttggcgtacgtaaagacaagtcccaagagattacgaggtgggtgggggtttagagcagtaggctataagccagctataaatatattttaaagagataaacaaagagatagaaaagcacagtacgaaatcgaagacataatgtatgtataatatatgtgaccagatattaatagtatagtatacaactattgtataaattgactataaataatttgaagctaatagtggtctatactattaaacttgctcttagtggctatgtgaagccgtaatcttgcgcgctttgtttaaactccggtcgctttctagctttttaaatatggagagcacgcacggggagttgctttgaccgaaaagctcgtctttgaccgggcaagggcaggactgtcaatgcacactgagtatgctgcctgcgttcgtgcgtgatctactggatcccgattctgctcggggacaaagtgtgtagtttgatcatcattgagataagattggattaattagcgtgtgtttctggtctaattggtgtagtggtagacgtttagtagcgtcgaagatattatttttcaatgacgaaaactcgcgtcagacaagactcttcgtcatcagttaccgagtgttacgtgcataagagcaagtttaatagtacagtcaactactaactttaatttatttatagtcaatctaatagcttatttatataatagttatatactacactattaatatctggtcccacctgttatacacatccggtgtcttagagtccgtgctacaact

SEQ ID NO: 1491 - DNA, 1501 bp, Oryza sativa
gagagagagtcgaagagagggagatggggagagagagaggaggaagaagagatggctgagaatgacatgtggggcccatgtgggtcttaccattttttttattaatttctatgtaaacctgacatgtgggtcctaggaggtttattattttttggaattgaattgccacgtaagcgccacgtcaatgccacatcagatgaagaccaagtcaaattagccacgtaggcgtcatgtcagtcaaaaccgccgttaaaaccgccgagggatctcatctgcactggttttgacagttgagggacgtgttgtatctggttttccggttgaaggacgaaaatcggattcgttgacaagttaaggaatatatgatgaacttatttcttttgccgttcggttcgattgattgggtcaggcccatcatctgggcttatggataggccgcgttggcgttggcgtacgtacttccggcccatcaccgaatcgatctcatgcacggctgggccatatccatccattaagtagccccgacactgatatatcgatcaatcttgaggcatttgtaaatttaccactatttttttaattttgtaaagagattattcgaattacagttccagtgtcatttcataattttctctagtggtagtcttataataataatttaaagcagtggcaaatttataattgttctcatcgatctcttgatctctcgagtttatcctgagaacatgtcctacttgtgagttgtgactgagtcaaatactcaaatcccattttagacggataaacaacacgaaatatcacatcttatagcaggtacagtaacaggctataaatcagctgtaaacatattttaaacagataaatgaggagagagaagagtagcgggctatagatttatagccagttgtagcacggactctaagacaccggatgtgtataacaggtgggaccagatattaatagtgtagtatataactattatataaataagctattagattgactataaataaattaaagttagtagttgactgtactattaaacttgctcttatgcacgtaacactcggtaactgatgacgaagagtcttgtctgacgcgagttttcgtcattgaaaaataatatcttcgacgctactaaacgtctaccactacaccaattagaccagaaacacacgctaattaatccaatcttatctcaatgatgatcaaactacacactttgtccccgagcagaatcgggatccagtagatcacgcacgaacgcaggcagcatactcagtgtgcattgacagtcctgcccttgcccggtcaaagacgagcttttcggtcaaagcaactccccgtgcgtgctctccatatttaaaaagctagaaagcgaccggagtttaaacaaagcgcgcaagattacggcttcacatagccactaagagcaagtttaatagtatagaccactattagcttcaaattatttatagtcaatttatacaatagttgtata

SEQ ID NO: 1492 - DNA, 1501 bp, Oryza sativa
tgacttactcttattttacactactttgttagggaaaatgagttgttttattcatcagggtgacaacaattttgtctaaacttccattggagctttattcggtggtagcaatccgttgcttacataatacgagtaactagcatttaggatcagatcacattacccgatgtcaaaattaagggggtacctgggcatttaccttactaccatgatttactagggtatgccaaaaccaaatccgccagggtaaggacaggttagaaacataggttgagatcagcatcaacatgtgcatgtagtcgtatattgccaatggcattataggggtggggcaaggatagagatggaggttgaaaatatccacatgtgtatatacctgtagtttggcggtattatatgaacaggatagatggaggttgaatgcatctatacgtgcatgtactaccaaattctagaaaactggaacacacaaggcgatcatcactttggccgtacatataagaaaagaatagagagacatggaggttgaatgcatctatatgtgtatgtactaccaaattttagaaaagtggaacaagaaaatgcgatcatccatatgtcagatatagcatttgaacacgggtgtggacaacttccaccgcaaagatcctggctagctgacctacactatatctcccaaaaataaggcctgagtttagttacaaattttttcttcaaactttcaacttttccatcacatcaaaacttttctacacacataaacttctaactttttcatcacattgttttaatttcaaccaaacttttaattttaacgtgaactaaatacaacctaaaaagaagaaaggttagcataaaagtccgagaaaacgacgtgagtgaacaggttgctaaacagtagtggtttgtatggagtgttttgatttctacttttatttggaagatgcatgagttctactactacctccattttttactatatgacatcattaactttttaatcaatatttaaacatttatcttatttaaaattattgtggaaatataaaataaattaagtcatacttgaaaaacatttgataataaatcaagttacaataaaataaataatatttatgtatttttaataaaacaaataattaaacgtataaaaaaattaacagcgttatatattagaaaacggagggagtactgtttcattaagcggaatagagagttttttttttgaaaacaacaaggtcctaatcaggaccagttcaccatgtggaggccaggcaaagcaaaagctagcggactccactacagagttttattcatgttttgttttctatcgcatgtattgactaaggataggaaatcaaacctaccacatatgggtgaaatcgattattcgttccatcatgattggggtaggttagttagggatctatttatagccacagaacattgccctggagaatacactgctgcagtgctgcttaagctcgccatccagccgcaa

SEQ ID NO: 1493 - DNA, 1501 bp, Oryza sativa
acgtgcccgtgaaaccgcgagagtcagctctgataccactttgtaacgtcccgcctctcctaggccgggcccgcttacatctgatagctttcataggtcatagactgccctcacagaccaacacatgtcttttctgcacactttgtcctcactcgtgcgcacccgggaaattcaccaaggacgcttaacctcagagttctttcgagactggcttccggaaaagaagttgcaacttgttgatatgagtattctattaattctattaagccctgggccgggatgccacagctgtggccgagcagcaatcttctcggcgagattcagggaaaaaggagggaggtcggagaggcggctatggccgagcagcgcttgcgcctgcttctgctccgattggggaggagggaggtcggagaaggtcaaggcggcgatcttctcggcgaaggcggcggcgctgctcggtgtgtgcgcgtgctcccgtggagacgacaaggataggggtgggctgcggtggtggagcgggatggcggcgggatggaggagcaagggagtagacaataaggacgacgacgacctcctcggtttttcacccgttcgcttgtggcgaggtgcggcggagtgggtgggaggagaaaaatcgaagggtaggtgaggaattgattttcctccgctcccccgtgcgttgtgggccttcaacagtatctccatccatttatctatttagatcacccaaattaggttccttgcactgtgggattgagtgtttgtgccaactttttaggctaacaagtaacacccctctaccggtgcatgctagaggtggccaaatgggccgggccaaacgggcggcccgaggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaa

SEQ ID NO: 1494 - DNA, 1501 bp, Oryza sativa
tagttccaaaatttttctttaaacttccaacattttcatcacattaaacttacaattttagcgtgaagtaaacacacccttactacgcatatcattttaatttcaactaaacttataattttagcgtgaagtaaacacacccttactaggcatatgcaacaaagccgcttcacgtgcattctgaacaagcgaaagctgttgtctcactcacatgtcacggcatcggacatcggtaaagcaaagggaaaaaaagctatctagactatcatgcatgtgacagccactcttgtaggttggcccgatcagatcggcagtaatagtttacgcgtgagcgatacagataatataagaaaatggaaaaaaattgcacaatactccatgtatggtaataataaatgaaagaatatattccatcgataatcatctcatcaaacatgacaagtgtaaacatctgaatatcagtgtctcgctgtctgtaaatagaacagaatcacaaaaaagaatctcgccgtataaacaacgcgtcgatcaaatcatccatccatccatctagaacacgatggcggcggcgaccgcgccggcgacggcaacgaagctggcggtggcggtgtacgtggaggaggcagcgggggcgccggtcggggcggagacggaggagggggtgaccgcggacggggtgacggcggagggggcattggcggcgggggcgtcagtgggcggggccggtggagacgccatgggggacggcgacgcggcggtgggcggggtggcgaccggcgcgggggcggtggccggggacctcgccgggggagcgggcagcggggccatcttgggcgccgggacgggggccgctcccggggcctgcgcggcggccgtgaccgcgaggagggcgacgatggcggcgactacggcgaagcgagccatggttttccggcttggaaacgtgagttttcaagtgcgtggaaaccgcgaagctgtgagctagagtgtgagaagatgccgatgaactgtgtggcgaaaacaatgggagggtccaggtttttatagccgaaaggctagtataccaccatgtcggttaagcaacagctgtagcctattgaagtcgtgacgaagtcgcaacggcaacggtcgccgacacgtgggggccacgtcgagtgggaccaacacgtcagtgggttgggtccggctggcaccgaccaccttcgtcgcgagagcggcgccggctatgttgacccttcgtgcagcggcaccgcgtcgccgggagggagaagcggttgttttaccaggtaatcatccaacgactagttccaagatggacaggtggacgagtgcctcgccgtcggattgtccatggacgtgtgtgatggatcacgataaaatgcggccctcgggcgacgtgctgggccgtccggctactagccgttgcggaggtcggttttggagttgtttacaacgggcgagacgtggtgctaatatgctatttttaatcttaccaaaatag

SEQ ID NO: 1495 - DNA, 1501 bp, Oryza sativa; identical to SEQ ID NO: 1489

SEQ ID NO: 1496 - DNA, 1501 bp, Oryza sativa
tccttccgaagctgtctccgcctgaaccggtacctcctcaacgacagccgtatgaaccggtacctcctccacagatggtggagttggagccgatccggaggtaccatcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgcctcgggccgcccgtttggcccggcccatttggccacctctagcatgcaccggtagaggggtgttacttgttagcctaaaaagttggcacaaacactcaatcccacagtgcaaggaacctaatttgggtgatctaaatagataaatggatggagatactgttgaaggcccacaacgcacgggggagcggaggaaaatcaattcctcacctacccttcgatttttctcctcccacccactccgccgcacctcgccacaagcgaacgggtgaaaaaccgaggaggtcgtcgtcgtccttattgtctactcccttgctcctccatcccgccgccatcccgctccaccaccgcagcccacccctatccttgtcgtctccacgggagcacgcgcacacaccgagcagcgccgccgccttcgccgagaagatcgccgccttgaccttctccgacctccctcctccccaatcggagcagaagcaggcgcaagcgctgctcggccatagccgcctctccgacctccctcctttttccctgaatctcgccgagaagattgctgctcggccacagctgtggcatcccggcccagggcttaatagaattaatagaatactcatatcaacaagttgcaacttcttttccggaagccagtctcgaaagaactctgaggttaagc

SEQ ID NO: 1497 - DNA, 1501 bp, Oryza sativa
cgttggatgattacctggtaaaacaaccgcttctccctcccggcgacgcggtgccgctgcacgaagggtcaacatagccggcgccgctctcgcgacgaaggtggtcggtgccagccggacccaacccactgacgtgttggtcccactcgacgtggcccccacgtgtcggcgaccgttgccgttgcgacttcgtcacgacttcaataggctacagctgttgcttaaccgacatggtggtatactagcctttcggctataaaaacctggaccctcccattgttttcgccacacagttcatcggcatcttctcacactctagctcacagcttcgcggtttccacgcacttgaaaactcacgtttccaagccggaaaaccatggctcgcttcgccgtagtcgccgccatcgtcgccctcctcgcggtcacggccgccgcgcaggccccgggagcggcccccgtcccggcgcccaagatggccccgctgcccgctcccccggcgaggtccccggccaccgcccccgcgccggtcgccaccccgcccaccgccgcgtcgccgtcccccatggcgtctccaccggccccgcccactgacgcccccgccgccaatgccccctccgccgtcaccccgtccgcggtcaccccctcctccgtctccgccccgaccggcgcccccgctgcctcctccacgtacaccgccaccgccagcttcgttgccgtcgccggcgcggtcgccgccgccatcgtgttctagatggatggatggatgatttgatcgacgcgttgtttatacggcgagattcttttttgtgattctgttctatttacagacagcgagacactgatattcagatgtttacacttgtcatgtttgatgagatgattatcgatggaatatattctttcatttattattaccatacatggagtattgtgcaatttttttccattttcttatattatctgtatcgctcacgcgtaaactattactgccgatctgatcgggccaacctacaagagtggctgtcacatgcatgatagtctagatagctttttttccctttgctttaccgatgtccgatgccgtgacatgtgagtgagacaacagctttcgcttgttcagaatgcacgtgaagcggctttgttgcatatgcctagtaagggtgtgtttacttcacgctaaaattataagtttagttgaaattaaaatgatatgcgtagtaagggtgtgtttacttcacgctaaaattgtaagtttaatgtgatgaaaatgttggaagtttaaagaaaaattttggaactaaactcagtctaaatcttgaacgcgctttttctttcatgtaaagttggataaaatccgtaggcaccgttagaaaataggcaaaatttgctacagaacatcgaaagattgcggtttttgctgtgagacactcgaaaatcgtgtatttgtttatgaacacttaaaagggtgttaattagctgctggacactactcctattaaac

SEQ ID NO: 1498 - DNA, 1501 bp, Oryza sativa
gtcagtgaaaccgccctccaaaatcatcaagggagtcaaattgtatcggtttagacagttcggaggtcaagatttctagtattgcggataaggtatacgatttagattccgtgttcatttcagggagtcaaactgtacttattccatatttccaagcctaactgaaacagaatcagcccattatgaagcccataaaacaggtaacaaattcagtgcgctattgttccaactgatgtctgcttttctttcttttcagattcatgccagccatattcacattaactcaaggattcaatgtcaatgactagcattctttttacaagcatgcctatttgttacttttgctaattgtgcagcagcagtgacgaaacaacgcgaagaggttattctaattgatctagcgtacgtaacttacgtgacatatagacaaagaattgatccaaggcaaccaccacatgtccacgtgattgatgattcataatagtaaacaactgcgcattattgttcggttaaaagttgactgctacaaatttcatatgaccacgtcaagctttataaaattataaaaagaaaactttcggcgacgacctcagtggtggttgcaaatatcggaattagattcagtttgtacaagttgtaaaaaaaagaagatttgagttcgtacacatacaaagtcgttagtccacatgagtcatcaaaactcacaaaatacacagtttcaaagcttgttcctagaaccgacaagtagaatgaactggtcataataatgcatccctaatctatttttttaactaaatgcatccctaatccaagcatggcgtcagtaatcccgaagctgacatgtagggattgtaacgcgagtgcatgctacatgcttgacatgggcggcaggataggtcggaaagtgaagaatacccagccacaccaggcgccgtccaatcgctgcatattggcgacttttgggcactttcccgtcgtctttgtgatgggtcgggggcacaaaacgttgcgtgcaaaagacagcggcattgctactcgatgtactgaacccacagtaagttcttgttggctaggaattttcggagccatcagatcattcatgatcaccgtacatgtaagttgtgcatatggattagtacattaacgacgtgttgattctgtaaccaagaggtttgttgtttgtttgttcagatggaactctgaccaaaatccaggcacgcgtgaaacggtgacacgaaaaatgcttccagctgatttccaccggcaacagccagtgagggagtcagcggcaccgcccgctcgtccccgcagtcactgactggtggggcccactcgccacgcagccatccctgacgtccgcgcgttacaccatccgcgtcgtagttaacacctccgttactccattccttccaaaagaaaactcgaaacctccccctctccggccgccggcgagcggctcatccatccaccccaccttggccggagacggcggcaatggctc

SEQ ID NO: 1499 - DNA, 1501 bp, Oryza sativa
tcgaagcaaaattctattaggtaaaataatccaaatcatcgatatatttaggatcgctatatatagttggagagcaagatagcacatgtgttaattacccggtcttaacagccgcttgaaccaaacggaacaagcaggcactttccacggaggcgcttctgcttgttttgtctcactaaacaatgatcaattagctagtctccgtgtagacgcatcacggatgtgtgtggattattgggaagaaaaaaggacgttaatttgtttcagctcagtactatatttcactatagtactatctacttggactagacccatgacacgtcaggtcatcagcttagctaatcctacggagatgcatggtggttggttatggatgcgaatgattagtacatgcacacacggtgggtcgtcaaacgcagcaagtccaagcacatggaacgttgaacatgtttgctcacaacaggttgctattacgagtacttgtggtcaacgtacgataggctttactcggtcataaacttatatatacattaagcgtatgatttgctgaaatgataacggataagttttagatttgtgacattttgatgcaccttatggtcacgcgcgtattcatacgaaagtgattttgagatatatatatatcaagttccaaaagaaaaataaattcatttcaagttgaattagtctgaactaatttcatgagtacatcatgtcatcatgtatggaattatcacaccatttcctttttctttagaaaatatcacactatcagaactagctagcctttctctacgctagctactccatcagttcaaaaatataacaacatatgattgaacatgacatatcctaatacgattagcttcaaataaaaaaaccaacgttggttttgtattaatttctactactatatacgaaggggtacccttttattttgtagaaaaatcagtattaattcattgtacgcatgcaacaagtggagtccctagctactccctagccgtagcgtgtaacaagtggaataatagtccatttacactgtagaggtagctaagggacgatttctcaagtatcttcagaacaaacatgtctgttgattattttactgtaatccctgtgtacttcttgtctccttcctttttgttgactcacctactctgttaatctctacgttactccaaatctccaacatcttctcctagaccttcacatccttcacacatctatataaaccctagaacacaccatgtcatccaacacccaagcagattaagctaattaactaccatcaacacaccctaatccaaaggtgccaagcttgcaggaaacagtaagctagctagcagtctagcactgcttcatttgatcatggccaccattactgctgctagtcccagacccagtgctgctcctgcagccatggaagagaccagcaaggcgatgcctactagcgagtggcctgccgccagcggcggcaatgcgtcgccgccggcgaggt

SEQ ID NO: 1500 - DNA, 1501 bp, Oryza sativa
tgactgtccgtcttatatgaattttttttataattagtattttaattgttgttagatgataaaacatgattaatactttatgcgtgacttatctttttaatttttttcataattttttcaaataagacgaacggtcaaacgttggacacggaaaccagggtttgtcttttttttgggacggagggagtacttgcttaataaccatatccaaccctaaaacttcttatattttgggacagagggattattatatttttctataaacttgataaagttataaaaaataacttaggaaaaagtaaaagtggcttataatataaaataaaggtagcagtaatttatttttgttaaaaatgattttttaatgcctaggacacaagttcatatcttcatcgtgagctacagatttttaaggtgtccataattactactccctccattccaaaatataacaacttttagccttcagggtttatcctaaatataataatttctccaccaatattcacttctcaaccaatcacaaccatccaccattcacttttcccacccacctccactactcatccaatcacaaccctccattattcacttctatctactttcttaataatcgtgtccaactctaaaactttttatattctggatgtgggacggagggagtattgaacacttgttggaggctaagaaaataatgccattctaaacaaatcaataaataaaaggaaaacttcttttaaaaatagagcaaaaagcctttaaacgtgtacgtctcctatagtatcatgtggttaattatcgtgtcctttccaacatcgatccacaacgcatgtacgtctacatacctgcgacgcttacctatatatatccatcgttcctaaagtatatcatcattttaacatttaaaattcattttaagattactcaaccaatcgtaactttctccatttaattttaacacttactacattctcttctcacccaaccacaacttaacattccctcatttactgctatcaacttcattaacccatggtcaaacctaaaacttaaattttataacgaggtaacactattatatatgtaaattatacaaaatactattaaaataggaactgcaggacctggcagtcaacactgcagctgttataccattataacaatccgacgaaaagctaccaccaacattcagcttaagcaatccgactggcaatttggaccatttcataagttttaaatagaagaatacagctgctatcccagtggcattgaagctggcacatactgccatatatacttagtcaaaatggaatccatgaatagaacaaaaaggatgcatatgccgctttatgacttatgatcgagtagacaaatagcatttgttctactgaatcccggccaataaatgataagtatattcagcagagatttggtcagagattaaaattagagtgtactactagctaatatgtacattgcaaggacacgtactgttcgcctc

SEQ ID NO: 1501 - DNA, 1501 bp, Oryza sativa
gtattcgcccttaaaccaaaataccacatataacacgtccctcgactctaaaaaccatctcaaataagaccccaaggaggtttgaacagtggttttagttgacgtggcgcctacgtagattatttgatttggtcctcgtcccacgtggcgttgacgtggcattagaatcaagattaaaaatttaaacaaaaagtaaatatggaacaccttcaatatatgaggcatgattccatatacaatactacaaaaatgatttttctggacgagacccttgttatgttgtagacggatcataactgaccacgtctgcaaaaatcgacctccattttcgcatacggctcattaagaggcccgcatgcaaaaatcgattttcgcagccgggacctcttaaggagctgtctagaagtctaacttaccttctaattcccactcaacagttcaaaaatttctaactcaaccttatcttctcctctctctatatatatctctctctcacctcctcacctcctctcttcttgatatcaactggtgggtgggcagtgcggcgcgatggtgggcggtggcggtggttgtgccccttgcggaggccagcggcggcgaccatcctcgcgaggagtccagcggaggaggcgcccggcgatggcggccttcccccacgtggatctggggacggcggccctcccccgcgtggatccggggacggccacccttcccccacacggatccagtggcggcaccctccccgcgacgaatatgacctcggtcacgtggtggccgggagcgacggggccctttcccacgacgactggcggaggccatccaccgcacggatctgggggcagcggcccctcccccacctggatttggcggcggtggctctccccttgcacagatctagcagcggctgccatatcctgcgacgatgatggcgacctcggcgacgacgacgaccggcgatgacagcggtggcggtgggagcgggcggaccttgtgagcggtgatgagcggccagcctttgggctagggtttgggattgggcgaccggcggcggtggggctgggttattttctttttgggaattttatttatttattcacgatttttgttttttcatgcggtcggcttaaggacccgcatgcgaaaatcggattttttgcatgcggttacgctaactgcatgcaaaaatcctaatttttgcagacctttgagtgcatgcgggccgcccgtttgtgtgcaaagatcgatttgggccatatgcaaaaatgaaatctgtagtagtgataaaacttggtatatggtgagccacaccgagcctaacccaaaagtattgggaataccttatctataacaccgagaacacactgacaacctgcaacatttatgcgggtataagttgggcccacctatgataaatgcatagaggatatggttgtatcattttgataaaatcatttgccattattgtcgttacacccagctaatgttatagcaaaatgatggt

SEQ ID NO: 1502 - DNA, 1501 bp, Oryza sativa
gaacctttttgtctagcaataaggagagaccatcggctacaaacaagaagaggaagggagacagtgggtcaccctgccatagactgcgtgtaggagcaaaggtagacagaagagttccattgaatttaactgagtatctcactgtggttatgtaattcatgaaccagctaacccaacaatgagagaaccctagtctgaccattgattgctccaaaaaacaccaatcaactcgatcgtacgccttggacaaatcaagcttgtaagcacaagcaaccttctgtggttgtttatttttctggataaaatggaagcattcaaaagctatgagggtgttgtcggttatcaagcggccaggaacaaaggcactttggctttggggtatgaggtcatccagtataggtctcaacctattcaccaagcacttagaaacattcttataaattatattgcacaaactaataggtcaaaaatccttcaactccactggattctctattttcaggataaggacaatcgttttgtcattgattccttcaggaagaacacttcttctgaaaaaaagacagcaccgcccttaccacatctttcaaaataccccaattacaatggtagaaatatcccgggaaaccgtctggacccggcactttcagaggcccaatctgaaacatggcagtagcaatttccgaagtcaattgtttgttcaaaaccatcattttgctataacattagctgggtgtaacgacaataatggcaaatgattttatcaaaatgatacaaccatatcctctatgcatttatcataggtgggcccaacttatacccgcataaatgttgcaggttgtcagtgtgttctcggtgttatagataaggtattcccaatacttttgggttaggctcggtgtggctcaccatataccaagttttatcactactacagatttcatttttgcatatggcccaaatcgatctttgcacacaaacgggcggcccgcatgcactcaaaggtctgcaaaaattaggatttttgcatgcagttagcgtaaccgcatgcaaaaaatccgattttcgcatgcgggtccttaagccgaccgcatgaaaaaacaaaaatcgtgaataaataaataaaattcccaaaaagaaaataacccagccccaccgccgccggtcgcccaatcccaaaccctagcccaaaggctggccgctcatcaccgctcacaaggtccgcccgctcccaccgccaccgctgtcatcgccggtcgtcgtcgtcgccgaggtcgccatcatcgtcgcaggatatggcagccgctgctagatctgtgcaaggggagagccaccgccgccaaatccaggtgggggaggggccgctgcccccagatccgtgcggtggatggcctccgccagtcgtcgtgggaaagggccccgtcgctcccggccaccacgtgaccgaggtcatattcgtcgcggggagggtgccgccactggatccgtgtgggggaagggt

SEQ ID NO: 1503 - DNA, 1501 bp, Oryza sativa
tatacatgaagctgccatcgccagtagccaaccaccttcgcccctcgaagggccggcgtcaaaatctgcgcactacggaggcactgcctccgaatcggcccctcccagcagtatggatgcacctgccgcggggccgctggcgccagctcaagtttgctctgctgctctcgtcgccacccctcctttagttgcaggcactcccgtcgcaactgtcgtcactgctcccatcgtcggttggtggaggacacggtgaggaagagaggagaggatgagggaggagatgtctcgagaggagaggggaagtaaaggaggacatagaattttttaagggaggagagaaaataagagggagaagactaggtggccgtcctgttgctaagcgtgcctcttaacaagtttgcatatatgtatttatttgttagctcaaaatcttttaacatacgggtgtttttagcctgtttggagaaaaaattaaagggattgtctacaaaaccatttttagtgtactgtttagcaaacaaatctcgctcaaattgaggagggtagtttaacataccctattccaaattatacaatggtgtaaaaagagatgttccactatgcaatttactcttttttataagtcaaatgatttaattatcgaacacatgtctacaagataacaatgtcatagtttaagctagagaggaaatattaattagttgtttccatatatgacgtgacatgtatatgcatatatatgacttccaggtgcaccgttaccgtttgtttatgacactgaagttaaaccttagatcggaaattcggaaaggaaaacatttgacctgtacgcataaaattctcaagggtccggtgtagttatatttatagcgccgtattttttacttaaaaaataggcaacacgtatttatattgtaagtctctaaattacatatgtaaatttagtgtatttataatataagtttcaaaattacatatgtaagtctcaaaattatatagtttttacatgtgtaaatggtgtgtaagtgggatgtaagtggggtgtaaatttgtattaaggaatagcatgcatgcatgcatataacacgaaattaattaggagccgtttcactcggatttgcatgactttagaggttagctagcatgctttcaggtctcttggcaaggaaaaagtatggaagcacggatcttaaacacagatccaacggccagagaactaattgtaatcaactaaaaaatttgtcgacacaattatagcaaatacgaattctcaatggctacgcgttgaaatggaaggcgacgatcaatttgtttcgctggtcggtcaatttgttcgtcttacaaccttaaaacatgcgtgtacgactcgatctatatatgtgtcacgtttattttcctccaaattaacaatacaatgtacacacaacaacctctttcggaaactatatatatatgtaggtacaagttcattctcgtgccaagaagggagatcgagagtact

SEQ ID NO: 1504 - DNA, 1501 bp, Oryza sativa
agaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttgccgacaatactggaggattgtttaagatattata

SEQ ID NO: 1505 - DNA, 1501 bp, Oryza sativa; identical to SEQ ID NO: 992

SEQ ID NO: 1506 - DNA, 1501 bp, Oryza sativa
tcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgacggtgaaacggcgagacgcggtgggacggcgccttgagatggcggggaccgagcaggccggcggaggtgcgagatggtggcggcggccggcggcgaaacgacgaagagcaagggcggcgcgagatggtgggagcgaggacggcgggggccagccggccaggcgaccagcagtgggcggtggggcgccggcgccacgggcggtgggcgtgagggcacgccggcgccgcgatgccgcgatctggatgccgcagccgccgctccgcctccaactcgcgagtcgcgtctgagttctgagtctgacggtctctctcctatagggttagccggttagggtagatgccgccgcgatttgggttgggctgggaagctagggatgaattatggactattgaatctatggtatttttaacttcggaaattccgacaatttttccggaatgtttccgatcgtttccgggttccgacggaaactgctattatcatattcgattccgtttccgagaaaatatttccgttttcgattccgattccgagaaattccgaaaaaattccgaccggccgattccgtttccgaaaacatgaccggaatccggaaaaattccgtactgttttcacccctacatgtcatacacaacaaaagggttctcatatactcctttgttgagatagagtacagatagagtatatcgctgactgcacaaataagatcacttgttaagccattaaagtgttgcttccgttcacaaatagatgctgttttggatgtataggaggcaatgaaatcttgattatttttttaatcacttatagatgcaaaaatataatatgatttaatattcaaagatggcactcattgatttatcataaaaaaaagactataactgtagttatattgaactgtttattatgaatatatgattatcaataggaatgataaaaattaatgaattggcgagagagactatgtcgtgattgtacaaataaaaaggaacacaaggagtatagtatattttgcaaaaactaaggtcattcatatggtcaaaccaacaattccaaataaatatagattttgaaggacattaaactcacaccccatgctaacaaccctctagcttgtttctttttcctttgtcacgaaataaaaaacctcttccttccacctcacataatacctatattttaacctcacgtattttttactttattacaagtcgacaaagttatagcacaaaatattcctaacatttaatttgtatcattaatttttaaacaaagtgattatgcgtgcgtacttctcctggccatatataatgccgtgccttgttaatataaccctgttatccaacgtgcgcgtaaag

SEQ ID NO: 1507 - DNA, 1501 bp, Oryza sativa
tatcgaatatattaatgccacttgcttacttgtttgaatatacagtatttacttgtttgaaccatatatttggactattccataatataaaaaaacaggagcctatttggaaaacagtgggggtggcagattcactaccaccacatctagggacttttatgtacaaccttcgttttgaatataaggatgtgtctatgttgtttatcaggtgtttgtcgaatacttatatcaaaagattcatttttagtcacttcagttgtcaatttttgaattttgaattatttagatatcatttacaagaatctgattacctatgcaatcactgaaatgatgggaatcaaagtaatcagtgcatgaatacttatagtgtggtaccaaagaatggagggagtgaataagaaatgcaacattcaaatattatagatgttactattaattgtcagatcacaaaaaaatacggcagcttattatagagggcacctttaggctgcgattcggccgacatgggcgctctcctcaacaagaaattccctttttccatcatgaaattaaagaacaacgaaggctagctagcaaaccagcaagatatattcagaagaacattgaagttcatcatttattcaccacatatatataaatagatgcttcctgacaaaagaaagcactaattatttagcaaccccacatagtcacacacacacagctaactatagtagcctagtgaccggttcttggggtcctaggatacccaagccagtagcagacaccaccaggcccattggggatgtccacgttgcagaacgccgggaggctcgccgccgcgcgctccaagtcccctctccggcagccggggaacacctcggccatggggtgcccggcctcggtggcgccgagctccctgtagatgcctgacagcatgtgatcgagcgccccgcacctgcaccagccgtcgtcgacggcggcgagctgccggcagcagtcttgccagacttgctcgtccgcggcgctggccgcgccacggccaacgcattggcgcctcaccaatgttcgacattgcgggagtgagtatgtcggatagcttattcctggccgacattgctcaccggggctgtagacttggtggtggtccgccatggtcgccatcgccgccgcgagcacggagagaacgacgaggagcaataccgagaacactaccttgttggaagccatattttgcttagtttgtgaaaaatcttaattaactgtgatagctaggctcttcgtctctgggtggttttatatatagctataaagaccaaagtgattcaagaacagatagaaattttttggctgttcatgagctatttatggatttgcttgtggttctgtatgaaacatctattgtgattcacacgcctaatctggggcatcatatggacaacagatggttaaagtggattgatatgtactacactctttaattatttgaatttgtttgatccttacgtggaagaaaataaat

SEQ ID NO: 1508 - DNA, 1501 bp, Oryza sativa; identical to SEQ ID NO: 1506

SEQ ID NO: 1509 - DNA, 1501 bp, Oryza sativa
gaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctcaaagaacaggccacgtgcctgatcaacctggttatgcctcgcatatagtcgtatcatcatgccataaatgtcgttacgagcacagtagttatcctgatttttcatccagcagaacacatggacagcatgctgtaaattcccagaaattgtgatctcctacaagtgatacaacatgtgtaagcgcgttattacctgaaaaggctagttttatgttagcaaatcgagagatttgagcctcgtctacaaaatttgcatgtgcagctggtactaccataacaacacagctagatcgattgaattgttcatgatttttgtaatttcaagcaatcgataacattttggccccaaaaccagtttgtcattagtgcctccacgcaaggcaaccatggcagccacattgatgtatatcatcagcaattttcaattcatgaaatgctacagagcgtggggatgatggccttacgcggatgaggagagggaagttgcggcgggcgaagcggccggcccagcagttgagcacggcgtcgacggcgcgggcctcggcgcgcgggagcgcgagcacgcgcgcggcggcctccgacaccttccagtcccgctgccaccggctcccctccacgcgcaggcggtggcgcgcggggagcgaagcggcgcccacgccctccacctcggcgcgggcctcgcgccggccccggtcgtagtccacggacacgggggggcggcgctccgcccaccccggcggcgcggcgcccgggtgcgccagccgcggccgcggcggccgtgggggcgcgcggaccacgcgcgtccgggccggtgacgctggcgccgccgcgtcgggcgtcgcagccggcgaccgcggcggcggcggagcggaagacatcgcggcgggtggtggagggggggagagaagctttaccgttggggcggtgtgagagcgggttttccggataaggggcgatcttttcctcaacagaaaaaccaggaaatgaactccatccgtcctaaaatatcctcgcgaaattagaatcagattcgtaaaacgagaaagcattctgttatatcctagatttttatattttaaaaataagatagtaatttacaagcaccccaatctaaaaatatcaccgtagaaatgcttttattttagaaactaggtgaaaccctacgtgttattgtaggagtttagtattataataatataagtaaaaaataatgcgtaacatagctagacaacataaactaaagtaagttgatgtgatttatgataatttaaatttaa

SEQ ID NO: 1510 - DNA, 1501 bp, Oryza sativa; identical to SEQ ID NO: 1507

SEQ ID NO: 1511 - DNA, 1501 bp, Oryza sativa
actattatttaatgatggcttaatgatagttcacgatggtcaatcgtgattggttaattaattacttgccaactaaatcttgataatggtgggttgtgagcacatggttttgagagtcgtgctcatggcaattaaggaccggttcgcgagctactgttgtgaaacattaaccgtgccaaccacaagccagcgtgggcaacggctttacctttcgtatagcatggttcattgcagagcaccagactgagaagtggcggagataagcccacgggggtcgctggggagtccatgcctctggtttttgagggggtgattatgatccaggaacggtgcactgtggtgggttgtgttatgcaaggggtaatgtcacagctcctttccgaggtaccgtggtggtactgaggcacattgtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtatgttgttcagtgttgattaaaatttctgattaattactccactgttttacttctcttaaatgttttgctaaatgctgtttttgcaaatgagcctatattatgccatcctttggtatccttgtgcacttgcatatttgctgtgtggcttgttgagtatgtcatatgctaattctttcaataatcaatcaacctcagttgaagaaaatgatccagaaggagaagacgtttggcttataccccagttgagctgcctgtgggagtggagccggagcttcgctagattttattttccgctgcagttttcttcatggtgaggactaagtgcctcttaagtaagtatttatcgttttagctaatttgatgaatctgtatattaaattgtcagtttgtgtacctcggctgattcctggacgaggattttatgcacaaataagttcggaaattactagtgaatttccgggcgtgacaagttagtcatcatcggcgcggcggagtcgtgttcggccgcgacgacgtcggcggcggcgtcggcaacgaggcggccggcggctgtttggggagagagagagatcgaggtcggagagagagagggaggtggcggcggctctcaccccagagatgcgacggcggcggaggcggcaacgacaacgcgcgcgagacgaccgcgagatacgacggcggcgtcggcgcggggatgctctaggtagtggcggcgaaggagaagccgagagagaaattgattggggaaaaaacttctaagtgttggtggagaagacgaaggcgcgcatcgggaatatatatacctctagatctttagtcctggttgatgagaataaccgggagta

SEQ ID NO: 1512 - DNA, 256 bp, Oryza sativa
cagttttgttttgctgcggaaaattcggatttgttttgttttggaaatattccgaaaaatccggtgcgtgaaaacggcgtggagtccgaataagttacgcgtggcttatccggttcggttacgcggagtggagattgtacgggcgccctgatcaagtgacctatctctatataaaccgagccgccgtcttcacgcaacacacgtgaaatcaatctagggtttgcctcctactctgtgctgcgccgtcgctcgtaga

SEQ ID NO: 1513 - DNA, 1501 bp, Oryza sativa
tgaacgtcttgtaatgctgcgccttcaagagatggacgagattgtcctctgtggcttgcggatactggtcgagcattgcgacgtttactttccgagggtcgatgaatccagtatcgaaaaccccccgccgccgggccctttgaatctccattctacaacaataaaaggaagtatatattatatgtagtctacttatatacaaggacctaactaattaaaggaaacataataagaaatctaactgaacgatacttacaaaatccagcaactcataatagagacgtcgagggcatccagctggtatagttcgtagatacccttgaaattgatccagagaatgtcatctccttgcaagaagtccgtgtccctgatcctcgctccgatcatttctgtaccggtggcgctcatctccatgtacagttgatggaacttgtacatttgtgtgggtagggactgcagctgctcaggcttgacaagcggtttaccgagttcgtacatgtatttcacttccgcctttttgattggtgcacctcgtagcaattgatccgtagttagcccggtgtcattaataaattcttgtattccaaaatcttcatgttcgttcacgttcgttcgttcgttcacgttctcgttcatgttcgttcattcgttctcgttcacgatcgttcgttcgttcacgtggcggcagcggagcggcggcgtggcggcgcggctgcggcttggcgcggcggcagcgtggcggcgcggcatcgacgtggcgcagcggcggcgttgcgcggtggcggcgtggcggcgcggcgagggcgtgccgcggcggcgtcgtggtgtctcggcgtcgtgccgccgcggaggcgtggcgcagcccggcgttgtggtgcgcgcagcttcgtcggcactgccggcgcgacgtcgtcgccggtggtggcagcatcgaggtcagggttggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcgtaatttttaatcatacaaagagcatttaagtaattacccacatattaaattaatcattaaatggtctaattgtaattttttatgtactttgagtgtccaagtattttcaggatttttcttgaaattatttgagcattggaagtatttttaacaattcaaagatcatttaagtgattattttaattggaaaagtaataaaatcctcctcctcagcttgggccattttcggcccattccttcctttccttcctctctcttccaccggcccaacccgagcctgcatcctctcttttcttctcttagccaaagtctggtattgctccctcttctaaacaggctgaga

SEQ ID NO: 1514 - DNA, 1501 bp, Oryza sativa
aagtaattatatataagtttagatcctatatacctacaatcaaaatttaacaaaaagatattcaaatttagttcaaacttgtttgaactagctagtaaataagttaatgttcataactaaacatttttttaaaaaaatcagactcattagcattaggtacatactcaatttttaatcatgttggccgggccccatgaagccccagttaattttaatatatatatatatatatatatatatatataaagttaaatttgagttgttttgttgctaggtataggtatgaatcgaatacttataactagatatatagaaaattttgaaaaatttagacgaatttgtgtatttcatattatggtgcccgggtgcccatatatgtcctatgtgtgtgtatgtaaaccggagttgctcaaagtatatatactataaaaagagtgtgctaaatatattcaattaaaaaagaaacacttatcatagaaatgataatttcataggatcaactccgacacaataattttctcatcaatttaagattccatggttcaatataattatgctttagattttatatatgttctgtgaggataattagaagaaaatcgcgaagtgagtatagctcaacttgttaggtttttttggtagaaccaacccacccggttttatgtcctagactttgatacgcgggtgtttgtgattacggctaactattgttgtagtagtagccaacgtacctgtctacatcgaggcacttgtggtcaatttgtaaatcccaacatatgtcgtctcagtctttcaaaggtgctcgtagaggtagggtagtgtgcgtgtgtgctcgtaggggtcattgtgcgcatattatgagcgtgtgcatttgtactgtttttcttaaaaaaatcataactcgttaataagatagcaggttcataatatatagaatgaaataatatgttttttttccaaaaaaggtcatccacgcacaaaaatgcatatgttaggctagcaaaattttaagaaactttaaataagatgtccacgtttgtgtgcgcatgcttccttcctgtttagttagattacaaatatatttagttcaagaattacaccaatatattcgtatatatattaaagtactggtttttgcagctgaaaagaatatatcttatgagatcgaattgaaacttttgttcaaacttcaatgaatcttaattaaacacgttttcagaaaaaaaaatagtatcgtcacacaaattcaacggagatatattattgttaggaaaattggaaaagggtacaacgttctggcagacaaacgtgcagctcacccctataaataacttagctgcgaccatttgttcgaatcagccgggctgagaggcagcagctagctagcgcacatgcattttcgttgtggcgaacaagctagctgctagtaccctcagttataccaagatatacactacattcctagctaggtacgattagccgccggtgagtggggagatgg

SEQ ID NO: 1515 - DNA, 1501 bp, Oryza sativa
actttggaggacatgtacacgtagaggacgacgagacgaacccaacggtactcaccctcgaaccaaacgacgaacgacgacggccgacgacgaggtctagcggcggcgcggcttcggtcgacggcggcgacggggctccggtgatcggcaacagcggggagagagcggccgggcttctccacacctcggcgtaccttacggcggtgacggcggccggcggcgacgacggaggcggcggcacgacgcggatggagctcggccggcgacgacggcggggtggagcacgtggcggcggcgctacgaggcacgggagaccacgggagagggggcacacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttgggggtaaagatagaggaggataagaggaatatttcccctcaactaattttagaaaaaggagcaacgagaggcgagattttggaaggggatcggcggcaacaggcacggcacggctctgctctggctctgtccagagctggaagatgaacagtagcgcagggaggaaaagtagacttcttgccgggcttttcttttctcagcctgtttagaagagggagcaataccagactttggctaagagaagaaaagagaggatgcaggctcgggttgggccggtggaagagagaggaaggaaaggaaggaatgggccgaaaatggcccaagctgaggaggaggattttattacttttccaattaaaataatcacttaaatgatctttgaattgttaaaaatacttccaatgctcaaataatttcaagaaaaatcctgaaaatacttggacactcaaagtacataaaaaattacaattagaccatttaatgattaatttaatatgtgggtaattacttaaatgctctttgtatgattaaaaattacgaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacaccaaccctgacctcgatgctgccaccaccggcgacgacgtcgcgccggcagtgccgacgaagctgcgcgcaccacaacgccgggctgcgccacgcctccgcggcggcacgacgccgagacaccacgacgccgccgcggcacgccctcgccgcgccgccacgccgccaccgcgcaacgccgccgctgcgccacgtcgatgccgcgccgccacgctgccgccgcgccaagccgcagccgcgccgccacgccgccgctcc

SEQ ID NO: 1516 - DNA, 1501 bp, Oryza sativa
gaggatgagcacgagcatggcgccgccgcctcggattcgccgtagcctctccgccatcggcgatgtcggcggcggccgctaccatcaccaccaccaccagggctcgggctccgccgccaccaccactcagccccgccgccagttgcctccccgccgtccagccgccgacactattattaccacgtcgccatcagcaagattcaacgcgggagcttcggatccggccacgggacggtcagatccgagcacggatccgcatcctccaccaccgccgccggccaccgtcacccgcgacctgcttgacgttgcccaccgttcgcccatggccatctcgacgaccttcgactccttgcgggggttggcactactcccgtcggcgtgcccttgccggatccgaacgcgtccaccatgggcgccgggtgccccagctgacgttgttccgggcggcggcgaggctgaggggaggaggaaggtgtggcggcggccggcgtgtgggggaggaggaaggtgtggcagcggccggtgtgctcgttggatgcggacaacggcatttcctccgccggcgcgacaccggctgccggacctcctcctctcccctccctccggcggcctcctccccacagcgccgcccgtcgccggcctgagaaaagtgaaagagagaaagggagaagagagggaaataagagagtggtgatgaggtggcatcctgacatgtggggcccacgtgggtcccatgctgacttagccgccacgtagaccaaaaccggggtcaaaaccgccgaaggatctcagatgaccggttttgtacagttaagggaccccgcatatctggttttgcagttcgaggacgttttttttatccgatgacaagttgagggaccttcggtgtactttttccttatagattcgggaaatgctgggctgttattgggcttttccaccggtcgacgtgggtgtggacacattgaggtggcgcgcaggatcgttttgagagctgatcaaacggctaccgatcaacttgatgcaggcgacatggaaaatcgacaaatcgttgagatctaatcgaactgaatgatgtggatcaacgatagaacagaaaattggtaataactatattaaatggagatcacttgcataggtaggtttataggactacattcgctgcgttgagatttttttttgtttttttttaaaaaaagcgcataggaaaagagacgcatgctatttttggcatgccggacaagttaaggccttaaaaatagtatcggtaccggactagaaagtgtcagatatataacccgtttccgaaaccaactactactccatgcaacgcacgaatcgctagcttattatattccgaaactgactcgcgggttatccgaatccgagtacgtcttagccgcttgctaagctataaataggaagcatacttgcacaaaaaaaaacagaaaagcgcagatcaagaaaagagattagatcgacgataatccagaagaagaag

SEQ ID NO: 1517 - DNA, 1501 bp, Oryza sativa
tcgaaggtcgtcgagatggccatgggcgaacggtgggcaacgtcaagcaggtcgcgggtgacggtggccggcggcggtggtggaggatgcggatccgtgctcggatctgaccgtcccgtggccggatccgaagctcccgcgttgaatcttgctgatggcgacgtggtaataatagtgtcggcggctggacggcggggaggcaactggcggcggggctgagtggtggtggcggcggagcccgagccctggtggtggtggtgatggtagcggccgccgccgacatcgccgatggcggagaggctacggcgaatccgaggcggcggcgccatgctcgtgctcatcctcctcgccgtcgtggcgtcggcgcagcaggagtacgaggtcacctcctcctcgtcctcctcgccgtcgcggcgcggcgcgggcgagggccatcggccgccgccttgggcgcagcaggagtacgacgtcacctccgccgccaccacgggtcctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcccagtcgcttgaagcatgtgtggtggagagaagaggggaaacacacgcgcgcgctcgctcgcctcgcctggcctggcctagcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacagcgtggagtccggataagttacgcgcgacttatccggttcggttacgcgcagtagagatcgtgcgggcgccctgatcaagcgacccttctctatataaaccgatccgccgtcttcacgcaatatatacgcaaaatcaatctagggtttgcctcatactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgatggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcgttatatgtctataatctcaacaatccaaaaaccttattataggcactgtgattttacta

SEQ ID NO: 1518 - DNA, 1501 bp, Oryza sativa
ggtgcaggtggatccacaatggatttagattctttcagctgcctagcaaactacagtaatccttaatataaatacatcatatggaaattgtttacttcacaaaagataattagcaaaaagcaattacaaccacagaaggaaagggacaacttattgatcaatatttcgtaaaaaaacacttattgatcaatatttgtgcaccattgacaccggtacactactgctacgatttacacttataacacaagtgcagacgttacattggtgcgttgataatcaaatattagtgctaattatttacaccattacgagtgcatgtctccttggtggtttgtccacggtatatcctcatccatccaaaacctctggacgtgtgtgcacaacgtgccctgcaaatttaaagcaactgattggagcaacttatttctgtccccaatgtaaaataatgtccagatacaacgagggaggtgatgtgatgtgaataatgctccaattgttttttttttttggtgggggttaagttggtcgtgagacatggatgatatcaggaggccaactgagctgttaaagctgatctttgccgtgacttgttcgtatatatgatcaattattctttcctcagtgtacgtacagcttacacaaaaatctaatgagggggataatgagactatgttaactgaaaacctagaattggagaaatgtgacattccatccttgtctgacattgcaaaacagatggaagaggaagagtgtgatgaagaggatagctttcaagaggttccttacaagaagaacagacccatgaaagcagaacctgctattacttcaagaatgagcctgaggaatagagctgaacttctaaccaaaaagaagaatctggagtccacgggtaattccaacccttttgctgtttttcagttaattgatccctttgagttgaataacattgctattgctgctaatatttccttagatagtaacttagtagaaatcaataatactgtcagggttatggataaggtataccctctatacttggatgtgcgttgtatactgatacggtatactcgcgcgtatacggatagttcctgtatacgttaaggaaatctatcacgtgacagaaacagaatccacagatggagggagtcctactcggacaagactgggtctttaccatatcgtgaggggtccgatatctccgagccctacttggagatcaactgacccgcggtataaaagggaccccctaggcaggacctaaggcatcgaatctcaccgccaatacatccaccacagcctacgaagttggagtctataggagccaagtcgccgggtgatctagtcgaaccaactcaactacggtcttgtcggtatcatcgagttccgctattccctttgtaatatgtggtttccatcatataatcccataccaactggattagggctattacctatcaaggggcctgaactagtataatccttgtcttttgtttgcttgatg

SEQ ID NO: 1519 - DNA, 1501 bp, Oryza sativa
caaggcgcgagctggcgctcggcgctcgcggccaaaacggcgacagaggcggaggatgacgccggcgggaggaaaaagggaaaaagagggagagaaagggggcttgcccccttgccactttggggaaaaggaggagggagtgagggccatgcggcagaggggggagctctgcctccgtcccttggaagcacgcgcgaggaggggcggggccaaggcgatgacgacggcgatgacggccgggcggtttggagcggagcgacgacacgggcggcaggcgcgggcaggcgcggcaggcgctgacggcggcggcgactggcccgtcggccaccatggcgcacgcgcgcgcgggaagcaacggacagcgcggcgatttgggtggcgtcggcgggaaacggcagcgagggcggagggcgctcggctcggcgcggctcacgcgcatgcgtgcgcagtgcacgggcagagcgggaaagagggagagagggggagagagagagagagagagagagccggggagggaggggaagatgggccgagagggattcagcccatcaaacccgagggaggcgaaatagacttttgcggagggatttgatttgggaaggatttggattcgggattgaactcaacgatagatcggggatttgagatctgagatggcacggacactagacaacaagcaaagaaacggatttcgcaaatagggtttttaagagatagttttcccgctaggcgccacgacggaacgggcgctacattattccataaataaatcatgacattacagatgtaaactagcatgaacgcatcattagatctacacatgtaagctaagcagtagaacatgaacagatcaaatattcgcaacatgtcgaacacgtaccgaggtgacggaaagaccggttgctcggcaagaactactcgcggttgcgggcgtcgacgaaggcgcgcagcacgcgagcgaagaggaagacgagccctcgcggacgaacagggagtagtcgcgcgaagcgcttcccaaaaaccttattgccgccttctcccagtgcaggacgtcgaaggcagaggttcgggagacctgctcacccgatcgccggtgcacgccggcgagcgggatggagtagtctacgagcgacggcgcagcacagagtaggaggcaaaccctagattgatttcgcgtgtgttgcgtgaagacggcggctcgttttatatagagataggtcgcttgatcagggcgcccgcacgatctccactccgcgtaactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagata

SEQ ID NO: 1520 - DNA, 1501 bp, Oryza sativa
tgcttctcaatcagcgttgtaagtagccatgctctgcggctgcaacctgtcaggtcgtcatcggctgcaagatgggtttttcctttaccaaagtgagaaaaacgccatggttatcctatccatccactttgcaggaagcgataacggtgaacgctacaatgtttatccactggaatccgctggccgctgggccggtccggcaggcaaaagcccaagcgcgaaaccgcaaggtgcaagcccgcgacacgcgcgcgacaagggccgcaaccgcgatgagacgttggtttggaacaagttcactttaggtccctcttcttaaagtcgtcgagttcgaatttcatcgttgaaccacaatatcagatatgaagaattcctcaaccaataaaaccagtataccaaaaatctcaagatagtatgctccccgggtttggttaatgtggtaaataggacccacatgagccctacaaagcgggttggcttggttgaggaggcggcgacaagggctgaagtggagggcagtggtggtggaggcaaggtggtggaagggggcgattgttgtggcttgggcatcacgccgatggcatgagctagcagcattgcccccttcccctctgtgatgtgggcgggcatgctcagcgagtggcgggcagggggagatgggtggcaagctgtgggcaccggggagacgtgaggtgcagacgcaagcatgggagctcgttcagctgcctgcccttacaatctgctgcacccaccgcctctcttcaagtcggtgaccgtctttctccctgccgcgcgccttcccgtcaactgtcgctcctaccccctccccctggttggtcgccgccttactccacgacgccacaaccaccctaccaatccacgaccaacactcccttcctcctctagctgctccttccttgccgtagcatgtcgctccccacttccccagtcaccaccctcgttgtcgccttctttctccctgccctcttcaggtatggcaaggacgtccacaccctcgttgagtactccatcgatgactacctctaccccaacattgatttctataccttcctcaccaagcaaggcacatttgcattccttccttctaaatcaacatctttgcattttctttagattgatttgctcacaaattgaatcgagcagctttgatgcgcggttgttcatggggacgatgcgggggaagcgaatgatgttcgtgggggaactcgcggcgtcaatggtgggtggatccggagagacacaggggaaaagaagggtagtgattttttttatgacatgtgtgtcccatactaaatcagtcgggttgaccgaagtcagctcgtcacgttagctaaaacatgagagtataatgtcttggaatctttggtgcaccgatttttataagtcaaaggactcttcatatctgatattatggtttagggatgaaattcgaactctgttaaaataagagatctgaagtgaacttatcccagttggtttt

SEQ ID NO: 1521 - DNA, 1501 bp, Oryza sativa
ttatcttaaaaatgtacagaccatatgtatatattaaaaagtacttcaccaaaaatcatatgtttgttgatatttttatttatattataataaaaagtagtggtaaaagttatttttaagaccgcacctttattcaaaacgatgataatttatcaaacctggagggagtacaaggagtctgaggctttaaaatttatcatataataaggacttttatagctgatgcactctcccaagcatggattaattagtctgaaactaaccaacaactaatgaattagaagtagcttcctattaatgagggaaattatggacttttgccttttcctatttaatttgtaagctatataattttgaatggaaggagtaacatgattattttatttttttttcatgtttttaatcaaagagcaaacatatattaccttccgatattaattcatatttcctttgtttttaatatatgatggcatcgatttttatacatgtttaacaattacctaagtattccctccgtttctaaatatttgatactgttgactttttagcacatgtttgaccgttcgtcttattaaaaaaattgtgaaatatgtaaaactatatgtatacatgaaagtatatttaacaatgaatcaaatgatatgaaaagaattaataattacttgatttttttaataagacaaatggtcaaatatatttaaaaaagtcaacagcgtcaaatatttagaaacagatagagtatcatttattttgttgtgtcttttttttatttttaaaaggactttaaacatgaattatattctttatatttgtaaaaattaaagacgaatgattaaataaatgtatgttcaaaagttattggtactatacattaaaaaagggaatagtattttcctggtattcataccataaggacaacaaaacaactcccatgatattttcttttctcaaataactaacaaagcctcatgcctaatctctttatcataagctacctggatctaggtagtttctcttttcatgttattgggaatatttgaccgattttcttgatagctacttatggacatgtgctcaaaggatgtaataaatatgatttttttttaaaaaaaaaagatgaattcacagtaactatttctagtggcgtaaaaaaaagattttacttgcatgaaaagacatggtttgaagagagagctctggccatgcagcaaggacgagccaatcagccaatggtatatgctgcaaaaagtcaaacgcatgcatgggccccagttgtcagtggcatatgcatgacctctaatttatatggtttattttttccctcgtaatatttcccaacattttctgtgtcacgtaggggaagctgcttagccagcctcagctcacatgcttaaaccctcgcctcttctccctataaatacacaccctaaccttcttctccctcccacccacacatcattcttcatcccccaccctaaaactcaactactcatcctctagc

SEQ ID NO: 1522 - DNA, 1501 bp, Oryza sativa
gttttcactcctggtctggtccgtacgtgcgtgcgcatgtacgcgtttggtatgtcgcttttgaacactgtactagtgctatatatatatcctgcacgtgcctgatatatacatgggtcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactgaaaacggccgagcgagcgaggcgagccatcgacgtctcgctgcatggtccctcgacgcgtaccggtgtaccacccacacacgccgcagcaaccaaatcggcctgggagttgagcagcgtacgtgtcctcccgcggatgtctacaccggccggccacgtacatcgccgtcgtcgctgcgcgaccgctcgctgggccgcgcgtccatatcatcccaccgcgacgggctccgatccacttccactccatctcccggctcgacatcctcctccgatccgacccgggcctcgcctcgcgcgcgaccccgcgattccgccgcttcgcgcgggccgttcgctaagttttcttcacacggcctgtacgtctcggggacgcgcaaaaggaaaaagtacaccgaaggtccctcaacttgtcctcgagatacaaaaccagatatcccacgtcccttaactaatcaaaaccggtcacaaaagtcactcggcggttttgaccccggttttatcctacgtggctgctgagtcagcgtgggacccacgtggaccccacatgtcagcttgggccacgtcagcctcctctatctttcccctattctctcccttccgcatctgtctcactcttcccttctcttcttaggtaagcagcgttgctggcactgccggggaggagaccgccggggcgaggcgggatcagccggaatgctgagctcgtccgcatccttgccaccgtcgccgccgggatcctcctcagcgccgcctcgatgctcgcgttctgaccgccggcaacgacgtcggtgtgggggatggacaccgaatagctccggtagtccgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgaggagctccatgatccgccccggcgagtttccgaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaac

SEQ ID NO: 1523 - DNA, 1501 bp, Oryza sativa
cgaatatgccaggaacactatgcaagagcagggaagaatctgggcatgataagatcgatcgaaagctacacaaaaaaaatggtttttaatccagcgtggtccagcttcctgatggaaatggcgctataaattattatcaggtcaagaacaaaaacatgtacgggaaaggcattgtaaattcggggttggattaaaaagttcagaaaaagaaatagtgggaaatttcggccggccatatcatgaatgaactccaccaagtatacacttgtgtagtgcttgacaaagaagcgatgatgattggtactgcaacgagtcgatctcatgtcagtaattcgtgataaatcacacttgtaagttgtaactgaactaattacagtggatttgtgcaatttactttagttgaaaggtttaaactgttttcagattttcgtagacttgatgagcagcaaattgtagagctacatatatgccgactaaacagtggcttagtacatcgtattattcatatccgacagtttatcaacactcaattgcatgcatgtgcgtgtgatggtgacttctttgattatgagaccaaaccaaacccctcaaacactcactaaaatcacagaatttgattcctcgtgtcggctaagtgacgattttttaaaaacaaaattatggggggagaaatcatggagcgttgattagggatggttttgaggttcattttggagcatgtgaagatcagcatcacgactgggctgattatcgctccatccaaccccaccaaaccttggaagatttggcatctgttccagccaatcagcgaccctggaatcaacatcagacgcccttaaaaaatttcaagttgcaattaatgaacggcgtttccaatccattgcaagcttgatcctcatgtttttataataaaaagggtcattcttgagttcattttcatttcaagcaaaagttgactttgctagtttaaacctctttctgtattcaggctgaagaaatgatagaggaacatggctctggtttcccctgcaggccaacagataagaacaaatcttgcttgaaattgaatcactagtgtaggatatatttttgtattctgtaacttgcctcggttttcagcctttcaggttggttttggtattggtcttttgctttgcttcactgctcaaacacctgcaagttgaattttttgcactaatgatattctgtatggtgaaaaacttattatatatccaacctgcacctaactgtataattgggcaaaggttctactcgtgcgatgtgatgtgaaaaatgtgcaaaatacagcgtaaaagctcgtaaaaggtgagaatatatagctagtgttaagatgctccagctagagcagcttgcttctgagtcacattatgcttgaatttgacagagctccaacaattatgtctcagagtccaaccaaaaccaagaaactgtacaatgtgctcagttcttttatgcttcctatcttagccgaaatggacag

SEQ ID NO: 1524 - DNA, 1501 bp, Oryza sativa
gagtagcatgcatttctgtcccatgttttttttcttcccgtgacataaagttctagtatttttttcctgtgttatccaaacggcaatttttaaaatttcccaaggtttttaattcctgtaggaattgaataggcatggcactttattgctatgcttttcctcttactgcgtttccacaatcctgtgttccaaaagagccctagtcatcctttggaatggaacaatgctggaggatttctcaaaaattgaactagtttccgcggaaatcctgcaaaattcttccaaaaggagaccctaagctgtactgtttagtgatactcaaacaaattctgcagttctctatgtcatagttgtcttcttttttttttgaagaacatttttactaccatcaaaacaaacacttatagtagaaatggcaagagtcacaaggcagagtgatccaagcaaattgtccgagttgaaatgactcgtgtacgatctctcactctcctgaagtcctgattgttagaagtataatatgttagttagatataagagtcaaatacaaatatagagataagatatatcctagagataaaattctagagataagatagagtcctagagatagaatcctagagataaatctactcttacttgtattgtactccaagtctctatcctctatgtactcctatatatatcccatgagagggtcgatccaatatatcagaaaacatcagaatacaacatattagattttctacatggtatcagagccatatactagcgtcaaccgatcctttgatacaatccatccatccttcggcgctgccccagggagacgagatgaatctgtaagctctccctggggcaacacaagctagctagcctctcctgtatcatctacagattagattagccaaagatcattagatgtgttttccattaattatcattagattaggggaatgttaaaagtataatatgttagttagagataagagtcaaatacaaatatagagataagatatatcctagagatagagtcctagagataagatagagtactagagatagaatcctagagataaatctactcttacttgtattgtactccaaagtctctatcccctatgtactcctatatataccccatgagagagtcgatgtaatagattagaaaacaacaaaatacaacagtttagatttttccacatggtatcagagccaaagaccaacgttgcttgatccgtttctaccttccgctcgcgccgccccggggagatgagataatcgccatatcctccctggggcgccacatctacaatcctcgggagaagagaaggagcggaagccacgccagtatgaacaggagaaaaaggaagcaatgcatgaatcaatcccatctagcagatcaagaaagaacaaaaggaggaaaaggagatcggtccaagcaatcatgccgtacgatggaaaatcaatctcgccgaagcatgctctgacagattaatctgcaaga

SEQ ID NO: 1525 - DNA, 1501 bp, Oryza sativa
ccttctccccgcctccatccctggagagctccccgcccgcggaatcggccccgcgcgttgttgttcgcgcgtgcgtccacgtggtcgtcgcccgcgtcgcgcctgcgccgtctgcgccgcccggccccgctgccctgccgctcctgcagccgcgcagccgctcggccccgcaagccagcgcgcgtgcccgagctgtgccgctcaaaccgccgcgcctcccgttgcaaccgcgcgcgcgtgccgtggtggccgaccgcctggtcgccgccgccgtcagcctctgccgtgcctgcccgcgcctgccgcccgtgtcgtcgccccgctccaaaccgccccgccgtcatcgccgtcgtcatcgcccggcccccgccactccgcgcgcaagctgccaagggacggaggcagagctcctcctccctctgccgagtcgcccccgctccctcctccttttcccaaagaggcaaggggacaagcccccttttatctccctcttttcccctttttcctcccgccggcgtcatcctcctccctcctccctgtcgccgctttggccgcgaccgccgaacgctagccctctcctttgaccgccctaagtcggttcccaaactgacattgccatcctataaacccaagcttccctcttttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgccctctccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgtcaccccgaccgttgccgccgctcgccgtgtgctcgccgtcgtcgtcgcccgagctcggaagcgccgctcgtcgccggcctcgctcggcgcagctccgcccaatccaacgctagcatcagattcccgtagccgcgtagataatctcgccgccgggaattggcccctcgtgacctcgtcgccgtttcccccttctcccgccgccggttgccgccgccgcaattcgccgccgtcgggcatcctctggcgaatccgagccgttggctcgtctcccctcgtcctatgcaaccacccggtgtgctcgctttcgcctgtatcgccatggttcgctccgccgctcgccgctgtcgtccgccgtccgttccggccggcgtcgtcgtcgacctcccgccggcccgcgtggcagccacgtaggcgccacgtcggcgccagctcggccaaaaccgggtcgagtcgaccccggttagccgctccctccccgtgcgcgcggtccaccgcgaaccgtgaggctgcgcgtgggcccaccgcatccgcgtcctccacgaaccgcgcgcg

SEQ ID NO: 1526 - DNA, 425 bp, Oryza sativa
cggcccgtcacaggtatcccctcacctgtgacgggccgaaaggaaaacccgtcagaggtataccagtgacgagttttgcttccaacccgtcactggtatcccctcacctgtgacggctttcatttctggcccgtcacaggtgagcggataccagtgacgggccgttgaatagaagcccgtcaaaggtatgagcaatacctttgacgggctttttttatctaacccgtttgaggtgtgttggatctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 1527 - DNA, 1501 bp, Oryza sativa
cgccctttaaagcccaggcgccctccctctcttctccctcgttgtcccatcgcctccacgccattgccgccgcctctcgtgctctgttcgccatcgccgttcgtcgttgcgcgtgtcggcggagccggcacgagcaaggacgcggaaggggactccgggcgcgccctcttcttcctcttccttggcccgaggccggagagattactcccgcgccgtcggcctctcgtcactgcgccccgcccgcacggtagtgcctccctccgttcttcctcctcgctccatctccccccccttagttttcggtggtagcacgagtagcctccccgtagctagccggcgccgccccgaccgttgccgtcgctcgccgtgtgctcgccgccgtcgccgcccgagctccgtagcacccgctcgtcgccggcctcgctcggcgtagctccgcccaatccgacgctagcaacggattcccgtagccgcgtagatgctctctccgccgggaatcggcccctcgtgacctcgtcgccgttttccccttttctctccgccggttgcggccgccgcaatccgccgccgacggactccctccggcgaatccgagccgttggctcgtctcccctcgtctcgtgcaactacccggtgtgctcgctttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcagccaagaccgggtcgagccgaccccggtcagtccctccccgtgcgcgcgttccaccgtgagccgtgaggctgcgcgtgggcccgccgcatccgcgtccaccgcgaaccgcgcgcgtgcaccgcgtccctcccccaccctagcgccgcgccgcgtgctccctccacacggtgagccgagccgctgccaagcgggtcccacccgggaccacgcgtggtgagcccggtccactggctctctctcttcttccctcccgcgcgcgcgaaccttgggccgctctgggccgccttcttgggccggccggcccattaagctcggccgagccgccctttctctcgggccgcgccctagccgcccaagggaagtctattttccctccctctttccttttcttttcttttctttttaaaaaggatttaattaaatccttttcctttagaccaaaaatccaataatcttagaaattcaatatcttcccaaccgtaaatccgtttgactccgttcaacttccaaaattcctcaaatctccagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccaccttcgaacgtcttgagcctatatttgaatttaattatgttgcttga

SEQ ID NO: 1528 - DNA, 833 bp, Oryza sativa
tcctgcagcccgtctagattcattaacatcaatataaatgtgggaaatgctagaatgacttacattgtgaaacggagggagtactgagcaatagtaaattcatggagctgatagtaaatactactcactctgtcctaaaatataagtatttttgaactttgacacggtcattgagatattactttgactaaaaatatttacaaaaataagatggtttaaataaaaagagttacatattatgatagtttgtttaatgataaatctagtcatattattcttacatcattgatatttttattttttagctattaatagtcaaagttaaaaatattttgactctgtactattctaaaagtgtttatattttgggatggagggagtagaaattaaccaccctatgagaaccgtgcatgactgcaagctgacgtacatagctatagtaaaacttttaaccaggtaaaaacagcggtaccataccatgagcctgctgaactgcagcaagcaagcatgaatcgatggtactcgaggatgaacaaaatgtgtgcacaacaactgaaatgctgaatgatatcaactatcgaagcctgggatgacaggggcggtaaccaaattcagttcatagtgggcatagtacaccatctctaattttctcagaggaagtaggtacctggaagaaaaggattggttggttcccgccggtggagaagagcccccctctcctttttgcaagtataaatagcccatgagcgtcctgctatatttcatcaagccgagctcagtgagcaacaagacagtgaagctagtgttctcagagcatacacagccagcgacaa

SEQ ID NO: 1529 - DNA, 474 bp, Oryza sativa
cggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 1530 - DNA, 1501 bp, Oryza sativa
atgcatgtagaaaaatgttgaaaatcggtggacagaccaaaccgacaaataagttaggaatgcaggatgtgactgcccttgacaccccatcatcagaagctcctttgtttgacctattaaaccacatcaatctcaaacggtgttatcgtgtagcatgttataaacttcgtcttgctcttttctcattaagatttagattttatctcggcttgtattaacacgctattaaaactattaaccgatgtgttccgtgtaaaaactttctctatagaagttgctttaaaatatcaaatttatcaatttatcaagtttctaatagttcaaacataattaatcatgtgctaatggttttcttgatcattttatgtacgccaacttaatcttcatcttcatcagtttcgcctatggacgtgtcatgttatcttccaactgaaaatctataattaattgatcaatttaccattataaaaatatatgtggtgtagctgggagttagaacggtgatccatctagatgtaatggtccaaatcgatagtagagtgatccatatacaaatttttatgatgttaggcaacatacctaggccaagtctaattcccaactttttcttcaaacttttaacttttcatcacatcaaaactttcctacacacataaacctacaacttttttcttcaaacttttaattttagtctaacttctaattttggcgtggaactaaacacaaccctattatagttgaaacttgtgtcaaattttaggatgatccatggcccatggtgtcacctagatatctccgcctaaatatcgcagaaaaaaagcacgaaattaagaaaaggaaaaactaaaaagggtaatatatatatatatatatatatatatatacacacacacacacacacacataaaagggtgaagtgacatataccataggaaaaagtatgtaaatgttttttcttttctttttttttcattattaaaatgggggtttataagagaatctctaaatatataataaatgatgtgagtgtggagataatctttttgcatactgatatctcccctcggtcggcaggcttggtatcaatcttgggaggggaaaaatgacaaattatcagttcagttgtggctatcaccattgtctggcaatcatatatgttatccaaagagtattatacttcaatagttgagatgttatccaaagagtattattcttcgcgcctgctgctggcgcagccgcaacttggttctgttctgtcggcacatgacacgagctgagctagtgttcctgaaactgaaagatgtgagggtatatcatctcagaattctttcgactctgcattggtgtgatcttccattaattttacatcaagttttttttttctctattccagaacgtatggtaaaccctctttgcttgctataaattcccgtcatcgcgtccctgaatcctcgcattcaacgaacaacgactactcttgactccactcaggagcagagca

SEQ ID NO: 1531 - DNA, 1501 bp, Oryza sativa
gtttccaacctcacctcttcatcgaagcattagagcaggtacaatagcagactataagccagctataaacatataccgaggagataaaagaatagagagataagcagcgggctatatgtttgtagctagctgcagcacgggctccaatacacagtgtgtgtatgatatgtgggatcagatactaataatgtagtatatatttatagataactattttataagtcggctattaaattgattatatatgatttgaagctaggttggctatactattaaacttgctcttagtaaagcgaccagtactagtactaattgcttgcaggttctgcccagcttggacaggccggtcaatgcgcatgcaatgcaaatgcttgtagaaaaatgttgaaagtttgtaaaaaaaatgttgaaaattgatggactgatcgaatccacgagggatgaatttggttggatggattagatcggaaatagcccattaagttttgcacgtgttaatttgtcttgtgttcaagagttcagatggaatggacaagggaaaaaaaaaaggctcccgtgaagacctctattaatgcttatattgtgggaatatagggaataattgatcagtgataattagtatgttttgtttttaagaaatgcttatattgtgggaatatagggaataattgatcagtgataattagtatgttttgtttttaagaacttcctatgttccaagttttttttggtttgcttaattcaaacttcttttaagttcgatgaaaataaataaatatactgcttgctcatctcagaatgctggcatgcgactcaccagtcaccacggtgcgcgtgagaccagagtatccagacacctcctccagtactgctctgtctcccatgcaggtaacctactgcagcagcacaaacatgtcagaacccaccaaaatatgtttttcctgtttgtattccgtctatatcaaaataacttttatctattttcttactcattcgttaaagactttattttaagcaattaatgcattgagatctgataaagtcaagacaaatgccttgagacttgataaagttaaaataaatgcattcaaacttgataaatatgagaagaaatgcatcaagatttgataacgtaaggaacattctactcttagaatttgtatttgtatgtataacataggtaaaagataaaattattttccccgcaaaaaaaagataaaattattttgtgatagagatagcattccctctacttgataatatttatcgttttggacaagattattgtcaaactttaaacactttgactataaataacatctaaaatatttgtcttagaaaatatgaagactatatatatatatatatattagtcttaaaaaatacttcaataaaatgatatatttattaatatttctatatatatacatattaaaaaatagtgatcaaagttggtttttttttggagatcatatccttgtccaaacatcgataaatacaa

SEQ ID NO: 1532 - DNA, 1501 bp, Oryza sativa
gcatcctagctctatcggcgcaatgttgcgacgccgacgctcgtctgtcggccatgccgttctcttcttcgcggcggtcgcgctcctcgagtcgctggccgcccagccgtggccgaaatgcggcaacggcggcacgttcacagcagggagcacctacgaaaccaacctcaagaacctcgcgctcatcctccgcacgaacgcctcctcggggtcctcgcccaccctcttcgcctccggcgccctcggctccgccccggacaccgtctacggcctcttgctctgccgcggcgacctgagctcctccgactgcgccggctgtggcaccaacgtctcgagggacgcggtcgcggggccgacctgcaaccgcaccaaggacgccatcctcgtctacaacgaatgctacgcccagttctccgacaagggcgacttcctcgccgccaccgacaactccggcgagtacagcgccctccaaagcggcaccaacatcagcagcaccgacgtcgcgggctacgaccgcgcggtcaccgagctcctcaacgccaccgtgcagtacgcggtggagaactccacgaggctgttcgccacgggccagcgggtgggcaccgacccggggttccgtaacatctactccatggcgcagtgctcgccggacctgtcgccggggcagtgccggagctgcctcgacggcctcgtggaccagtggtggaaggggttcttgttcccgcggaacggcgaaggcgcgagggtctccggcccgcgctgctccctgaggtccgagctggggccgggccccttctataccggcagaccgatggtgctgttgccggtcaaggccgacgggctcacgccggcgccggatgttgtgcctgccattacgggaggtgattaattaaactacagtattatacttcctcgtctcgctcatgctgtcccatatttttcccgggtaattttgcacggggcttgattttaactgttaacttaaatttgatttatactcctcttagtttatgttacatatataaagggagaatagccaatatgatccctaaaattttgctcctagatcattttagtccttaatatttcatagtgtccaaacaagtcctttaaatttgtcacgtgggctaatattgttcttggtcctaccaaaatcactatatggacatgccatgtcaccctcctatgtaaaatctatatgatttgtctaatttactcttacgtatatcatagaaaaattagaaaaaaggaaaaaagttaaaaatatatatatggtatatgtaagagtaaaaatatacgtaaaagggtgaaaaaaatgggaaaagtatttgttcctatggttatgtctaattcacccttacattctttttctatgatatacgtaaaagtaaattgggtaattcatcatagattttgcatgaatgatgacatggcatatccatataatgattttttggacccaaggattattctaagccttatgaaaaagtttaagggtttt

SEQ ID NO: 1533 - DNA, 1501 bp, Oryza sativa
tagtagggtttcatttgcataaacagcatttaataaacatttcagaatttaataaaacagttaagtaataattaaacaatattaatccaacgctatacaacataccctgttgtataggcccaaccattctgaacaaccatacccggctgtacagatctatctccaaaccaggaatatacaattccaaaccaggagctaaacaaattattaccagttatagcatcttttatcatgatgagaggtgtgagactaatcacgaaagacattgttagacccgcccataaccgcgggcacggctattcgaatagttttactctggctagaggtgtaccactgtacccacaagacacagccccacaacatgtcaccatgtgcctcaataccaccacggtacctcggaaaggagctgtgacaatacccctcgcacaacacaatccaccacagggcaccttttctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattgattaacctaatcacgattgaccatcgtgaactatcattaagccatcattaaataatagtgagtcataagttatcccaatagtgtgctaatgtttctaagcatggctaagcaatcatatctaatatctagctgaaccaatatatatatagcccaactagtcaagttataataacccaaggtatcaaggaataaagtaatcaagaacaaaagggctataacaaacaataggttaattccatccaatgacattcgaaaataaatgcaatagttgaatagaaatagtagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatctgagctaagatgaattagttatgaatttttaaagattaaatcggattaaaacacttatatggattttaattgaattatgacgccataatgaattacttttgaaaaggaaaaaggaattattgcgtcaacggctagggtttgcggtggaccgggcgcacggcggcggttcacgggaacgaacggccgagatcgatcttatccaaaacgaacggccgagatcaagcggtccacgaccggatcacgacgggcggccacga

SEQ ID NO: 1534 - DNA, 1501 bp, Oryza sativa
gtatggaggcactgggaagaggggacaacagcagagatgatcgaccattccttgggaagaaactacaatgaggctgaggtggtaaaatgcatcaacatcggactcctatgtgcccagcaaaaccctgtagatagacctacaatggtggatgtcatggttttgcttaacagcgacgctacttgccctctaccggttcctgcacctaggccaacatcttcgattgatggaagctctggttactcaacaggttactcaacataatggtctggttggtagctgggagctagatttgtcaccgatgttgttgctttctgttgtttcatattgaaactattcattctcgatttgcaatccgtagcatccaacttcaattaatgaagagtttcgggggactattactcctcaggggttatatatagtttaactagttgataccccgtgctttgttgcgggatatgtgaatgaatgcatgttatacattataaaaatggtaaatgtatatgtttaaataatgtgaaaatgatgagtagataataatttgccattgcttgtatattgagttctaataatacagcaaaattgtaaatgatacgtaatgtttgcatgatatttaaaatactctagataataattgctagtgtgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaagttgttagattcaacctatatgatgaacaaatagtcaaaagtgagtgttttagaaattatggtgaatactgttttcgcgggtaaacagtgcagggtggcactaggttgccggtcagatcggcagattccgtggggagttggtttcggattgttttcgtggaatttctatgttacttcatgtttatgacttctagattgtttctatatgtatgtaatattgtttgtgtgttgatgtcagtcaatttagtgtgaacttgtactcaaatatggtatttctttgttagttcatgtgcaaatattgcttgaggccataggagtatagccagtgatagattaggactaggcttgggagaagctgagatccaaacaatcaaggatatcacgcgggatgtctaggctagagaacaatgcacgtggagatgaaagtttccatatatcatacacgaggtgttgtgcaagtatagaaagagtagtcaaatttggattggaatccaagtttggaaagattagagtgtggagttgtacggggatgttgtttctctggtttcttagatttcctatgtgattagaagtctagttctagttggattcctagttaggggcattcacgttatggtataaataaatagggcatatttgtcac

SEQ ID NO: 1535 - DNA, 1501 bp, Oryza sativa
agctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattttttaagccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgtcggaccggccttgcgcccggccgcacggcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcgagcgcgactttaaggtcgccacggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccatgtgtgccccggcgtcacaccgatgattggttgagacggctggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacgcgctcctccatcgacggtggcaatggtggccccaggttcttggaaacctaggtcatcttcaccatcat

SEQ ID NO: 1536 - DNA, 1501 bp, Oryza sativa
ctggagcgcgatcggaggccgtaaaccccgcaattaccaggcgttcggagccgcggtggcaggggcgacgggctgctgctgcggcggcggcggctgtagcgccgcctgcggaggagcgggcgtcgtccagtagaagcctccggcgggggcggcgtcgaagccggcggcggcggcgaggtcgtccatcagagggcagtcgaagacccacgtggagccctccggggaggccatggctgcgggggggtggggccgctcaccgtggccggcgacggtggccggaggaggctagggtttcgaggtcgcgaggagatttgggggcggattcggggcggtggtgcggtggtgggctcggacgccgagataaggacaagcggaataggagcacgaggtgaacggatacggactttgggccagaccgtaatgggctgaatggacataggctttggatgatggagtgatagtgctacggcaacttaaattttgtttcatgagttggttctgaaatggagttggaaagaaagtttaaacccagcttcacatatctaatttattttgtgatagcgttacatctaactcttctctcattttagatggaactaaaattgtttggctgagctccagctccacgctgtgccaaacaagcccttagcttaccatacctccgtcacaaaatataacaagtagctaaaaattgttacatcatgaaatggaggtagtaatagagacgtagagcccaggagagtgtttttgctcggataaaaggtgaagtatttattcttgaacagaagaaagttttttttctgaaaacagaagagagtgttttgtgttttttagtgttattaaagaagttgtttatagggataaggtgtgcgtatgtgtggatttataagggtgagtatatgtgtttcgggaaaaacaaagaggttcggccaattagtttaaaaaagatataagtattgttttattttaagtatttttatcttaatttatattttgtcatactaatagtttttcttttacgataatcatcttcaatatttgggaaataataaagacatcctctaatttgggaaaacatcgattttattttcttcaggtggaattgaaaaatggggaagcagccatcctctgccatttgctcgcatgttgaacgcacacccttactgtagctatcactgcacaaagccaaaaccaaaagcacagacaacaacagctagtagcttcttctgaaccctcaatattcaccactagaaaagcagaaactgaaatggtatgagcctcttacttaacgggagaaaaaaaaaaaacacgcttgagagctcacgcaaaccacaccttcatgaacacctgctcaattcttcccaacacacatcgccaaaaaggggacagatttttgtgtcacgcagatggcatggcacgccaagtcgccaacgatatatgccgagaattcaccggacaaagccaagaacatctagcaaaaattttcaaatttggacaaaca

SEQ ID NO: 1537 - DNA, 1501 bp, Oryza sativa
gacgccgccgcccggttgccggcggtggaagaagaggagcaggagacgccgctctgctccggcatgtccatcgttgctgcagcctgaccggctgcgacgatggcgacgaggttgtaatcatgatgggcagcagcgaagctgtccgggctatgtttgtccaaatttgaaaatttttgctagatgttcttggctttgtccggtgaattctcggcatatatcgttggcgacttggcgtgccatgccatctgcgtgacacaaaaatctgtcccctttttggcgatgtgtgttgggaagaattgagcaggtgttcatgaaggtgtggtttgcgtgagctctcaagcgtgttttttttttttctcccgttaagtaagaggctcataccatttcagtttctgcttttctagtggtgaatattgagggttcagaagaagctactagctgttgttgtctgtgcttttggttttggctttgtgcagtgatagctacagtaagggtgtgcgttcaacatgcgagcaaatggcagaggatggctgcttccccatttttcaattccacctgaagaaaataaaatcgatgttttcccaaattagaggatgtctttattatttcccaaatattgaagatgattatcgtaaaagaaaaactattagtatgacaaaatataaattaagataaaaatacttaaaataaaacaatacttatatcttttttaaactaattggccgaacctctttgtttttcccgaaacacatatactcacccttataaatccacacatacgcacaccttatccctataaacaacttctttaataacactaaaaaacacaaaacactctcttctgttttcagaaaaaaaactttcttctgttcaagaataaatacttcaccttttatccgagcaaaaacactctcctgggctctacgtctctattactacctccatttcatgatgtaacaatttttagctacttgttatattttgtgacggaggtatggtaagctaagggcttgtttggcacagcgtggagctggagctcagccaaacaattttagttccatctaaaatgagagaagagttagatgtaacgctatcacaaaataaattagatatgtgaagctgggtttaaactttctttccaactccatttcagaaccaactcatgaaacaaaatttaagttgccgtagcactatcactccatcatccaaagcctatgtccattcagcccattacggtctggcccaaagtccgtatccgttcacctcgtgctcctattccgcttgtccttatctcggcgtccgagcccaccaccgcaccaccgccccgaatccgcccccaaatctcctcgcgacctcgaaaccctagcctcctccggccaccgtcgccggccacggtgagcggccccacccccccgcagccatggcctccccggagggctccacgtgggtcttcgactgccctctgatggacgacctcgccgccgccgccggcttcgacgcc

SEQ ID NO: 1538 - DNA, 227 bp, Oryza sativa
tctctccctctctcccactccactcctctcctctcttttcctggccggccagtggctacagcaggcgtcggcaggcgatacggcggtagcgctcgcccttccctccctctccctcggttgtgggcgggaagaagggcggtgacagcaagctagggcggcagcgggcgaccacggcggcacgcgacccctcccctccctcgccttgcagatccggccgaggggaggca

SEQ ID NO: 1539 - DNA, 1501 bp, Oryza sativa
tttaaaaaaaaaggcaaaattgtttaaggagcaaatccccccagttgagacgttgcgttgttctttactcgatctgctcaagagggaaggagaggtatataagggcgaggtcaaatgtgtcgttcttatttagaattggcacctatgtctgatagcttaaaatggtgtcacttttaaaatgggttctccaatgattatttcgatttggtaaaaggtgagcccactcgaagaagtcgtttgttaataaaaactggttgtgccggtttctattaacaaccgtcacatagatgccggttatctccaatggtgtcccgcggcggcacgcgagaaaaacaatgtttctagaattttctacacatacagtgtcaccctttttttattgtaatagtgaacaacacttccctgttattaattagtttgttggctgatcaatgtttatacattttttttttggaaaaaaaaaagactttcaccctgaaagagctggaaagtataaaaggctagtatatattataccccgtactatatactcactaggatttgtgcagtgatgttgtctaggcccgttccggcggaggcgaagctgacgcccgacgcgagctggtggatgctgtggctggggtcaaggtacggcggcacggcgggcggcagccccagcgcctcggagacgaagtcggcggcgagccggccgttggagaaccggccggtggccacgccgccggcgaagtcccgcccgtacggcgggtagttgcccctcgccatggtctggatgaagttgttgttgcccgtgtccgccgtggagtcgccgaacacgatcaccgccgggacgcccccgccgccgccggcaacatggcatagcaggacgtgcgcgatcaccaccaccaccaccacggctttcatgccatgtcgtcgcgacgacatcttaattagtactcccaaattaatttttctctattttcgttctgggattcgtcactggctacgtgcaagtatttatagtgtcgtcgccgcgagcgacaagggcacgcgaacgatgagccgggcttgttgttcatccgtctccgaggcgtttgcttgctctacatgcccctagctgcaaaattttggtaagttctagtacagattactttttatctaatccgatttcatgatgcccagaagattgcatgcatgcatattgatcaatcttctgtgttaggttaattaattatgtggccgagcatgagcatgcatggtagccagaacagtgaccatagacggtagtagtacgtagtagtgggtagaccatctgatgatgctacagcaaccgatttttagttattggtattgatccactgatttcggtggatcattcaatgtgcgagctagcgaatcagatcgtctacgcttaattagacgtacttcatcagcgccgcgttgtaacttaaaggtcgagctgatctttcattactaggtcctgctataagttaatttagcaaatgtgcacttcttttgagttttg

SEQ ID NO: 1540 - DNA, 1501 bp, Oryza sativa
tcttcgccttcaactccagaatctcctgttcgactttcagctctatctggagctcgtgggggttcaggttcctcggaggagactgtacagttcatgatggtcaattctctgctgtctgagtcctatgagagttggctgcagcaccgccccgctttcctgcagaggggcatctaccatgcttacatgcaacacaagcatggacgatccaccctcaactttctgccgacacgtcttcctctgcagtccgatcagatgaaggttcatccgccgattcaaacgacagcaagaggctctttgccattgtccagccgatgctggtgtacactggtttgattgagcagctgcagcaatttttcaagaaaggcaaatcgtctggcacgcaaaaggtcggtgagaaggacggatcaagtggtggtaacctcgaagcttgggagattatgatgaaagaaaagctggggaacatgaaggagatgctaggattctccaaagacgtgctctcatggctcgaagacatgacctcatctgaggacttgcaggaggccttcgatgtcatgggtgcgttgccagatgtgttctccggtggccacactacatgtgaagactttgtccgggcgatcatacacggtgcaaagagctgaacgaagttttccgaggatctacaatttgtgttgaaactttgccacgcgcctgtatgtttgtaaggatagtcagcttttgtgtggcagctgtaaacattataattcttccttgtaaaatgaaactgggcaaggtttgtatgctagcttttgtcctggcatttaccagcctccattcacattccttgctccacctgcaattgaagaacatgaaggtgaaacaacgaccgtaaatgaagttattgacgacaagagcctgtctagcgtcaaaactcaaaagaagtgcacatttgctaaattaacttatagcaggacctagtaatgaaagatcagctcgacctttaagttacaacgcggcgctgatgaagtacgtctaattaagcgtagacgatctgattcgctagctcgcacattgaatgatccaccgaaatcagtggatcaataccaataactaaaaatcggttgctgtagcatcatcagatggtctacccactactacgtactactaccgtctatggtcactgttctggctaccatgcatgctcatgctcggccacataattaattaacctaacacagaagattgatcaatatgcatgcatgcaatcttctgggcatcatgaaatcggattagataaaaagtaatctgtactagaacttaccaaaattttgcagctaggggcatgtagagcaagcaaacgcctcggagacggatgaacaacaagcccggctcatcgttcgcgtgcccttgtcgctcgcggcgacgacactataaatacttgcacgtagccagtgacgaatcccagaacgaaaatagagaaaaattaatttgggagtactaattaagatgtcgtcgcgacgacatg

SEQ ID NO: 1541 - DNA, 1501 bp, Oryza sativa
gcttttttgacagccctacttgctcgtgatcatttcacgtacacgtttaggttcattggttgtgctccattcaaggagctaagtgcctaagacaaaattagactacaagatcaccggtgttgtaagcttgtgtacgtgctattggtttccctattcctctctccgacacagataggatcgaaaatttggaaattgtggtaattttggtttgaattaatttaaaatgttaatcaaaatttgatcacatctaaaataaattttgctaaattctattttaatgaaagattcagaaaacaattaggataaatagttcctgtcagaaggggtgacaaaatccataacctcgggcagtgtttgtcaaatggaaaaggaaaatgatttcccacccatctttaaatcctaaccattcattctccctcttctatttaatcctaacccttcgttcatttccctatctcaaccccacccctcatttcccattatccaaacacacccttgatggtttagatcttgttggctagtgggaatcaaccatacagttcagggatacatggaaatgcaaaacagtttgaatttttaagttactagtaaagtgactgtgcgttgcaacgggaaatgttgtatatcaatttcaaattatattaagtgaaaagatattaaataatcattgagtgaaaatttgttgaacataggaaaaaaaatctggcaatcaaagaaactagaaatcataatagttatgtagattaatttcaagcaagaaatttgttttcattacagaagcataatccaagctttttgtcgcataaaacaatcttacagtgtttattaaattataaaaaggcaacataggtaaaagcctgctacgaaaatttgatgatgtcatacaaattaaagcacaaacattaaatctagaacattaaggattttcagatatggtatttctcatggatgatcacctcaaattaaattattctatataggtaaataactaccctaatattgtgtatttgtgatacacttaataatatcccgtgcgccattaggtatgttgctttcacactcattttgttggtacatcagtagatttagcaaaaaaaaattgcattagcttgtcaccatcctgcacatgtattttctttgtaagttaaatatttctaattatatgatataatattcaaatgatcaatgccagtcaggacttacattaatagccggcaaatgtaattcttcatttttccatgtacacatgaagagatgaacaagaagacccgatcaatttccccctcaatttccttaattccctttttcttaggaattaaacaaacaagttcttaaggtttagatgggttgggaaagggttcatggcttctgatccattaccgcccctgctctctaggcataccgcgtgcatacactcgccgcgccggcacgccattcccttctcatcaggtcacgcatcacgctctccccccttcttccgccccttcttccctaaaacagg

SEQ ID NO: 1542 - DNA, 1501 bp, Oryza sativa
agacacaagttgagagaaagttagggtttcaagtttagttcgagattttggtgaggagtgctgttggtgcactttgtaaacactagttgatgcaataaagtcgaaaagtttcaatctacatcttcgagtttgtcatctaccggtgtttctgggtcccgacggtctaaccggaggggtgtgcgcggtctgactagtgggatagcggcggtctgaccgtaggtgttcaagcgatctgaccagcgaggtgttggcggtctgaccggcggcaggagggcggttcaaccggcggcgactggacttcgtcatcgacttcgttcgagggtaatctttaattccgcaaaagattttgggtttttgattttcgctaccattcatccccccctctggtaggttcgtttggtcttgtacgatcctacaggttccaccgttgtggatcatgtcaacctggccaaagccccttccacatgtccaccccaaacctgctcatagagccaccctacagtctttcatatagtgagacaatgtactaggctaagtttgattactcagtcctgtggatgggcgcaaattacatcattttccatggcataggggtagtccttatatccggggaaaaccaccaaaactagcacaggcccgtgcatacttcaagtgtaaatatacactttccacaaaataattataacaacattgtcacgcccagaaattcacgaaccagaatttctaagctgaatgtgcattaaatccctatccaggaccagccagggtacacaaacgacaattgttgacctacagatccacgttttacaaaaatagaaaagattacaaaatgcagcaaaaaagataaaacgagctagacttggaaacttgacttcagtagcggggcgactccactccacaggcaaaccttgacggcagcgacgaaaccaactccaacaggacagctcccactaggaagatcttcagctctggtgtgggggaaaagaaagcaagactgagtactacccactgtactcagcaagtcataccggaagaggaggtatgatgcaggatataaccaaaggaggctaaaggttcttgtgcataaagcaggcatttcaaagcagtagttgaaagcagtaaaacagtagtagtaattaagcagtattaaccaattactgtctaacgctacaccacgttgcaacaggcccaaccaaccacctgaactacaccagttcattaaactaaactcggggtgagactaatcacggtgaatctggttgatcgcccataaccgcgggcacggctattcgaatagttttactctggccaaaggtgtacaactgtacccacaagacacgattccacacatgtcgccataccccgaagtatcatcatgatactgcaaagggggaaatcgtgataagaccctccacatatccctcccctaaccatccacaccacgctaaggtttcacccccacccctcaaaaggcagtgggcggtcccctcttgcgccgcga

SEQ ID NO: 1543 - DNA, 1501 bp, Oryza sativa
aaatcaaaaacccaaaatcttttgcggaattaaagattaccctcgaacgaagtcgatgacgaagtccagtcgccgccggttgaaccgccctcctgccgccggtcagaccgccaacacctcgctggtcagatcgcttgaacacctacggtcagaccgccgctatcccactagtcagaccgcgcacacccctccggttagaccgtcgggacccagaaacaccggtagatgacaaactcgaagatgtagattgaaacttttcgactttattgcatcaactagtgtttacaaagtgcaccaacagcactcctcaccaaaatctcgaactaaacttgaaaccctaactttctctcaacttgtgtctctctaaaaccgatcccaggaggccacccctccctctctatttatacccaaaacctcctactcaaagtaggaagtaggagaacaactcctagtcacactaggactcaatcctccaaactctcgaactgcagccgcaggaaaccaatccgacgtcaatacaccaccatctccgtatggcacccggtctcgatctcctgcgcacatcccaggccagctcgctcctgctgcttcctcccaggccgagctgcctgctgctgcttcacccaagcagcacacacatgcatgcaacgacatgcatatgcaccacacacatatatgctgctactgctcaccacagtacgcaaacacatatgcatactacagtaacccaaagcactgtagcaccatatactcctctccagtttcttccaatctccttcgcgaacaccgatgcttgcacgcacacctcgtgaagcccgttgcgaagatctctcctcatacgatgtccatccaccgtatgccatctcgtatccaacttcgtcaaccggtatccttgaccgtctggacctcaactcctctctgagtctagtcccgatcctcaccgttgaccgaagttgacctcaaagaatcctgactctagtcaccttctcacatggtatcccgaccgcactagacctctgtttctccctgaacatagtcccggtcctcaccattgatcaaggctgacctcaagtcacctgcacataatcagacaaaacaaccgtttctgggcacagatatcacaacctgtcccacattagtcacacgcactcacaccaacattcacacatattttcaaaccaattcaacgattaaatcatttgcatagccaattgttcatcacaaatattacagaacccgtgaaagcagcgaccgtctagccttgcttaggcccagcaagtgcccgactgctaggacggatcaatatcctactgagcagtaactagtagtaagtgggactctcgaacgactatgttgtcctcagcctagctagttgttgacatcaggtgggtaaagctgggcagtctctgcagagatgagtcttaaatcattcgaatgtgtcgtgcttccggttaagaagctatgtcattgggtgattcctatttatcatggtatgagtaga

SEQ ID NO: 1544 - DNA, 1501 bp, Oryza sativa
ctggcgtgatagtccaaagctggattctctaggaatccactggtccttccaaattccatctccgattctccaaattaagcctttcttaagtaactcaaggccatgttcaacagctttccatgtaggtgaggtatccgatgggaaaacagcatcaatgagatcacagttcggataatatttggcctttagaattctcgctcaaagactgtcaggatactgaataagacgccaagcttgccttcttagtaaagcctgattgaacagttgtaagtcccgaaaacctaatccccccatatattttggtaagatcaggttctcccaggctgtccagtgaatcttccttttgttttcgtcatctccccaccaaaagtctcttatcattttgtatattcatcacacacagtagcaggcaatttaaatactcccataacatatgtcgggatagcctgtgcgactgatttgattagaatctctttagccccagacgacatatatttttcagaccagtcagtgagcctcttagcaaaacgttgcttcaaagttttgaactttccagccttcatcctaccctccagagtaggtaatcccagatatttcgtctcaaaaacagttgattcaacctgcaaagcctgtcttatattctcccgtagctcatccgggacatctgcactaaacaacagagaacatttttgaaagggtcaattagccctagaaggggagtgaataggctaatttaaaaacttaagtaaagcggaagcaagaattttcggaactaagcaagaatttttggaacttccgaaaatactcagagcagtcgaacaaaagaggataactctagatcaatagcggcacaagcaagcaaagctagaggagagggatgaagaaatatcaccaagatgaagctcacaaagttgttcccggagttcaaatccttaaggggattctactctctattgaagagctcactaagagccgggtcttagctaaccctttcctcaagaggttgcactaagcacccctccttccactaagaggtatctctttccttgcggaggcgagatctggcattcacaaacttctcccggccaaccacacgtagatcagtggctcgggagcaacacctagccgtctaggagtcctcaacctccaagagtaaaagatgatgcaaggaactcctggagatgatgcaagtgctcacaaatctttacgaagaccacaagaagcacccacacaaactcgaatccacactctcacacacacacctgtaggatcgagatgtcgactagagggggaggggggggggtgaataggcgatttaaaactaaatgacacctaatcaaaactaacataagttgctaggcttggtgagggtcaactctaactaagtaactaagttatgttttgcaaacctagggtgacagtggctcaattatatctctaggaaagtaaatcacactcctatgtcaatgtttagcaatcctagggtgatatgatctcaaga

SEQ ID NO: 1545 - DNA, 1501 bp, Oryza sativa
ggcccaatgacagccgttgtagagtagcacagtttgaccggccacatacctccggtcaaaccggcagagcacagagttgggggatttcgcccccaacggctagttttggttggtgggagtataaataccccccctccagcagcaaggggactctcttggcacccaattcaattgcatacaccccttgcacctctctcacacccacttgagttttgtgttcatacatctagtgtgttagagggttaattagccaagagtcaagtgcattgcttccatttgtagagctagtgtggcacttgattgatcatctccacgcagggtcattgcttgttattcttggaggttgccgcctcctagacggcttgtggaggagttgcccggtgatctctccgagaagattgtggaggaggtccggtgccggttgtgagtggtttggagttcaccaccttcggagtgaaggaagaactaccctagtgatcgaggcttgggtagtcctctccatgggccggctcccgccttgcccaccccttgacaaagggggcgtgcggtggcttcgtggttgagcggcggagttgggctcgcttcaacggggagtaggaaaccggcaagtttccgaacctcggtgaaaaatctctgtctccttgtctcatttgattgtcacatttacatttgtacaatttatatttttagagacattcttgagatcatatcaccctaggattgctaaacattgacataggagtgtgatttactttcctagagatataattgagccactgtcaccctaggtttgcaaaacataacttagttacttagttagagttgaccctcaccaagcctagcaacttatgttagttttgattaggtgtcatttagttttaaatcgcctattcacccccccccctccccctctagtcgacatctcgatcctacaggtgtgtgtgtgagagtgtggattcgagtttgtgtgggtgcttcttgtggtcttcgtaaagatttgtgagcacttgcatcatctccaggagttccttgcatcatcttttactcttggaggttgaggactcctagacggctaggtgttgctcccgagccactgatctacgtgtggttggccgggagaagtttgtgaatgccagatctcgcctccgcaaggaaagagatacctcttagtggaaggaggggtgcttagtgcaacctcttgaggaaagggttagctaagacccggctcttagtgagctcttcaatagagagtagaatccccttaaggatttgaactccgggaacaactttgtgagcttcatcttggtgatatttcttcatccctctcctctagctttgcttgcttgtgccgctattgatctagagttatcctcttttgttcgactgctctgagtattttcggaagttccaaaaattcttgcttagttccgaaaattcttgcttccgctttacttaagtttttaaattagcctattcactccccttctagggctaattgacc

SEQ ID NO: 1546 - DNA, 1501 bp, Oryza sativa
tggcgatgagtggccgagcttcgggatcacctaaggaacacaatgggaaagattagagagggagagagagatcatagaggacggggacgccggccgaaggcggcggccatggcgaagctcaccggcgtgcggtgcgaacggggctccagcggtggaggggctgacggcgtggccctcgggctcgcgaatccgatggcggcgatggcgcggctcagcgcagcggctagtggcgaccgaagctacggcggcggcggcggagaggagggcgactgtgctagggcgaaggagggcacgggggagctcggcgaaatggggaaaaagagagagggaggggcggtggtgcttaaataggggaagagggggctcggggaggctgggagtgggctgatttcaccggagtagtggggaggtggagagagggagcggggcgcggggaagacggcgacgccggcggcgtggcccgggaggtgcgggagaggcaggagcagcgatttcgggcacgggcggcgccagccagaggttggggacgggcccacctgtcggtgacccgaggggaggaggggctcgggcggccggctgatgggccttggacttcggccggcccaactggtagggggagggggaaagagaatgggccagcggcccattaggaaaaaggaggggaaaaagaaaaagaaaaagaaaaaggagaaatgaattttcagggattaaataattgctcgtgctcatttttatttggttaaaattatttctaaagctctgaaaattccactaaaaatcctgttagcgtattttgacacgtagaactcaagaaaaatttcacatgtcatttccgattattatttgcatttattaaattaaggtttctctcttgccacttcacaaataatttctcgagactatttattaattaatttagacttgggagaagaacttcggggtgtgacacttgctccctccatcccacgccatggcttcgttgccggcgagcagccggaagggaagaagaaccaagggtatttttgtgtgagatgtcattgttttcttttttgacgtaaacatagtggcattgtggcgatggcaatggcaaaatctcggatttctcgccgtatggtatggtacggcagacagagtacatgaaaagtggttttgctttgcttggtcgtctccaaattgaccatggcaatccaatcctattcttactcgggtcgggggtcagagcgcaccgcatatcgcatcatttttttcgggcaatccaatcgtataggtttccactacatactttcccatttttttcttacactttggttctataaaacgccgcacatgacgtcgaaagtcaccccgctatcgcagcaatccaaaatccccaacccaacccaacccaacccaaccgcactatcacgccactcttcgcccgcccgcccgccgccggaatcgccatcgcccgaccgccgccgcgttcgtgtccccacaggcggcttctctccctgcatcacca

SEQ ID NO: 1547 - DNA, 1501 bp, Oryza sativa
ttcccccggttcctcgctccgtttatatgcgggcgcgaaagtcgctcccaatcacgcaatcccgcctctctccttcgttcccacgcgtgggagatagcgatctttctgcgcgtgaaagaaaaaaaacggaattttctcttggtagtttaacgtaagggcccacttttaagttttgaagattgaatttaggctatctcttgaagagaggagttttttcacttcttattttcagtttaggaaaccaaaaataaatttttaggagaaaattatagataatctgttgatgatgctctaaacagtactatcaatgcaatttactcgtaaatgaacaaaccctatgtctcacaaaattttcttcccaaaaggcctacaggaacgcgctagctcttgattctggagcgattcccgcagcctaaccagaagccccatccaatccaggtcgaccagcgcggcggatccagagccgtagctcctcggagtccctgtctctgtggacgctctcaccctaatccgacgccgggcctctccgatcttccttcgccttgtgctgtggcttctcttccccctctatatatccctatcagcgagatgctccactcatggcggcatctacaacgggcttcccggtgagttcttccgtttccctacttctgtagctcgttctgctgattttttttcttttgaatctggattgggcgaactatgaatctagagtgtttaaaatcaaattcggacaaagttttcttaattccacattaaatctaaccggaagaaaaattgaaattgatatatattcgaagaaattaagttctcaatctgatacatcagcttatttaggtttacaattatttatttagcaggcttcatttgtagagtagaaagagattactgctgcgaaggttgtagcggtgctcgacggggaggcctcgccctccccggagccgtggtgtaagaaaggaaggaagtttgtagattaattttttcttgatttattccatcacgaactggccttctataggtgattacaatctgctaatgaataggaactaactgaaacaaacctcaaacattaaggataattcttatctaatgcgagcaacacatgatggcgagaacaccgctgtggcgcaccatgcgcacttactggtctctcgcattcctgcgacgttccaagggaattccccacatagcagatgatgatatatggtagtatcttatttgacccatacactagtcatttgtgctccttggtactaggttttcgtatggatcaacaacaaccagcattggagggaaaggggagaacaaatggggcaagccatttcggagcagatgcttcccccctcatgccaatgcatctttgtacaacactgcccaaggcgaccactgagctgtcactgaagagatgtatcgagcagagaagagagggggaattaatgggctcgttgttagccattccgctgttgacatgttctcgatgacaatcattgagaattcaaga

SEQ ID NO: 1548 - DNA, 1501 bp, Oryza sativa
cggcggcgaccaccagcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacgggaacggcggcgttccggcggtcggctggcgaaacggaggggtggacgaggtcggcgaggacgcggcggagccgaaggaggcgacgccgaggcgggagaaagtccgaggcgacgacggcggcggaccggagctcggcggcgacggcggagagagaggacgacggcgcgagctcgattccgacggggagagagagcggcgagtggcggaaacggaggagggaggcacggggaacgtttaaatagtgttgggagggggagagagcggccggatgagggggaatcggccgcggaagatccggccgccattgatgcgccggcgaaggttgcgggagcgtttccaaacgaatccgagggagagagagagggaaaagtggggggaaagagggagggaatcacggggagtgatttccccctctttattgcgcgcggggacggcgggaggcggcgggattcgcggcggctgcggcgctagggcacgggcgaggctgcgggagcggcgggaggatagggatgacaggtgggccccacccgtcagcgagggtggcgggcgggcccgcccgtcagcggcgcgcgcgcggggagaggccgagtgggccgcggggaggagagagagggaaagagatgggccgagccggcccaagagggggagggggggaaaagactttttagggtttttctttttataaaatcattttaactttgtttatttcttaataattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagagaatgatttttatttcgggatgaatttatcaggacgtgacactaaaggagtacctaggctatcaaagggacaacttcaaccatgagggtcttgggtatgttcctccaccaaaagggaaggtggacaagagtgtgatgatcaagaggccgcaaggtcttagcaattttgttaaggccaaaagtatccttcctaatgattatgcttgacattgttcttttgatgcatcttatattcttaggaagaatgctagtggtcgtgttgttgctaagtatgtaggcccaaggggcaagaatatttctatcaagagagtactttgggtgcctaaggcacttgttactaacatgagaggacccaaacaagtatgggtacctaaaactagaaattgatctcttgtaggaatatgtctccggtggaagaagttgggtgattgatagtggatgcaccaatcacatgaccggagaagaatcaa

SEQ ID NO: 1549 - DNA, 981 bp, Oryza sativa
cacctggaacaaaaaccgaattatgaatcaatttactgaactacaaaagcacgcgattaaccctaattctcacttgaaaccgtaccctaaagagaagaattaggttttctgatcagctcctatatatctccctcctatattaagtaaacgagcagcccaacagcagcccggcccattacaaactaaaaccctaaacccaacttttctgttccacgttggtccaacattctctcaacttgatccaaacattaatccactccataataataattattctctaacaggaaaaaaaaacggggtgatggcaagcaggtcgtacggctgcgaagaaggcggtggcgctggcccgcgatacggcattttttttatatataattttctttttatccatgagcagattgttcagtttagtgttaaaatgtaaactagaattcgtatttgaaatgtaatgtatgctgtatgcatcggggactaatattaatttcgggttacctcaattcgggaaggttaatttcaaaggaaaaccaccattccgttccgagaaaacgtacggaaaaacggaaacagagagctatatatattcgcacggcgcacacaacttgattgcttaattcacattcatacgcagacgcgttggccggggagaacggcctcgccgagcgcgatgaggcaggtcatcgtcggtccatgtcgtcgcggcagccaacagcacggcggctctcgcccaatgttcggaaatttcgccccccaccgaaatgctaacatctcatccgaaaattttggttttttgcaattcttttatgaatttggtcaaattttattcaaaatccgtcaaaaattcaaaaaatttccatctatcgctcagctacggcagaaatgttgatttcgaaatttaaaaccctgctctcgccggtgtcaaggtggagaaggggtaggcaagagagggatagagccgtgatgctcctgtcctgtgcgccaagg

SEQ ID NO: 1550 - DNA, 1501 bp, Oryza sativa
acatttgaggtcaaatagtagtatttttttgcctcaacaaattgattgagaaatgagaaaaataaaaggaagagaggtctggtaggaaaaaaaataaagaaagaaagcagagcacgagaacagataagtcataagtccccattttcactttctccttcactttccccaaatccatccgctctcatcccgtgtcctttactgctgtctagctgtctcccccgattcaactccccaccaccggtcacctctagcatcgctgtgcttcttccctgtctgctaccccacacaacaatccttgagctccttccctacttgctgcgccccatcttcctctcgtggcggcatccggttatgcatctgggctacagctcagctcaagtagttgacgggggcggagtggcctcggcagcggcgtggagtggattcgacggtgatgatctgcttccgagccaagtctgatgccgtgcacggccgcctcctggttctcttccgcacgcagccaaggccacgacagcgagcctcaaccttgcgtggcccacgagaagcaggcgcaaggccggttcagggtgacggctagggtgcgtgcatggtggtgctaattctgtgctcgcatcacatgatggcggtgatttgccaaattggtaagccatcaatctgatttgcttagggatttacccagaaatttgagttctaaatttgggtattttttcgttttagggttttgaaatcatgcaacgtgcggccgaagatagaaaccggtgagacaatgattctggtggctggagttttgctttatttgggtttgggatctaattcgaggaaaatttggaatttagggtttgtgcaaattgggtattttttctagaaccaatttttgtatttttgtatgttgtatatatgcaagttgtcctagtgtaacacgaaccggtttaaatttagcccaatttatgtaaaatcctgatcggaaccgatttggtgcggacttaggattaccttgactttttttctccatgtcaaattgaattggatctctgattcttttgtgcattggccagcgtatgtgatgaactcatacggatacggacacaatcagggacgacgcacgaaatttgtggcaaaaacatgttaaacttttataataggaaaagaagtagagaagagatagagagaaatagagatgggcacgctataaataaaactataaataagttggtcgaatttccatatccgtgcccgacggaattgcatcctgacgaccaaaaattataatctgatccgatttgtagtgcgtacgtactctgaattctcaaataggcatagtccgtggttaccacgtgaaaattattcccatcttttctcctcgtcaaggaataatacgattttcaacatttgcaggaacaaatcacaaaacatatcctccgcttacattgcccatcgtttcgtttctgcccccgacgaatttgatttctttcctcgatcctcctcctcgattaatctggtt

SEQ ID NO: 1551 - DNA, 1501 bp, Oryza sativa
tactctctatataaatagaaataacttaaacactggtattgcttgcacctattgtgtttagaattaacttttgggtaaattcacatacctaacttgcacattagactaggttttgcaaatcagtaccgagcttgttttccagttgcaaaatttgtaacaaaacttgctccaagcgataaacttttttcaagatccaaaccaaagtggaacaaaggtagaaaaaatcaattcattgtgaaatttgctattatttttccaggaatactatttgactggagtaaattttctaggatgtctgtatgttatgcctaagaccacccttgcagtaggataccgtctgctttgggttctttattatattatctccttcgagggttttttaggatcattcaggctatatttagtctattttggcttttacttccttttctcagggaagtggttaaagacctcagaagcagatttctgctgctcattatatgtccttgttttctaagagccatgcatattgagaaatgaaggtgaaaattggaggactgagtaagtgagtatttctatttgatcagctagtgcagccccaacagtagattttttttatatatatgccaattttatgattccagcctaagaagctattgtgaaacattgaacgtgctgtgtttgtggcaacttttttcttctccaaattttgttttattaatctgagtattctactactgtatttgagttaatctattaaatgcatcaaagtgaaactggggcaagttgatgctgcctttattcgttcagcacaaatcagctattatcacctttggtcctttggtaagaattctttcaatgtttctcctggaactgtgcttaattttggggtgatgcaagtctgtaacaccattgcccttggcaaggatgaagataccaacatgtctgagcattttttttttacttaatacccattttggacaagataccaaactcttgttagttctgaaccaaattcttatattgattttctatagcaaattacctatttaaaccaattaaatcaaggttttacttaatccaaagatgctctaacaactctacttctagtactccctctgctaatgtaatcatgtttaccttatgtcacagcctactttcaggtgatcttcacttcttcagcatatcatgaacaacataataacctgaaaaagattgaaacggcatcattaatgataggaagaaataaaattagtcatatctgacgaaacatatagtatcaattcccgtgtaagaacaatatgtgcacagtagattaccatgtagcactaaataagaagattagggaaaattacgacaggaaaatcctaagcaaaacagaagactattccaataaaaaggaaaaacagaatctggcatatactgttcatttatttgtattttctcaaaaatatccgggatacaattttttttggcagaagtatgcgtcacaactattgcgcaaaaattacatggacatgaa

SEQ ID NO: 1552 - DNA, 1501 bp, Oryza sativa
ttaatctataattagagaatatttactgtagcatcacataggctaatcatggattaattaggctcaatagattcgtctcgcgaattagtccaaaattatggatgggttttattaatagtctgtgtttaatatttataattaatatccaaacatccgatatgatagggatttaaaagtttagtcccatctaaacacaggtcgaagtctcgcataaggaaacagcgatacagaacagtgtcgcataaagaaaaagcgatagaatgtcttgtccaacggtgccgcttaattagtgattaattatcctaattaaattaattaataataattagttattaattagttgctaatcaatgtgattaaacattaaccattgcccctgttggtgagttgggcagccatgccgtgcggtctcgcaaatgggctgtgcgagaccgtacgctcccacccaagctgcgcgtcgtcactaaagtttacaaaccgtgcggttatcacgtgcgataattttcttaatttttgaaactatgatatatctcacggtaatcatacggttttcacgataattatgtggtaaccgccaaaccatggggtgacggtatccactcaaaaacggtttagagaaccctagtcatcagtcgtcaccccatcattctcacgcaatgggtcagcaataccatattgctttcgtcagcgacgaaggtatagttgtgctaaaaattttcatcccgaatatttctgagaaaaaaaataaacaatatatttttaaatttaattcgcctttataaccgtaaggcctttttccttttctgaatggggttaagttcatgggccgcctaattgggtcggcattaggccatccaaactaggcccaaaaaagggcaaaaggcatcgtgttggtccgtctccgagttgtttccctatttgggccttctctcgtctccgtcgccgccgccttctccaaatccccttcgcattcgatcccctcccctcgccgccgtctcctccacctccgccgctcgccgcccgatcccctcccatcccctccgccccgccgccccgcacctagatatgccgtcgtcgtcgtcggcggcggcggcggcgtgcgggcccccggagttcacgccggggtggaagacggtgtcgacgtgcgccccggacgtcgtcggcgagggcgtccacgtgttcgacatcttcgggtacagcgaccacaaggggatgggcgcccacgagcccatcaggtcgggggccttctccgtcgccggcctcgactgggtcgcctgcctctacgccgacggctacggcgtcgccggcatcgacgacgtctccgcctacctcaggctcctcggcgacgcgcccaccccgcgcgtgtgggtctcctgcgaggtcaagctcgtcgaccagcgcaccggggtggcctccacgccgcagcccttcctcaggtacgccctggcgttcggcgacaagtgcaaggccctccactgtatgatgatccccaggggccaga

SEQ ID NO: 1553 - DNA, 714 bp, Oryza sativa
gctagtcctatttatccctaatttagcctatttcctatataaatttcattctataaatcctaatttttgcacaaatggagtttactcaatatttgtgctattttaaccaaaagattcaccctagattaattttacccatattttatttttatataatttatttgaatttttaattagggccaattcttattccatcgcacttaaatttaattgttaccaatatggttgcgataatattttatttatttctatcctcacctaatctttatttaaaattatatttcaattatttattttgacaatttatttttagggtttattcctaattaattattccttactcacgattaatgaactccgaaatcaaatccaaataaaataggcgaataaaaccggcatgatgcaatttatttaaaaagtttttgaaggtccgtatttttagggttttgattttgttagtcgaattttcagcgtgttaaaataccggggatatataaagaagaatatttcattaattcagaaagtactacagaagagattacaaaagctgctagagccataccgaaactcttccgaagactccgagggactccaaatactattctatttctactccacttagcactaaactattaatactaaagtatgaagaggaaattgcttgcttgagtgtgtgttgaagtgaaatgagctcctctatttatagggccggta

SEQ ID NO: 1554 - DNA, 1446 bp, Oryza sativa
ctttccaaagcgatttaccaaagattcccaggagaaaggtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggca

SEQ ID NO: 1555 - DNA, 1501 bp, Oryza sativa
ccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggca

SEQ ID NO: 1556 - DNA, 1501 bp, Oryza sativa
atatcaaattttcacaactttgcagttgcagatattagtgagttaatattttgatgtttgacaccatatatacatatttaaacgatatatatttataaacgaaagggagtatcacattaagttcttagacccggctgaattcaggagaaaaaactctgggcgtccgactagtaagctacatgcaaacatatatattgtaccagccgaattcaggtatatggcttatatgcactgggtgaagaatcatacattagtcaaatcttatcctcctaaatatagttggatacttggatatatacagaatgttcttgccatagagacatgtaaaaataaatgaatgatgcatacatgttatgttttttttgacagagtggggcttgcaagaggcctttacaggctaatgttatgttaatggtattttatatttttcaaaagtgatttttgaatatatttaaaatacagattgacatttgtctatttgtctatataagctttttgtaacataaagtttttaacagaatgttttatctgaagaatttgttagtgtccatgtgaaagttttttttaatatcgacggtaagtatatttagcaattattcttaatgaaatatgttactacttttaatatttctacccacaattttttattctttaattcctaacaagtacatacgtccagatttgtaaccatgatttgattttttatgagacggatgaagcatatggctatgttcggttcatattgctgcagtcacatcacagctaaaatgcccccacgcaaaagaaaacatagcagctgcactgtacaaccgcaacaaatatatatcgaacacaccctctatggcaaatctttcaattgtcaagaaaaccaaaattttcgaacaaactccggcgctcaaaaagtggtgaatttaactatttgccactctagtcaagtagccactctcgcgccatctcgcttagacttcaatgccccacggtgatagaacacggcccactgtctcctgcatgcgcagcgtgggccgaagctaacgtgatggcccaaaccatagacccagtcacaagtacaaaagctcaaatatatatgacgttgtgtattgcgaactaatccataaccatgtaaaacatgtcattttattagcagattaatcaagtattcattaaaaaattttaaaaatatatattaatataattttttaaatcactttcttatagaattttttgaaaaaaaaatataccatttagtagtggggaaagtatgcgcgtggaaaaccaacaagtagaagaacacatgttgcaagtgaaaatatgaaggtagcgttagccatgttgcaagtaaggtcaaaataaattgaaatttgcattaatagttaaatattggcagtgaaatttactcaataaaaagttttcaaacaaactcgcccaaaattaatggggcgggacggcggtggcagccgtcggcgcctcccgaggccgtcaccggcggtgggtcccagcgcga

SEQ ID NO: 1557 - DNA, 1501 bp, Oryza sativa
gtgctagccttctcccggatctgtgtgttggcgctgtcggtgtgtgggtggtagtatattttttttcctttttcctggttacgaccttccaaggttgtaatcttgtaattttttcctgctctatcaatagaacttcgcaccgtctcgttaaaaaaaaagcggcagcaatctaaaacaaaccaaacgccaaaacattgcatggggctagcaagatcaatcaactcgtattctgttttgtcttagagcagctcctctctccttaaacctctttaccagcttctctagatcactcttcatctccagccgatgcaaaggactccactgcaataagaaagagacaatttggaaaggtagtattaggggtgagtaaacaagtttatccctgaacacgatgttgtttctcgttgtccatatatagagtccagcaaatggcagcaagcagggcaattttcacagctatatgtttaattcagctctaatgtcagcaaggataaagaagtcaccaaggttaagaggaacatgatcccagttcagcacatctctacagaaacaccaaacaaaatgcgccaaagggcagctaaagattatgtggtttgtagtttctagatggatagtggagaaaaaaaactaattttaaaacggatttgctgaaaaagtgacgccacattatgtggctgagtacagtcggattttaacggctggtatgcgctgcgctggacatcgtgtgcacgatgcacatccgtttctccacctgtttatccctttgcattttttttactttatttgttgatccggagttgctatgggtttgtagcagtcaattgactttattgttgtaattatatatttatacaaatttacatactagttacaccccacttacgcatcatttacatatggttaatatgtaattttaagatttacatatgtaattttaagacttacatatgcaattttagaacttaaattgtaaatacattaaaattacatatgtaatttagagacttacaatataaatacatatcgactattttttaatgaaaaatatgacgccataaatacagttagtccaatcagtaactagagggtgagcgtgtacggtacggggtcgaccgcgggccacggccggtggggagcacaacggctacagtctatatttattttagtgctagaggagacacagacagtaatatatgctagtatcaattatttgaagagttcagtgacattgtaccataagtacgaaacgaatactccactttagtggcatgtggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggctcgccggcggcgatggccatcttttcgttga

SEQ ID NO: 1558 - DNA, 1501 bp, Oryza sativa
ggagaacaggatagaccctttcccctgaattttcacagttgaggcgtccccgaacttgacgctcccggtgattgatacgtctagatctctgaacttagcacgatcacccgtcatgtggttgcttgccccattgtccaggaaccagatgtccccggtggctgctccgctgtcagccaacagcagctgcggccacacacgctcctcgtgtacgaccagcccgctcgccggctcgtcttcggtcaccgccagtaacaatgcagggtttgcgtcgtcggtttgcgcgagatgggcctccaccttcttcttcttgggatgagggcactgggtggagtagtggccgaattcttcgcagttgtagcacttgatgtggctcttgtcacggccaccgccgccagagccaccagcgccactgttccgcggcgcgctgccgcgtccaccacctccaccgtgccctctgccgcgaccgcgtccgccctgggcacggtttcccctgtcgctgggaggtttgtttttctgcggcgaagacgactcgctgccgtccttcctgaaacgcgcctcccactccgcctgagtgagaagtacttgaccgtcggcggtgacaccaccagcggccgccttcttcttgcgaactcgttcttcgtaggccttgagacgacccaccgcctcctcaaatggcatattatcaatctcataaaactgctcaatacctgcgacgaggctgatgaatttctctggcaccgtgtcgaacagcttcttcactatcgcggaatcactcagtgtcgagcccaacaccgagtgacgcacgctcatcgcggtgatgcggcccgcgtactgatccagagtttcccccggctccatcaccatggcaccaaattcacccttcaacgtctgcaggcgcgcttcgcgaacgcggtccgcgcccacgaaccttgtcttcaagcaatcccacacttcctttgccgatctcttctttgccacctgcatcagcaagtcctccgggagggactgcagcagatgggacttcgacttcttgtcccttcttgggtcgacggccaccccggccgccggctcgatggcgtcccacacgccctggtcctccatcattgcctgaacgcgaatgcaccagctggtgtaattcgtcgccgtgagttgtgggtaggagaacgcactccctgagctccccctcgccggatccgctgcggctcccgccggaaccaacgccatggtgtcagatcagccctcaacctgagtgctctgataccacttgttggcgaagaacaccaatcgaacaccttgtgggcgtcctgtagctatccggcacagcagactgaagaaactttcagggagacagagaattcagagaatgcagagaacaagaacaaaataacttgggagagtatttgggcaactttcggtgtttatttcgaactgaaatgaaaactgaatgcgcgcgtacaaattctgttaccaccaactatttataggctaacaactttgatcc

SEQ ID NO: 1559 - DNA, 1501 bp, Oryza sativa
gaagcgcgtggtgaagctggccacctcgccggtggcggcgtcccagagctgcactggcggtttgtagaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgacaggagccggaggctgcatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaa

SEQ ID NO: 1560 - DNA, 1501 bp, Oryza sativa
aacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcg

SEQ ID NO: 1561 - DNA, 1501 bp, Oryza sativa
gtgatgatcaaactgggatagaggaactatatcacaaaactatagatttattgataaatttatcacaaaattacaaatttaattaaggccaagtatcacaaaattacatatttaatattgaaattatcacaaaactacagattatagagtttaaatccctagcaccgcggttatgttggagctataaacgttgcagttttatgattaaattggcactaaaacatttagttttgtgataaatttgctattaatatttatttttgtgacacgtcattttaaatatatatagtttcatgagaaattccatgctaaatctgcagttttgtgatacaacacacactataaatatattttatagttttgcgatagtttgatcgagtatctatagttttgtgaaattttatttatttttaatttaagttgcaaacaagctcctttaccagcacgttggacttggacgtttggcttgccacttccccctcttgtcttgatgagcacagatcgatttatattttattcagcacagatttggatcacgcttcccctgcaaatcttcaatccgatctctgcaagactgctactgcaatacggagtagacctcctgacagttacaggtacaaaacgtacggcttataaccgaaaaccaccaccccaaaaaaggccaagctcagctcaacaaacgtatcaccctgcatgcatgcaaacacgactgattaagcaaagctactccttctaatccgcagctgcagcaaaaaactaacaaacttgccttgagaattgagctcagaatcgaatcaaattaacttgcacttctctagtattaatctttcgcaagcagccgcaaagaaagctgtgagaattattggcgcgtaggaaagaaagaaagaagagaaaagattctgtcgttggagaggagaggagagtaattcgcccatatccgaaaggcatcatctctccatccatccatccacccatccatggtgatgatgatgatgctgatgattcatccatccatccaccatcgtcgtcgtcgccgcgagcgagcgagcgaacgattgatttctttgcagattccgagaatttatcccaaacgaatccggccatcatccccctctccctttaaatccacctccctcccagcttcgtctcctgccaccgtggagcactcgatctccaagctcatctagctcttcttgcttcagcttcttcctctctctcacagttcatcacacttggctttttgagtcaggtgcttgttcttcctgctgttcttgccttggtaatgctcttgatctcttcttagatgtaatcttgggttagctagcatgcagttcttggggtttatctcatctttctgtagtttagtgtgtcaggtttagtagtaattgttcgtcgagaaaacaaaatgatatatgggttggatgaatggagaagaatgtggttcagttcagtgtgatcatcttcttgttgtggctctgaatcgaatgagctgtgaatttgg

SEQ ID NO: 1562 - DNA, 1501 bp, Oryza sativa
aaagagttcgagagctagaacaagtttagactctagaactcgtttgctcctcctttccccttttttcttctccgtccctctctttggtgggcaaggtcctccttttataactcaaggggataccacatgctccacttctacctactcttcttttgggtggggacccaccctctcttgaccaaaaccccgttcgccttctcttggaagctaaaatatagcttgtctttgagtgtggcccagcgtcctcactcgtctgacataggggatcaccctgtcattccttcattaatgggcggagatttgcaatggctgctatccgaatgaccctccgatgggatgggtcatacctacctccactccgctggaaggaggtgcaaaatgggtgcgcggttgtctgcctatgacatgaccagcgtcagaccagtcacagaccggtcattgttgtccaccacgtgtcagtttagcaagctgcatgtctgcccttcttcatacaacgacttccttgcaatggttgcgatgaagcctggaatatatctgggcgggactgacgtgccaactccaggaggtagcacgccggctccggctagggacgagtgcctggaggctctcatcaatccgacgggacggggcgaggcgtgtgtcaggccgcctgttgccacctaacccgcgatctgaccggtctgtgaccggtcacacactgcgaccggtcacggaccggatgagcgctgcgctgcattaaatgcggcgtggcgcgctcgtccaaaccgcaataaatgcggttaggtgagccctgctgtgctcacctaaaccatacacgtggcgtcaaaaccacagggggtcggggcgcccctgccctcggggccgaaacgggagcggcccgacccctcggggagataaaaggcggggaggtctcgtcaccctcaggcccgacccaagggtgaccgcggctacccaaacctctagtcatgataccctcggccccatgtcatcgacaagtactacctttgtttcaggttataagactttctagcattgcgtactactaatctaaaatcccttttattaatctattcttgttctatatcctttataaacaaatattcctagagaataacctgacaataaactaataaaatcctacaaaagcataaaagatggccactttgaatctttgattatgttgcacctcaaaaaaatatatatcatatattaccctaaaaaaaccatacacttttccaatttcagacagccaaaagaagagagagtgagagtctgagagacagcccattcagaggttagttagagttgggccgagcccatatcatctcctatataaatggcccttccgagcgaacctccgccccctccgaaaccctaacgccacccgcgccgccatccccgagcaccaccaaccccaccccccgagcgagcggagcggagaacgcgaggcgaggcgaagcaaacatggcggcggctgcggtgtacggcgccggcggcgcga

SEQ ID NO: 1563 - DNA, 1070 bp, Oryza sativa
cgtggactggggaatggggacggaggggataaggattggaatggttagggttacacaattgctttatatactctatgctttgggcctggtttttatgggccatatgggccaaatacacaggatattactacacacatacttttatatcgggcctccacggagggcggggacgggggacggggaaccaaacccgcccccgccagacccgacggagaatactttctctccatttgattccccatggagacacaattaataccatcaccatcacctaatgggagaattctccacgggggaccggggaccgggtacccattgccatctctaggccggttgttatatgccgatgtattaaaaaacgacgttgatgatattttatgtgttagtagttttttttaaaaaaaaactcgcacatgtattacaaatacatacattgtatccaaaaagagctggattcatctttaaagccagtcccctctaatcctctctctcttccctggaattcctcacctcctctccttgcttctctccccactacaattcttttaggcaaaatttgttacaagacactgaaagattacggtctttgctgtgagacacccgaagatcgtgtatttgctcgtggacactataaaaaagtggtaattagctgctggacactcatcccattattttattatttccggtcaaaatggagagagaagagttgcgtaagtaccaaaatacccctgtacagtgttcttcctctcacttcttttcttttccccatcttcttcttcgcagtggagcagagggcgacggcaaccggcccgagccgggacggctcggccacggcggggcggcagcggcggcgcatcgcccacgcgctgccggcgacgccctccgcgtcggcgcgatgcgcggcggcggcggcgggctcaacttcttcggtcgcgctcccatgccgcccgcctagtcgacctcatcacctcgccgtggcccacccgcgtcgtcacgtccaagcacaccgccccctcgtcgcatgctccgcggtgagctcccgaggaagccgcgcagccgtgtctgtgagg

SEQ ID NO: 1564 - DNA, 1501 bp, Oryza sativa
acacatccatacaccaaaaatcccaaacgagaacaaacaaaatgtaagagatctagttcgaacacttcagaaacaacagaaaaatcaacagcaaaagagcaacctatgaaccaaaaaccaaaaaaattacacacacaagccaacgatttaagaaacctccacctccacctaaatctacaagcaagagagatcaatttcaccggagaaaaatgaagaaatctcaacgcaacgacaaaatcgtcgacgagctctccctctctctcgccggagaaactgagaaaaaacgagaagaggggaaagaatgagagagagacctccacctccacctaaatctacaagcaagagagatcaatttcaccgaagaaaaatgaagaaatctcaccgcgacaacgaaatcgtcggcgagttctctcgttctctctctcgccagagaaaccgagaagaaacgagaagaggggaaagaatgagagagagaaaaagcaggtaaggacaggcgcggaatccaaaatttgagaaaaaaacaaaaggtggggcccacgttgaccacaagcaagactatccatccatccgcacgaatcgcaaaagctaatccaacggcaggaaaaacgacaaatccacacccaaaaaatctttcgacaaatgtatagcaattacgttcagttatactccgtgtgcaccaaggttgagtcgtttgtgggcctgcatgctcatgaccctaccttggggctttcatagtgcacttacgtgtcatttagccatataattctacgtcaattttgctatatatttgtcgataaattttcccctaaaaatttgacagatgtaattacagtacaaccgtaatgtaattacactgtaacttgcatgtaattacactgtaactataatataacttgtatgtaactttcaaaaatctctccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagagatggcaatgggtacccggtccccggtccccggtcccccgtggagaattctcccattaggtgatggtgatggtattaattgtgtctccatggggaatcaaatggagagaaagtattctccgtcgggtctggcgggggcgggtttggttccccgtcccccgtccccgccctctgtggagggcccgatataaaagtatgtgtgtagtaatatcctgtgtatttgacccatatggcccataaaaaccaggcccaaagcatagagtatataaagcaattgtgtaaccctacccattccaatccttatcccctccgtccccattccctagtccacgccgccgtccgtcggccacagtgactgagcggcgccggctcccgatctcgcgcccgcgcccgcgcgtgcaggcgtccgtgc

SEQ ID NO: 1565 - DNA, 1501 bp, Oryza sativa
gtaagcatttcctaattttttacttccaagttattcttgtgtaattgacagctactagtgcttcaaaatctactgattgttgtttgtcagtttttttttaattcctatcaactgtaccctgttttcttcatcttcattaacttgctgtgcctgttgattccattcagcttgttgttatgttatttttctgccaccttctccttggtatagcttgtgtgcagctgctatacttctttagtgaaatcttctgcttgttcttttgtttccatcagctgtgtcatgttgttggagtcttgtttccttgtgcactctccatgataaagcatctttagctgtgcactcctatttttttttgtttttcttctaattatagttgtaaagccaagttcatggtctgcatgatttgcctttttcattgttgtttgtcttattaagaaagtgatttagatatttgttttatattttttgtttagatggctcctgctgctaagagaaatttgggtaaagcacctattgtagatgattctgatgaatctgattgtgtaagttatagtcttttattaatgttttttttatgaaatactatgttatatgaatttagtttgtagtttactaatatctatttcgaaatatatgaattataggatggagagctttctcgtcgtgaacttgatgatattatatatgaaatttttagaaaggaggtagtattactttcttgactgtatttataatttgttattgttttttatttttttaatgtatattttttctatttttattataggttgttaaagatgttaagaaagaaatattgaatcgaaaatcttgttctcatgcttttcgttatgcgaaggtatgttgttatttactaagttcttttactgttatttttatatttgtaagtacattcctgaattttataggcagtaatttatttttctgatttaggtgaactacacatttgattttaatttttatattgcttgttgttatgtaagttacccatttcttttcctacatatgttctattttattgtactttagatattttttctgtttacttgtctcagattgtcttaagatcttgcatttgtttagaaattgttctttacttagagtttaagcagtattgttcttctactttacttagtgtttatttttttctactgttttctttcaattttgttttctgatgattctctatttagtagttgtttgtttacttgtctaagagcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttgttgtgctttacatatttgttctgtttacttttgtattatatatctattttttatttattttgc

SEQ ID NO: 1566 - DNA, 1501 bp, Oryza sativa
agcggctcccgctgcgcgtcatcgtgcaggtcctcttcttcgagcagctccagctacggagctccatcgccgagtgcctcatggtctccgagaacctcgaaggcggctcgaggcagctcatccccaccatctccggcgagcaataccgccccggctggcccctggcctcccgggagaaccaggccctccgggagggcatggacaacatgaagcagcgcgtcgccgacctggagaaggagtgctccaccatgagggatgagatcgagcggctgggccgcagccggagcaccggcaagggcagattctccctcaacatgaaaccacagatttgcagcaccaaggaggctattccgacgacagcgacgacaacggcgacggcgagcgaggagaagatggccgtggtgaagggtgacaccacgccacggctgaagctcagcaggcacaagaagaagctgtccatagaagcatgatgatgatgatccgctgatcactcacactaccaatccttttcacttttcttcttctctgaattcttgataatcgagtgccatcagctcagtagatgtgttgccgtgttggtgtcgtaactgcgaacttagtgagttgttgttagagtgttttacatccatccatccatccagcaggaggagaatctagtgaaagagctgttacctgttcattttctggtgctaagtttttgacattttcatcatcatagtaaaaattgccaaagtgttgttagcatatctgttggaatttggatcacatctcattggattgtttcttctgtgcgtcgacagtagataaatcggcacgtttggttctttgccaatcctaacattatcttatttttgcaacagtaagagttatcattgccataattttggtagagttgtccgtttggattttggcctccctttttttttccaatggttttctaccaaaattgttactatgttttagccaaaatattctctccacaatccgcaatgtaagttactatccgtaagacccataaaaagacccatacatattttacatacagtcctttaattaatttattattattataccaggacttgttttattttatctacaatttatctccagaattagattaaatttcataaaactccacctgatccgaattactctaccaataagtaaaagaaaaagaaatttggttccttgggcaaccgtgccctctgcagactctggcaaggcccatacgccggagagcccaataaggcccatctcctgagaccgcaaccgccacgaaaccctaaaaccaagcccatcaggcccaccaacccgaagccacacccatccctctcccactataaatacccgcaccccccaccctggaaaccctaggttaaagcgacgccgccgccgcaagccgtccgccttgctcctcctcgccgagagcttggtcctcgccgtctcctctccccacgcgcagatctaagcctagggttagggtttgtgtagctcgcagcga

SEQ ID NO: 1567 - DNA, 1501 bp, Oryza sativa
ccttcggcttggagagagggaaaaccgatccgaatcgaactcgattccaaagctttccaaagcgatttaaccaaagattccaaaggagaaaatgtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggca

SEQ ID NO: 1568 - DNA, 1501 bp, Oryza sativa
agagtctaagtagaaatacaatttggaataaaaataagcaatattgaaagaagaatccatataagcacccaatacaagattaatcaaaattcggaataaaaataaaataaaatccgaaattagaaaaaaaaagagaagagtccaagtagtaatacaatttaaaaataactgaaattcggaattaaaaataaggaatatcgaaaaaagagtacatataagaactcaatacgagattaattaaaattcagaataaaaataaaataaaatccgaaattagaaaaaaaaataaaagaagagttcacgtaggaataaaatttaaaattaactgaaattcgaaattaaaaataagcaatattgaaagaagagtccatataataaaccaatacgatattaattaaaaatcaaaataaaaaagagagttcaagtaggaatataattttgaaacaattgaaattggaaaataaaactattaaaaagatagtctatatataacacaatacaagaataattaaaattcgaaataaaaaataaaataaattcagaaaaatagaaaaagaaaaataagatctcaactataatacaatttataaatactaaaatttgtaataaaaataaatactattgaaataagacacaatctagaatacatgacgagattaattaaagttcaaaataacaaataaaataaatttcaaaagtagaaaaataattataagagttcaagtaggaatataatttatgaataaaaattatcagaatgaaaaatatgcaatttaaaaaaaaagtccatctagaacacaacgatgacaaatgacaataaaaaggggagaagcaataggtagagtactagcggttgatgggatatctaaaaactataaacaaaatcccaaacagaatcacaatgatgattaagaggagtgacgatgggcatgccgttaagcagcatggtcacgacggttgacaggacttaaggagagtgaaaatataccccaataataatcatatccgatttttaagatctcaatgacaataaggatgggagggagcaggtgagctgtagaggagtatagtggcgaagtcactaatgatttggcgagacttataaaatgtaaaaaaagaacacaaacaataattatgttcgatttttaaaatcccaataacaataaagagaggtggtagcggacgggccgtagagtagtaaactggcgatgttggaagatacttctaaaaattatgaaaacgaaacccaacaaaacaatgaactctaaaaactataaggactaattttaaaagttctaaagaagatgagtaaaggtagtggtagatcaagtaagcaaataaaaaggtgacaaggaagtaatggataaagactggtgtggcttttaaaaactataaaattattagaatcacgggaatgataactttaaataaaatcatgtgtaaaaaatagataattttaaattgatgctagccacgcaattgcgcgggccgcctaactagt

SEQ ID NO: 1569 - DNA, 1501 bp, Oryza sativa
atccaccgtgtccaacggctccattcttagcttcactctcagtgtcactgtactcctcatcaacacactttcacgtagatctgcatctcagtagcaggctgcgtggaatgtaattgagctagggtttgatgcttttgaattagtctttgtgtctcgatgtgtgcgcagatgcaatcacaactgtcagcgaagtgatagcagaggttcatgttcgagtatttccaaatgccgcaggaggccagcgtgtcaccgtccttcagctgccacccctggaagatcaaccgttgctagcacggcaacatcttttccttctcctagagcttcaccttcacgctcttaaccgtgtccgacggcttcacccacagcgtcctagtattccccatcagccccctcacgaagatctccatctctgtagcaggatcatggatgccgtaatcggccagcgtgcgactgccgacctcatccatctgcttcccatcgtatctcaaccagaagtcctccgtgatccccgacatatccttgatctttgctttcacgctctccaccgtgtccgacggctcctgatgtgaccatggctattatagatacaaccgttgctcacatcatgaattaacaagaagacatcaagatcaagtcctccatgtgttgcaatctgattcggccacgtgctacattgctgacttcaaacggccgccaaatctacatacgtgctccgttttgggcccgtgagtacttgatggaaagctctcgaagtcttctttccaacggatccaacctcatctcggaattccatctcgtttggccataatcacagaagcaaagtgttgcgtcacctgtaatgggcctatgggcttgtaacctcgtctgggatcccggcccaagtgaggcccatgtgggatgcatcccaatctggtgaagcacgacccttggacaatcttggtcgtcctcctacctctataaatagttaggtaccccttcagggtttttcgggttttgtttagatgaaagtttagctattgctacttccttgcagcgcgcatgtgggctagaccgtccgtctgcttgtaatcggaaccccaacttatcatttatgctcaattcctatttgtaattcagattgcttttatcttgttcttgcttgtttcttcgatttgcttgcaggaacaaggttgatctgcatcggcaagatcaacaaccaacggagaggtgtatcgatcgctaaggcgcaacacaacgtcttgtacggttgtagtcgggtcgtcaacgtttctctcaaatcgtagttatctcaactcactgaaagatcgggccaacaacagccttgagtgtcgagtggaactcagggttcatcagctccacttccagtgtcaacgtacccccctcccacctccccccctgatcagctccacgaggagctgcatcctcttcccctggaattggcggctgccaccgcagtttcgtcgagatcgaccgagttggtgttgcacggctgcgccgggaa

SEQ ID NO: 1570 - DNA, 1501 bp, Oryza sativa
aagattaaaaaacgatactgacatgcctttataggtgcaagtttaattaaaaaaaccagcacatataaatacatgtgctattttttttaaaaaaaatcagcacctagaagaatatatgagtaccggttttctaaaaaccgacacgtttgtgaaagccgagccgatgaaaaccgagctgacctaatttttcttctcgccctcctcacatatctctcaccattctcactgctctccgatccccttttctgtcctcgttgcctccgccactcctccccctctcttttgctacctccttgcctccgccgaccctccccctctcctccacctcccttcccctgtcttccgtcgccccttctcctctcctcctctctgctcggggacggccagatccgccgccgcgtgcttagggacagccagatccgccgccgcacgctcgggggtatccggatccgccaccacaagcacggggcagcccatttaacgactactgtggctccctcaactccctcaaccaccgtgtgcttgggggcggccgaatctaccaccgtgcacacgaggacggcctactcacaacagcggcttcctcaactccctcaatcgccacaggcacaggggtggctgctcaacgacgacggtggctccctcaactccctctttgtgttctcctctgtgttgttaattttgctcttgaatgttgattttataattgtgttcttggatgttgatcgattttagggatgatggagagttgcttgatgcatcggctcgaatcgagcaacctttgttttggattcgggactctcaaagatgtcggttcctaaactggcacctaagattcctcctcatcagtgccacctatgaggtgccggttggaaaatctggcacctacgtaggattcccaactggcacccattagggtttatgtagtagtgaatgtttaattattagtatatatcttggtttgaaagtaaataattgtatgtaaattatgtttatgcaaaagttttcaaaattgaatttgttgaaactcctacctttctcaccaacgaacaataggttggcacttccaaatgatgttttgcatggacaagattggttgtgaatgattgatctacgaatgctaaaaggaaattgtgcctaattaggagtttgtaaggctgttttagcaagagataaattcttataatcgcaagaaaaaatctgcacctgatttcttactcttcttgccatatagtacctttacatgtttgactgattccaaattaattcccaagacgcataagctttccaattaatctatactactactacaaagataaaatatatataaaaaatgtcctccgtcccataatatatgtgcttttgggtggatgtgacacattctaagacacattctaaagaggatgtgtcacatccaccaaaaaatccctgagtactttcttagtgtttctatattatctaaaaaaaatatgctatttgttaatctgcactatatattaac

SEQ ID NO: 1571 - DNA, 1501 bp, Oryza sativa
atactcatgttgtttcattatgtatagatcaagtgttgcggtgaattgaaacatcctttcgctatttgctgaaacattgtgttttatatacggtgaaacagcttcaaaaaccgttgtttcatatgttgtagcaaaatatttcgtgaggtgatttggttgtatttcagctttttaaacgatttaaacattttctatctacttagtgaaataattccgatctacttggtggagccgtgcatgatttttgaaaaaaaatgggtgcccgatttgtaggcgtctcggttattttagccgccccctaccttagatcattgttcgtgtttccggcataaagtgtccaataatccgacactgcagctctgtcgacgggggatacccgtagaccggatatagagagtattggggtatgttggaacgaggatctacgtaatacgacatcaagcaaatgaaagacaagattatactggtttaggccccttgataggtaatagccctaatccagttggtatgggattatatgatggaaatcacaaattacaaagggaataatggaactcgatgataccgacgagaccgtaatcgagttggttcgactagatcacccggcgacttggctcctgtaggcttcggcttcgtaggctgtggtagatgtgttggcggtgagatttgatgccctcagtcctgcccagggggtcccttttatatcgcggatcagttggtctccaagtataactcggagatatcggacccctcacgatatggcaacgacccagttctgtccgagtaggactccttccatctgtgaactccgtttctatcacgtgatagatttccttaacgtacgcagaaaatatccgtatacgcgcgggtataccgtatcagtatacaacgtatatctaaggatagagggtataccttatccgtaactctgacaagctcgagttgctcgtatattttaatagccgaccgtcgccgtggcgacgactcaacaatcgcaaggtctgtaagattaaccgaaaattcttaatattggaataatacattattgaaccgtaataccggatataacatatctttcaatttacatgttcacgttaaaagaaacagaaaaggagataaggtattacaaactgagggacacattatatctggtgctgtggttaagggaagagattcaaactcaacgtcaaacatgagggatgtaaagtaaacatatttctattacgcgcggtacgatttggacttacgtgcggcccaatcgattgcgtttgttctgaacggcccatggaagcccactattgctgctcccttgctccctataaatagctagggttttacgccacggcgcacgcctccaccgccgccgccgcagccgccccattctccaaccctagccgagaggagcagatcaagcaatggtaaacctcgcagccgccgccgccgccgcggcctcctcatggcttctccatagctctaacgtggtgatcttgttgtggctcgc

SEQ ID NO: 1572 - DNA, 1501 bp, Oryza sativa
aatcctacgtaggtgccagattttccaaccggcacctcataggtggcactgatgaggaggaatcttaggtgccagtttaggaaccgacatctttgagagtcccgaatccaaaacaaaggttgctcgattcgagccgatgcatcaagcaactctccatcatccctaaaatcgatcaacatccaagaacacaattataaaatcaacattcaagagcaaaattaacaacacagaggagaacacaaagagggagttgagggagccaccgtcgtcgttgagcagccacccctgtgcctgtggcgattgagggagttgaggaagccgctgttgtgagtaggccgtcctcgtgtgcacggtggtagattcggccgcccccaagcacacggtggttgagggagttgagggagccacagtagtcgttaaatgggctgccccgtgcttgtggtggcggatccggatacccccgagcgtgcggcggcggatctggctgtccctaagcacgcggcggcggatctggccgtccccgagcagagaggaggagaggagaaggggcgacggaagacaggggaagggaggtggaggagagggggagggtcggcggaggcaaggaggtagcaaaagagagggggaggagtggcggaggcaacgaggacagaaaaggggatcggagagcagtgagaatggtgagagatatgtgaggagggcgagaagaaaaattaggtcagctcggttttcatcggctcggctttcacaaacgtgtcggtttttagaaaaccggtactcatatattcttctaggtgctgattttttttaaaaaaaatagcacatgtatttatatgtgctggtttttttaattaaacttgcacctataaaggcatgtcagtatcgttttttaatcttagactcatgtgaagattgtgaagaggttaaatgtgatggttttttagaaatctgcacacgtcccctattaggattttgtagtagtggttagaggtaaatgcggctaccctgcctagcacgccgattagggcctaatttttctccttacatatctctcgccgttgagagcccttgctgcatcggtggctgttagctaggtgctcgacggtgagaaaaattagggcagcagggactcaccatcaggcacctaaaaaccaccgaggtgatgactgcgccgatttttagaatattgaacatgcaagggttttttgcttgatgaaatatagaataaagtgctcctttcccttgtgcgcctgttgtagcttgtagacatatggcaacccagcagtccaaatttacttctaatcgctaaccactagcagtttatcctcttgacagttttggcagccttagttgtattaacccatttaattacttgcttttgttgtcttcaatctgatgtggtaatagcagtgacattctactggggacatgtgccaaacaaagaaccaataatccccttgtcagaagggagcagtaacagcagcagctactgcccactgtc

SEQ ID NO: 1573 - DNA, 1501 bp, Oryza sativa
ttctctacgactgaatagaccctatctgaacataaaacatacgtgtcccaactcccaagtcctaatataaaccatatctgaaatcattttctagcatttgcgtgtcaacattacatttcgtgttgcagacggtgcatcttgacttaatttgccaggagattaatttcaccagatgacccaatataatcttggagatgggggcatgtacgagatctttgctgtttcataaatgttgatctctgtttggtgtcctgcagcgtacgaaattcagatagaccggcctaccacaagctagaaacatctggagaagcagctagctgaattatatcttttctgaacttgtgacggctgggagattcagagtttcgtttgatggtggcactgacaaaacctgaattctggttaattacaggtaacgcctaaaccagaatcgctggctcaccacctgtacacatttgtgcagcatatggtctaaactctgaagataatggagcgatttgtttgatttgcaagccggcaggcagctgatcggaatcagacgatacagacaaggcagtctgcagtccgaccaaccagtttagctggagcagttcggcgttttgcagaagctgcaggagaaattcgagaccttggatgtctcaatccgaactcactgttgaaaaccattttctaaattttgccacaaatcacggattaaatctacgtacgtggcgtgcaaatcctgtgcagaaaaaacggtgttccctgttcagttgcataccggcgactgagcagactcgctcctgattgggggaaaaaaataataataatctgcagccagctgcagtgcactcgcagtcgattttccgaccgaaaccgtacgtggcgttcacttcaccgtgggatcgaatcatccaaaaacatcaattcgatatttcgagagaaagcctggaaaatttaggttgacagctctgctgcccagagaaaaactcgtaacgaactctgctgaaatccaaaagcggaagtccaagtcaagaaatttatcatttagtacaccaaataggtcaggctgctttctttctctcttttttcccttttttttgtgagaataggtcaggatgctttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcgtttaatttggaacgagggagtactaacaaatacgtatacgtacttagcattgctgatgttcttttcgaagaaattcagacatcccgatgttggctataaatacttcctctcaccaattgcccacataactcaccaagaccaccagaca

SEQ ID NO: 1574 - DNA, 1501 bp, Oryza sativa; identical to SEQ ID NO: 1557

SEQ ID NO: 1575 - DNA, 1501 bp, Oryza sativa; identical to SEQ ID NO: 1558

SEQ ID NO: 1576 - DNA, 1501 bp, Oryza sativa; identical to SEQ ID NO: 1559

SEQ ID NO: 1577 - DNA, 1501 bp, Oryza sativa; identical to SEQ ID NO: 1560

SEQ ID NO: 1578 - DNA, 1501 bp, Oryza sativa
gaatatactgcaaaacaacactaatgtaatgttcggacaaaacttaaacgtcattatgaatattattagctcttaataatcggcaatagccaataggtcagagacaaacacccatcagaggatccggattcgatcaggtgagtgccggacaaacagtatgcggcgccatcgcccgtcgccgccgccggctactttctgttagagcacgggcctgtttagttcaagaaaaaaaaattatttttgaatgtcacattggacgtttaactagatatcgaaatagatttttggacacgaataaaaaaactaatttcataactcgtctggaaacagcgagacgaatcatttgagcctaattaatccgtcgttagtatacgtaggttaatgtagcacttatggctaatcatgaactaattagactcaaaagattcgtctcgtgatttcctccctaactgtgcaattagtttttgtttttatctatatttaatgtttcatgtatgtgtccaaagattcgatgtaatgtttttaggaaaaaaatctgtgaactaaacagggcccaagtttagccaactactaactccaaatcacatatagtcaacttaatagttaattcatacaatagttacatactacactattaatacctgatcccacctgtcatacatacactgtctcttgaagtccatgctacagctggctacaaatctttagctcgctgctcttctctttcttattttattttcttaaaatatgttaccaaacgacgacacgtagccagaaacacctcgacacgaacacccccatgtcacaccacaccacaacacgatcagttcaactttttttttctcttttttcaaaatttcacatccttttccatcaatttttctttaccccgcattattgcagaagcaagaaggagcaaatatgcccttttctatttctttcacctcccctgattctttcttgggcgacaaaccacaacctgccacgtactctactctacccgccgcgcgtcactagctaatgacacgtgggcctcgcccatgcccgggcccacacgtcagcgggacacctcacctgcctgcccctgcgctgcgccggctgcgccttctggagaaaaggtaaagaaagacaggtcacccacgcacctcgcgcttaatttatttgtttccatttttatttttaattttttttcctcacgctttctcggttccatttggctttattaataattaattagactttttcctcttggctttataaaagagagcgcttaaaccctctccacctctccatatccggcttccagacgcttctctcctcctctaatctcaagtctctgtctcgtcgtcctcgcatctccactcgccatgggtaattatgctcacctccgaatcgaattaattcccccgtttgattactgctggtgcttcgcgtcctgatctgattgatgtttttttttctgatttttttggtgaattttctggtggtgtttttggggacg

SEQ ID NO: 1579 - DNA, 1501 bp, Oryza sativa
acgcgcatgggaaagcccgtcgtctgtccaaacggcgtcgtgctgcctccggcgggttgcggcggcgggttcgatggcgcgttggtccatcgcgcgttgcacgccgggcagacgtcggcgccggagacgacgcagtggaggtggaacctgtgcgagcactccgccgtcaagggaggctcccagaggccgaagtcgccgtggcagccgtcgcagcggcctcccgccgatgccatggtatcgtggatcggacggacggtggcgtcttggcttggatagttggatcttgcagaatgcaatgggaaattgggaatggctggtctgtgcgtctgctgctcgtttgatctgtatttataggcaagtttgtcggtttgtccacataataattactactccctccgtttaagattataagacgttttaactttggttaaaatcaaactaacctaagtttaattaattttgtaaaaaaaatattaaaatatataataaaaatttattcaattatagatttaatgaaagtgttgtaaatattaatattttttaagggtaagctaaacttagaatagtttgactttaaccaaagtcaaaacgtcttacaaccttaaacgaagggagttgtactgaattttgtactatcaaaattttctattagctgtaacacacaaatttacacaggcatcattatgatgtgtggcctcgtactcttaagatcacatggaacaggaattataattggcgcacacacgtcaggaagaaaagtcgcgtgcggtttcttacagagtgacgacaaagcttgggggtacgaggggcggggtgagggttaaggtttcggggtaggggtgggggaggtcggtgctaggagggggaagtgggggattgggtttagagggatagcctgggaggcggcgaacccgacggtgggtggtgggcaagggcgggtggcggcagtaccgccataccacggggtcggcggtgagcggtgatggtggcggaggcaaagcaaggtgaggggaaggaggccggccaggcaaggccgcagcaatgtggccagggcagcgtcacggcgaggggagaggatggagaatatgtgcaggggcaatttggtccgatcacgtcaaaatgtgggccccctcaagcctagtcagcgcaaatatactaaacaaatagacgcggtgtcctctggcaaatagccatgttttgggagtgtcttcccccaaaactcacttcgtgcagtgtcctggagctaattccacaaagtcgcgatgtcctgtagcaaaatttgcctttcaaataattagaatgggtgagcttcgaacccaagccatctaggccaccattttgtgaagctagccggaataccactagacgtttctcgcaactctcaaaatcaaacaatcatttcacattcttttacctacatgcataatactacatccgtcccaaaatataagtattttttagactccgatacggtctctgagatactactttgaccaacaat

SEQ ID NO: 1580 - DNA, 1501 bp, Oryza sativa
tcatagcatgtgttttagtgtttagttacttgcctccatcttatgtgttataatcctgtgataagcactagtaaaccgaatactcacaaaacttgtttcttttgcaaataggatatgtaggaaagcactctaaaatcttgcagttttgggtgcctctgcatttatagaaatctgacctgaacagaaccatatgttactcctttcttcctatactgcagctgctgcatcatcacagtgtcgtatgccttctccaactgaaaccacaagaagtatatcatcagcgccgagcaacaaaataacagtaacattgcaagcccaaaaatacaatctctgcacaatacagaacctttgacaggtagtactgatctccattctcgtccgcttccttgtgcttcctcttgtaggccagcttcatgtggtcgaagctatcaagcggggtaatacccagaatctaacaatccaacagcgcaaaaaatcaaaacacaagtccaccgagcgaataaaagtttaggggaaactgctcatttcagcttccacctcgtaggggttctcctcgtcgctgaactccgcgccacctgccgccgctgccgcatccgccgccaccacgaccaacccacgtcgcctcgccgccgacgcgaagacccttcattccatgccaaaaaaaaaaaaatctcaaacttatccacaaaccaaaacaaccccggtccgaaaagcggcaaggtgaatttaccgaagcgatttggggccggcgcgacgagggagcgggaagaaggcgcggcgggacaagggggacaccagcgcgggcaccgccgccggggcggccgcagccgccgtcgccgtcgccgtcgccattggtgcgctagggttcaaagcctcggacgcgacgccatgggagagcaaagcgcaaggtctatctctctgggaggtctcgcggaaggtggtggggttgggccccacgcgacccctcatggacccgaacgagttaggcccaacatcataatgggcctactgggctttcggcccatgttaatggcggtagccgccgccgagggggtatacgtagtagggggcccagcacgcgtggggaaatctctcccccaatccgtttcgtcctcctcgcgagcgatccccacctcgccgcagttcgccgacttttcgccgccgcgtcgcgctcccccgaggtccactcctctcctgccggagaagcgggcctaggcgaagagcagcgccatggcgaccgcttcgggtaagttttttgctagcgtccttttaccggtttccgtaaccctagctcgatcctgcgcaaaaaccgcgtggatttggtgtagatttcgctggttttggatctaggggcgttgataaacgggtgattccgcttcgattcgacgggaaatagggtttcgcggggatccgtacggtctctgcgttgcctgaattggggatcgaggctgttgcgattggttgatgcgaggagatttccgcggatgattctcttattacg

SEQ ID NO: 1581 - DNA, 1501 bp, Oryza sativa
ggcgccggccacacggcgctgctggggcgcctcctcgtcgcggcggggcggtacggcatggcgaggctgggggcgatctgcgagcgcgccatgtgcaggagcctcgacgcggggacggcggcggacacgctggccatggccgacggcacggcttcgacgcgctgaggcggcggtgcgccgagttcatggcgtcgccggacaactactacttcgtggcgggaagcgtcagccatgggcgcctctccccttcactccggcgagaggtttggaacaagtactatgacacgtgttgcagcagatacgaggagggggcccacattctgacagcaacaaagattaagctaagcaaaaaaaataatacagcagacaatgtggttgatatatgattcagaaattgtaaatatgtagaaagtagtagaatttcttatttacgatatagcgttattaggacaaccaaaatattgtttttattggtcaaggacttttttatccaccactttcaatggtgagttactaataggcaatgcttaatgtgttttttttttttgctttagtacaccatgctagtatatttctatttagtagagtatacattgtttgcttagagggtgtttagatcgcgcggggggggggggtggtgttaaagttttgagcgtgtcacatcggtcatcgagtattatttagggtgttgcatagggtgtttgggcactaataaaaaacaaacaaatttattaatcctaattaatccgtcattagcaaatttttactgtcgcgtaccacattgtcaaatcatagagcaattaggcttaaaaaattcatctcacaaattagtcataatttgtgtaattagttaccccctccatttcacaatgtaaggcattctagcatttcccacattcatattaattttaatgaatctaacatatatatctatctagattcattaatatcaatatgaatgtagtaaatgctagaatgacttacattatgaaacggaggaagtatttttttagcctatatttaatactacatgcaggtgttaatcttacttaagatgaatttggccgattacagaactacctaagatgaattttactgtcttggttttttttccctttgaaatgtggctattgagtaatactaatcaatataagtttggcaattaccgcttgcaaagtctgctttgtttttgtagctgacttgtaaaaattatgggcagtagtatttttttttccttgatgaattgcaccgcacaatctatagactcttcgtgcacctcaatgtcgtgtaaaaatgatggccaaactagaagaaagagagggaaaaaaaagagagaaaagaatggacgcttcggcttcgatgtctgacaaatacagttaaattctctcgacccctcttgttcttcaattttaaaaaaattcaaaaaatcttcacatcttgagattccaaacttgctactagtatataaattcctccatggtcatcagctcgatcggtcact

SEQ ID NO: 1582 - DNA, 1501 bp, Oryza sativa
ataattctaatacaaatatcattagtccattaaacctgcatagccattaacaaacaaacgccaaacattaattttctgattcatggtgtaactagtacattctttcatggtgaatctaacgtacaccctaacagacatataagatgatataaaagagattgggatgtataggcttgcctccatgcgtggctgtcatggcttgcatccctgccattgctattgtttggctaattgcgtcatccagtcgaaccaaaagtaggtgctagaaagaatcaaaagctcatgtctcagtgcgccagtaacggaagcaaaacaaacctaatggagtataaataaaggggatttttctttttcacctgagcaaaagaaagaagggagggaagaaatcaacacaaacctgtcctctagactcctcatcacctccagtatactggccgcagttgatggcttggaggcgatgcaccaagaggcgtcgtccttcacatgggttgctcaggcttgtgaaggggatcaaagtgacgtcaggggaggagagtcgttgaccagagcaggggcggaggtggagtcatcgcgacggaaatgcgggcgctggtgacaagtgactgatcgaacgcacgcgagttcgactcgttcccagcagagaagccagagagaaggatgtttgccggctcggctcaaggcgcagcgcgacgaggacacttttgcctctcggctccacacgagaaatgacacagacacgactcccatagttccatctagatctctgccgccgcttttgcctctctcctcccccgtggccccattagaggtggccaaatgggccgggccaaacgggcggcccggggcatggccgaacctgtagcaggcatggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacagtgcgtcagtgcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 1583 - DNA, 1501 bp, Oryza sativa
agcggaagtagacaaatttaacgtctttacaattttgcataattattcagaatgtgaggtacatttagtacaaaagctgaattagatgtttgaacgatataaaaaatcagtgaacctgcatatagctatacaaagtgcaacatcaaactaaatccaagccagacctgtgatgcctcctctgccctatgtgttgcttcagctgtagctcttgtaggtgtggttgtcggcagagctggaagagtagtgggcggcagcaatgaaatagcctgcaatatgaaacagaggaacaaaaaaacagcaaattgagtatttagaccattacaaattaaagctgagaaaggtctgagtatttactctcctaacaattctttttgaagatccaatcgtaggaggaacagatgttgctccctgaaaaccaaaacatccattcaggataagaacctaagtaagtaaatatgcaacagttaaggtggaactgggaaaaaatattattagagccttagaggttagaagcagtacattgcaactagcctgaatttaccaccaagagatttactcttttgaataattctaatacaaatatcattagtccattaaacctgcatagccattaacaaacaaacgccaaacattaattttctgattcatggtgtaactagtacattctttcatggtgaatctaacgtacaccctaacagacatataagatgatataaaagagattgggatgtataggcttgcctccatgcgtggctgtcatggcttgcatccctgccattgctattgtttggctaattgcgtcatccagtcgaaccaaaagtaggtgctagaaagaatcaaaagctcatgtctcagtgcgccagtaacggaagcaaaacaaacctaatggagtataaataaaggggatttttctttttcacctgagcaaaagaaagaagggagggaagaaatcaacacaaacctgtcctctagactcctcatcacctccagtatactggccgcagttgatggcttggaggcgatgcaccaagaggcgtcgtccttcacatgggttgctcaggcttgtgaaggggatcaaagtgacgtcaggggaggagagtcgttgaccagagcaggggcggaggtggagtcatcgcgacggaaatgcgggcgctggtgacaagtgactgatcgaacgcacgcgagttcgactcgttcccagcagagaagccagagagaaggatgtttgccggctcggctcaaggcgcagcgcgacgaggacacttttgcctctcggctccacacgagaaatgacacagacacgactcccatagttccatctagatctctgccgccgcttttgcctctctcctcccccgtggccccattagaggtggccaaatgggccgggccaaacgggcggcccggggcatggccgaacctgtagcaggcatggcccggcacggcctgctacagtaacgggccgtgccggcacggcacgagtagccgtgccgtgcttggg

SEQ ID NO: 1584 - DNA, 1034 bp, Oryza sativa
ctgcagccctcatttttttataataacagagatattagtacatgtggtgttgcctccatggtaatggatgagcaacggctttttttttttgggggggggggggggttgtggggatctcaaggtgaattagaagaggcatttgcaacaaatcgtcttacatggaggaatatcaaattcagagtgacatttggactgagttttgcaattttcctttattagaaattagaaaaaagctcacacgttgttgtgggaatttgtataaaacaaataaataagttgagcaaatatctagaataaattacattggtgatacacaaactctacgatctagtgtttgaacatgtaaaatgctcattttagagcacaaacttatccggtgcatgttaaccaaggtcaaaatggtacaacaaggttaatcttgctgattttgttgtttttgaatgctgtgtaaacatgcctacctccttcccataatttattacgttggtttgtcaaattgaactaaccaacatcgtagaaaaaagaacagagggagtatctcagaaggatatcaagtagacatatttattcagcaaaacataggcataacaatcgcataaagaaagagatacaaaactaaattagaaatttgcatatgtgccattctttggaactggcttcgtaaaaatgctatcgttaaaatgagattcgctacacatccaatcttaagccatgggcattagctacaatgccattttcgctatttcttacaattgtaaaataattttcatccaaataattttttgttggatgtttttgcccctagctgtggttgaaccaaaccacatcttctttctttttctggtgaccgcgtttttcacgaaccgagagagaagcggcgccaggggtgacaacgccgatggcacccaccatctgccgcgcgctcgacggggaggcgacgtggctcggcagcaggtgacaccggcgcagttggggaaggaggctcggctcggcagggggcggctggggacagcgtcgtcgtcgtctctctcact

SEQ ID NO: 1585 - DNA, 1501 bp, Oryza sativa
agcaaaagcccaactcgggaagaacccaagctgcagtgaatacttcacaacaaagaaccgacctaactaaactagtacggggggtggccaggtccctcctttgaccctcgccggcggtctggaattaacatccaaaaggttgcaacaaatgtgaaaaaagaaatctgagatatgcaacaatatgacatgtaccaccacacaaaaaatcagctcaaaatatgatgtacccaatgagaaaaaaaaacaaatttgtactccagtaatattcaaacagattatgttactattcacctgagatttatctttttattctctcactgtgtacgtcgtattgtgaactgattttttttagtggtggtgtatgccaagtgttgcacatatcataatttgtttacattttttgtgacttttttggatgtatttttcgaggttggtagcacggtagcacattattgtgcagtagcacctgatattctctctgcttagacggatatggtggtggtgggatattctctccacttagacggatatagtggtggtggtggaggaatgatggtgagcggcggacattgacggtccactactggcgtgaagactatgagagccccacaaagaccccactaaaattttttaccatatatagataggagggaggactgtaactatatctagtttgctcagacctactgctatttctttctgaatccgccactattaatggataggaaggtagtagtggcacatgattgtagggttgaaggagggtgagtagggtctaggacagggtatggaagtcaatagtggcatatctcgttgcctgagcctcgaaggatgggaaagattatgggacatgggtatcttgccaccactcggcttgggggcggagtagaagaatagatgtttaagattgggatggagggatggggagaggaagagagacctaggcaggaaggtcgtgatgatatgacttagtgacgatatgatcggtcgatctggtgttatgcgttagtggggaagagagtggaaggaagaaaacatgaagaaggttaacatcatagcatcagaattctttgtgtaatctggtctatctaaaagtgacttaaatgtgtgaataattttacattcgctccctttgtcgtagaaaaaaaaatcatatcccaataaaaagacagggagaaggacataagactaaaatatccctcattactactactttggtccctaaaacaaataatcttttactggtaggtactaagcggcattaaatagattaaatttctttgatttgtacaacaaaaacagctataggagggtaggaattaatatatttttttagataaagtttttatctttggaagttataatttattttgggatggggagggagacaactacagtgtttcgtttggatcgttctgtctgttatgcccgtgatcttttcagttcagaacttcagagagcgataaaactgtgggggcaagtgctctggcgccggcaataa

SEQ ID NO: 1586 - DNA, 1501 bp, Oryza sativa
aacttttcacaaagcacaggcaaacaaatctacgcaacaggaaccacctcacatccgcccatgaccgtgggcacggctgtttgaacagttagttaacctctacagaggggtacactttacccacaagatacgaacttattctgaacacccgtcggtatcggaggttcgcaacaaagcctttcctaagccgacccagggttacctcatgccacgtagaaggatcaaatcctcatataaatataggccattttagttttcacaaatcaaactccaaccacctcgatcggtaatctggcaagcttcgcgttcttgccttaccaggaacccgggttggctccaaccgaccctgccccggcattccccaactattggcatgcgaggtttccctgaaccgactagttacttagctagggtgtcccattccaccttgtggttgcactttgttatgcttgatgaatttcccacaggaatcggtccttatatgcgaatacgggacagtgccacacaggcacaacccccgcatcgcgagttatcacaattcattttatttttaaacacaccgacaccacaggttgggttttcaaggcttctcaaacccatttcccaatttttggacaatcaacagtgtatgtgggatatttgatatacgcgctcaaagagcacggataccgaagtcccacaagggtggagcgacaaggaatcagggtagtacaacctataggaattagtgcgactactgggtaggtccgtcggtttggcacgcaaaccgaggccaagcaagttaagtgtgtgactctaataatgcaagttgcaaacaaaacaataatgattttccaattataggagcaattggtcaaaaggtgacttgccttgctcaaggtcttcacggagcttcacgaatcttcgagaaaacccgcgatcggcgaaaatccggtaaccgcaactatacgcaaacaaacaaaaacctaaacaaaagaccaagaaaaagaccctatttagactaaataatagtgccattaaatagatctcaatttttacggaattactggaaatagaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatggaacaaaggaaaaagatttattaaatcccttggaaaattaaagggatgagggatgtgatttggacttatctcgggtggcattggtgcggcccaaagggttgaaggaggctcggccgagccattgggccgggcgcggccacggggaggcggcccaacagagggggcgcgggggagagagagacggcccggtggaccgattccaccgcgcggggtcccgggtggggcccgcttgtcggtgatacggcccacggtggga

SEQ ID NO: 1587 - DNA, 1501 bp, Oryza sativa
gttatatatagatgctataaattttctataacattttttcctaatcaataaaaaaatcatcaacatcatcaacaaattaatgtactgactttctcaaaagaaattaatcgttagttcgttacgtggcggtaaactttttgatcaagcaaacgtagtgttttttctacttcaaatcattttctgagagaaatattttagctgctagttccaggacgacgatgccaaatgtgtcacagattactcctaattaatgcttgtagcttatgtgatatccacatctttcgtgccaactgccagccaagggatgactataatcttggagatggtaattaagagcatatacaaatcacgacgaaacattacgcaccacgagtacacgatgtaccttagagctgcaagatcttcatccataattagttgctacggttgatgagctgacgtgcaccaaagcctcaaaagtcatgggccacatgcaccaaaatgaatttcctctccttaatttcctgtgaaaataataacttagttcaaaagcgaaagttccatggtaactaatttgttttcgatataaccctgtgataactataatttaaatttaaatagatacaatctcctataatttaaatttaaatagatacaataatctcctcgctcttttttatcgaacatctcctcattcgttaccgaatgtcaaattgcaaaacaccttttctaagcacaaacggaatgctatagtttttttattcgattacataaaaatcccaaatatgtatattatatccacacacccacaaagataaatccctagtcaccaaagtacactgttatagatcacttgcaaattattctaacatagtcatgcaaataaattagtgtccatacaccagaatatgttcactaggaaattgtgaacctccatataaactataaaagatttataataaagtagaaccatcttatcccaactaaaaatttagttagactttaccagtatagacattgagataaactaaatagagtttcatttttttcaaaagattgaaggaatcgttatgatcctctagatgttgaatgcaatttctatttctctccctctctcaaagtttctcaacctgaatagacaatccgctgttttgcttcaccaaaccgttctccaaacgaccaaacccatttagtaaaaaaaaagaaaaagccatcccccattgagttactgacaggtggggcccactctccacaatcccacctgtgggccccactgtccagccactgtagtgaccaactcttcctcatcctcccttccatgggaagccaaagaagaggagagaaggagagagagagagagagagacgccggccgtacgccctcctcctctaaatctcctccgattcgcacctcgcctcggcgagatcggatgccgctgaggaggaggaggaggcgctactaatcctctccgcccgccgcgccgaggggatcttggatcgacgaggagggggaggggagcaga

SEQ ID NO: 1588 - DNA, 1501 bp, Oryza sativa
aacgatttttgttgactctctattgatgatattggaattaattctagaagaaaccattattgttgcttgattacttatgatttatgttgagaagtgttatttttccaggaaaaaagggacaaagtgttgatatctttctatgggattaaatgttgtatgcctttttttacttaatttggcaacctgaaagaggaactcaaaattgtgcatgttatttcgcatttatttttgcctcctttccaattcagtcaagccattttccttgatgcattaactttaacttcatcttgtttgctggttgcatttcgctatttaaattgcgaactctgtttagcatctttgctatcataattcataatgtactgatcataatgaactaatataaaaccattacatgcttctgaagggagcatgttgaaactgttttttaacatcaggggtcatgtttagtcttaatagtatgttcatttatcttcattgtgacatacttcggtaccataaagatccaaagctttcttcagtaagtcactaaatttactaatgtggttctatttttggtccagttaccttgttgcagcagccatcttgcaatgcttgtggagcctttcactagccgttgttgatatttatgcacttcttgtgaagcgttctttgcggaatccacaggctgtgtgtatatttaccatcggagatggggttagtgttttatctttctataaataaggggccatttttgctaagattccttttttactttttgcataaatagaatacctattgaacaacgttattgatttttgtagatcacagggacactaaccctaggtgcagcatgtgcatcagcaggcatcaccgtgctcattggcaatgacctgaacatatgcgcaaacaatcactgtgcaagtttcgaaactgcaaccgcgatggctttcatcagctggtttgcacttgcaccgtcctgcgtcttgaacttctggtcgatggcctccagatgaggacacagcttgtatttagacataattttgggctgtttgtcagccagatcactcggtgcaacagccaggagaaaacgtagtgcagctaattatactacgaccaagttgatgaatgcctgtgtaatgaaatttggtgtcgaattgtttgtacaaaataggggatagtttgttctgcaagagggtggttgtgaagctctgcaatttttttttttttgaaaacggcatgtttcttgtaagaagctttttgtgatctgaaaacacagagctcaacgtgccgatttgttatgtcattttattattctgatgtgatcttcattcccgagaaatatgcagttcacattttgcatcattagtgtcaggatagtagctcttccgagaactaggtaaccatgtgaatttaacgcaacatgaaccagtgcgttttatcagaagtatgttgaatttcaagctgttgacatgtgcttacttacaaaggttttttggatgttgcagtgcagaccgacacc

SEQ ID NO: 1589 - DNA, 1501 bp, Oryza sativa
gctgtcagatatatttggatggatatgctatatattttcatgaactacaaatcacattcaccagccaacaacaatctgattacttccaactgcttattcagttttagttgttcatacaatgaagaaaaaaattattggcttccaaaagtgaaacttagcaaatattcagatagtctgtccaagccagcaaatgaactcctgagaacacggaaaatgaagtatttgtttcacatatcatctaaccaacactaatctgcataccccagaagcaagaaccagtaacaaaaaccactcagctagactaagtgtatgtttttaactaattccacagacacttctctacaaggatgcaattttctattttaaaccacatgacactttcttgattcctcctacctaaaattaactatattgtgactccctaaaatgtaatatacgaaaacttgtaaaactctctcttctatgctcaattttttcccttaatctttgaccattacccaaactaataaacaacacaatctgttaattaagatgtgcattcctaccagcaaatttcatgcaagatccacggtaaggaagatcctactgaacaaatgcaatacgtagcaattaaagagcttaaatctccccaagatccatggtatcttgcccctgcatcaaaatccacatggcaggtagaggtagtatgcctgtgatggcgaggtggatttgcagtccaaatccggtggtgtcattcaaagtggtacagcaataaacgacgctgcggccggccgtgggcgtcgcggccgggcgacggcgaggacgaggccgtgcggcggctccgtgcgatgtggaggccgagacggcgtggtggggctgtgcggcggacacgaatcccctcggcttgccaccatcgagctcctcccccaatccagcaaccaggaggaggggacggcggcgggccggatttgagccgcagccgctcgaggagccccgtcgccatgctgccccgagcttgagaggggagaggcattgtcttcgtcggatctcgtcgctgccggcgtgctgctccccaagtccctgcgcgccgtcaccgagctcctcgcccccatcaagcgacgatgaggaggagatggagggtcgccggcgcgtgcgaggagagggcctcgccctgctctcactggggacgtcatgggagaggcggcaacgaggacgagaggagaggtgggggtagggggagaggcggccactaagcggaggaggtggcggctgcgagcctgtgacgacgagaggatgcgaagcggcggcggcggcgaggcccgtggagagagggcagagtgcgaactattttctttttttttttctttcctctcttttattaggtggggattggggagaggcggggccgcgaaagggggagcaagcgggcaaagccgccgaaggaagggacgtcacgtggcacgatttcaggagaggcaacctgaattctcgctgcgccacgtggaccaatcaaagaccaggg

SEQ ID NO: 1590 - DNA, 1501 bp, Oryza sativa
tgagggtggtcggcgaggccaaaacgttagtggtagtagtgatggaactcttgggacgcgccaatactagaggtgtgcttctggagagggagtgggtggatgaggcactagaggacgagaggaggaaggggccagagagagcgggtgtactaggaggacctcatcctcaaagacattgcagccgtcgcctcctcctcacttacttacagctttcatgttcggttcagagagcacttttttagttgagaataaatcattcccttttatgtgaattccccagcggcgaattaacaatttgtgaggccctatctattcaatctctcgagccccaagaaaacccccctcttcctcagactcaatctctcttttgcagtagatgccgaacctgctactcagtgggcgggcgcagcaactacatggacccctttatttatgttgttgccaatgctttcctgggccgagccggaattctttattagaacgtcggcaggcaaagtctgaaggaaggcagctatccccttggccttcttccttttcgatgaaaaacaaatcaacatctcaatatctctaaaagtccccttcatcgagccggaaaatctcccacccacccccacccccttcgtcgagcctttcctttagtggtaagggatatgcactttatctgaacgttggcaggcattccggaattctcctttttgggccccgggtgaacataggctcaaacatgattggagaggtcctagctacaccatgcgttcaataaaaaaaagcctttgggaagctgcagggattacaaaaagagggtgctttcctatgttgcactgaaaaaggacaaaggagaagacactcttcgactttatttcttcctcccgcgcccgcctaagcctggctcggcccacgttagaggggaatattagcaaagcggaaaaagacagagggagagggagctgcatcttattctcttcgcgagaacttcaggatcgaagaagcattcggaaggggcgaggccttcatttcgttggcagaagcagaaacgatccaatccatttggggcttcggggaacccaaaaacgaactctgtttacttttttcatagatagatgatatatataggaatactatatacatccctttactttagatttagatgtctatgtatctattttttaatcatctcccgattatctttttttttctagttcgtactgctctttctctctaaattgcatcaaagaaaatagagagagagagagagcagatagatcctatcccctataacgaatactcatttctatctattgatagaaaagaaagatcttcgtcacggacattgcctttgttctattttttttttagatttgaggaattcctcatatccaaggcagctccccacaaacaccctacccatacgactatgccctctcttgaatcgagagtagattgggcttcatagctactttcattctaaagacgaatattagtcaatacgcaggcttcttct

SEQ ID NO: 1591 - DNA, 1501 bp, Oryza sativa
ttggacttgttccggatacatgcaacatgaattcatgatcatgggtctattttctatgctcaaagactggactatttattatttcccgtaagggttatcaaccgaatacttgcgccagtcgggattcaattgttatatctattttggagtatcctataagggataatcactcagatcagaagctattcatacgagctacacttggtctatataacccggaagatttattactcgggagcatgttacatgcgtcatcctttaaagggtttcgaaggcatattttttgtcctaggcttaatatgtctgcagcccatattttcaggtgtggcctgtcacgttcttttagggacttaggcactttttgcttaggccaaagtgcgcgtgatcaagtgcccaatgctttaaaatccttttataccgcagttactcaaatttttaggagttgttattatgcatcttaaaaggtgtcaaacagtaaagctttatacagctgccccgctgacttttttatataagtcaaggtgctgtttgggtttttaagcaattgattggatacaatatcattgctttttgccacgtaagtgtgcatttttattgaccaatattatggcttaggctgattatatatcttggtcattttccaggcggttggtaaatcctttatgagtttatttactcggattttacaccatatatgccgtatatttccgagtgtggtgaaaccatgtgtcttttagggacttaagcatatctgttaaagcagtgtgcgcatggcgtatgcctgatactttggaaatttctttattcatagcattcaagcttttttatagctattttgctatgtgaattttcaatgatgtagtcaactttaggttgctcgtatcaatttttacaaagaagtcggtatatcacttggattatattatttggggattcacaccgcatatgctacatattaatatcaagtcgcttggttgactacaattatcgaaaccactcggttggttggattatttattccttgactatatgcttggtttgtttaattaaccacatagtcgggggctacacctattaggtgcatctagtcgatgcacctgactttagttttcaaccctccacagtctttagatttggtaaaagtactcgggagaccatggcaaagatgattgaagcactcggctttggagtaattagtttgagagaatattatcttttcgactgtgaaggtctcaggggctactgtggagattatgggtaccctatacccacacggcatggttatccgactagtcataggggataacttatatctatggaatatgtaacagatcatgacttgggtattacgtttccttttatattatggagcggcctaaagtcttgatttgataatattgtaaaatagatttaggaaaccgataccgtattggttaaggtttctatcttgtaatcttaccccccatcctatataaggtgggcaggaggccctctagggggc

SEQ ID NO: 1592 - DNA, 1501 bp, Oryza sativa
aactgccccagggagggagcacatcccagcaaaatgcaaaacacagcgcacagatgtggtggcaattccatcacttttgccaaaccatcagtcgtcctgcactcctgcggtggcggctcaaaagttcggccgttcagtttattgtccatcttgccatttatacgagaagattaacaggagatcaaccagaaccgcagatcatctactcgccaaccctcctagcaatcccacggaagcagatcctctgacatgaacttcccccgacgtggtcactaacaggtggtgtggagattatgggtaccccatacccacacggcatggttatccgactagtcataggggataacttatatctatggaatatgtaacagatcatgacttgggtattacgtttccttttatattatggagcggcctaaagtcctgatttgataatattgtaaaatagatttaggaaaccgataccgtattggttaaggtttctatcttataatcctgctccccatcctatataaggtgggcaggaggccctctagggggcatgacacacctgatcatcagatctatactacacccggtggattcaaatccccaaacaggagtaggatattacctcccattgagagggcctgaacctgtctaaatccttgtctccgcatccatccacttttaggtctcgtgcgctacccgcttttattattgccgaattcatgtttcgacagttggcacgccaggtaggggtgcgtcgagtttcccgtcaacaagtgcgatggaaccaattttcgatatcaccaggtttgttgtttcaatctattattatttttagattgatttttaattccagaataactttctggtattttcttgtgttcatgggttggtcggctgagagggaggcgaagttttctgccgtgtcctcaagcgacgaaacttttctcgtgcttgtgtgaccctaaatgccaaccgagccgatggcatgtggtgcctattgatggacactgccgagcctaccagaaggaaacacatgctgacttgaagcacatcaaccaacagggagaagctttatatacactcatggcaaaagcagagatcaatcttcttcatatatgcacatacagctgttatatatatttatatatatgtatatgctctcgtctaatctgttggtcttcttttaaatgcatgaacttgtggcggcgagtcgatgtcgcgcgatttcacccaagttttgatcgtcatgcacatggtcgcccaagttctacggagttcctggttgcttgtgggcattaaactccgacatcaccaggatttttcccttccaacttattgttgttcattagattgatctctaaatatcatattaatcttttgatattttttgtttttgttacttgcatataattgcgcggcactactggggcgattgatgccggtcatggactcgaggcgtctcgctatgcggtcaatcggccacgagtctactccgccggcttgtcttcgc

SEQ ID NO: 1593 - DNA, 1501 bp, Oryza sativa
ctataaaccgcctagctcgttggtgacgccattgccacaccgcggtcaaccgccaccgccgacgaccgacttcgacgcggccgtcaccgccgacgacgccgtcgccactgccatgccgctgcccccgcctcgagctcgccacgccgccgggccgctacgccatgccgccgcgactccacgccgccgccgcgcccccacgccgccggacccccacgccatcgccgtggcatgccgccgccgcgcccgcacgccgccgggccggcccacggctccccgacgccgccgccgcgccgccacaccactgccgcgcgtgcccaacattgctgaacatgaacgaacgtgattgaaacgtgaccgaacgcgaacgaacgtgaacgaacgcgaacgaacgtgaacgatacgtggacgaccgtgaacgaacgcttaacgaacgtgaacgaacgcgaacgaacgcgaacgaaacgttaacgaacgtgaacgaaatgcaaacgaacgtgaacgaaacgttaacgaactggaacgagcgtgaacgaacgtgaacgaaatgcttacgatcgtgaatgcacttgtactaaaagtgtgagaacgaacgcgtttagactaatacattttcctggtaatacatatatgattatatatatgtaacttggcccgtttagactaatacattttcctggtaatgttgcagagaagacgacgtcgtcgttcctcaagccgaagtggtagctagccatcgaaggaattcgcgcaggcaagtgatgtaaagaagtgattattagagatttaatataagattgttagacttagcatatatgattattacaattttaatataagatttgtagcgatttaatataagtatgttagacttagcatatttgattattacattttcaatataagattattagcaatttaatataagattgttagaattagcatatatatatatgattattacaattttaatataagaatagtagcgatttaatatgagattagtagagatttaatataagattagtagcgatttaatataagattgttatacttagcatatatatatgattattacaattttaatatgagattagtagcaatttaatataagattattagacttagcatatatgattattacaattttaatataagattgttagagatttatataagattgttagacttagcatatatatatgattattacaattttaatataagattagtggcgatttaatatgagattagtagagatttaatataaaattagtagcgatttaatataagattgttatacttagcatatatatatatgattattacaattttaatatgagattagtaccgatttagtataagattgttagacttagcatatatgattattacaattttaatataagattattagagatttaatataagattagtagagttttaatattacggttagcaaatatgacctatagatctaacaaatattttttgtatgcacaga

SEQ ID NO: 1594 - DNA, 615 bp, Oryza sativa
accaactgggactaaagatctgggggtatatatattcctggtgcgccctcattgtcacgtcctgataaattcatcccgaaataaaaatcattctctaaaaggaataatagaattaattaaaatttgaaaagaaattggcaaacattaaaatgcgtacaagaaaaattcgaatgtggcccgaagaattttcgttaaattctccttggtctaaaaggagccctcaaattttatttgaattttcagaacaccggaaataattactaagcaacaacaacaactatcaaagtttactaaaaagaaaaactaaaaataatccccctcctcccttcctcccttcctccctctttttctctccctttccttctctccctccttctcttggcccaagccgctcccctcccgcgttgcacgcgcgctgaccgcgcgcccgcgtggggcccacgcgccggtcgtcgtctccttcctccagccgcccggcctcctcactctctcccgtgaaccctagctcgttccctcctccaaatccacctcattcaaaccggagattccaaaattaaatagggggaagtaatacccatttattcctctctctttcccccatatttcccccttgat

SEQ ID NO: 1595 - DNA, 1501 bp, Oryza sativa
cttgttatactgaatatacagctagcttatctcggagatgctttggtgagggtataatgtttgcttatgcaattagtctatgtcatgatgatgatattagagtagtatctggtagtttaggcgtggtgtctagattatgggatatcattatttagggttatatgctgcggatgagagatgggcagctgatggtgacagctcagtatgggtattcttccgcgcctgtatataatcctaagttagtttcctggtgttaacgaccaaatttggtaatatctgcatcggaaaagaggattagaccgaagcagaatcaaaggcgaagatcgattcgagaacagagtaagaatccgctggagtccggatcagctacgatcagaatcggctggagtccggatcggctacgataaggatcggctgggtccgagtcagactaggtaagccgatacagccgattctgacaaaacgacttggtgtacgacatcgggttagattgatatgcttcaaaatgattgccgcacatggatagggtcctgagaaggcaattgtatctattagttaggatatttttgaaagggtcaattaggcctagagggggggtgaataggctaatttaaaactttatgcggatgctaaaactgaaataaggtcggaaagtctgatccacagtcagactatccgaaaatatcagatagtctgatgttggatcagactgtctgatccaccaatgaagcacaacaagtagatctatcacacaaacaagagtaaagcacaaacagcgactagatctatagcggcacaattaagcaaagctaaaaggaggatgaagggagatcaccaatgatgaagttcacgaagttgttcccggagttcaaatccttgagggggttctactctccgttgaggagctcactaagaaccgggcctttgctaaccctttcctcaacaggttgcactaagcactcttccttccactaaggggtatctctttccttgcggaggcgagatccggccttcacaaacttctccctgccaaccacacgtagatcggtggctcgggagtgacacctaaccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagagagagctcaaagatccaaagcaatttagcaccaagctcaacccaaagtgaatgagaataaattagttgggtaaccctagaaaagggttaggtggggggtacggatagtccgatattttaaacctccaaggcaacgagaaacagagaacgaagttccatgaaatttcagactttccgagacatcggactatctgatgttaaatcggagtattctgatattttagaagcaaaaacttcgtcctcaaacagagactcaagttctatgaaa

SEQ ID NO: 1596 - DNA, 1030 bp, Oryza sativa
tttcccccttccctcccctctttcggccgccgctccgccgcgccggtggtcgccggcggcgaccatcggggcgtgggcgcgccgcctcccgccgaccgcgccggcgtggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtgaacccggtccgcgcgcccctccccctcggctgacgcaataaaccctttttaaattaaaatttaaatgaagaaattcgcaaatattcatttaaagagcatataaacttcaaatggccataacttggccatttgaactcagaattggactgttaaagtctctaatttttccttaagaagtcaagaacccatttttgtactttgttcctgcttgttatatggagtttattagagtaaaagcccttttattttccattggtcgtatagacgctgcagcttcggaagatctgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattattaccttgttcaccctggaataaacaaaaccccaactagtggacactctactcatggtaccagtagtatgattttaggtagatgcttcgctggttaattaggcaacattaggtggttttacaactgtagactttgggaatattctcatcacctggacactatggaattgttggatcattgtggaattggattcacacctcccctctattcaaaaccctcaaaatggttttaggctgggctcgaggtgcatggttttgatagtagca

SEQ ID NO: 1597 - DNA, 1501 bp, Oryza sativa
aaacaaatacatggaactggacagctgatccaaatacaatagttgtgcaaaaaatattttgttgaaattttggaattgaggcaccaaagcttgttttgagagaagccatgtcaactctttttgttctctttttttttctcagaaccaactgcatataagctttaccaagcccatggacatgtctaattcataatttacgaagccgctgaaaaaaagaattcaatatgttcgtggttcgggtggacaggaagctcgtggctcgttagctcgcttggctcgtgacaggctcggcttgtttgaatttcctaacgagccgagctggcatttcagctcgttagaccgaagtagtcgtgccggtctgaccgcctggataccaccggtctgaccgagatttaatcttcggtcgaaccgctgagatcagctcctgacgcctgtagccatcgccggtctaaccgccgccttgccgccggtttgaccgccagtgagttgccggttaaaacacaaatcgaataactctcgaagtagatgacaactttattgcttctatctgtgtttacaaagtgcaacaacagcactccttaaaaaaaatctcgactaaactcaaaaccctaactaaactcacaactcaatactctcaaaagcgataccgggaggccacgccctccctctctatttatatatgaagtaggcagcccacgccctccctctctatttatatatgaagtaggcagcctaaagacacgaaccaaactcatactagaagtcctaatccacctaggaaaccttcccgtacaagaaacaaactttacaaactccaatcataacaaatttggactccttccaaattcgacttcgcatcccatactcacacaatacctcgtatgccatatagaatcttcaccaaccacgtgcattgaactctagcgtaagtatcccacatgatatctgaccgtcacagacatcgtcttaaccccaagccaactcccgatccatcaccgcaaatactatcttgaggcatcaagtcacctacacatgaatcaaacaaagaaatcatattccgagaccaagctatctccaacttgactcattagtagcaaacaacagtattacatacgcatagtatccatctagaagccataaacatgaaacaatcacggatatccaaacgaacaacccgaaaccgaaaccgacacagagtcgcccggtcagaccgcgggctgaccggtctgaccgctcgcatagcgccagtctgaccggcatcacctgcccggtctaaccggacctgacaaaacagcagtacctgtatatcacctgtaaatccaatcatctcaaaaactcctatccaatcatctccaaatatcaaaaccaataatctcaaataccaattatttatcacagaataagaatcaaaacacactttgatcttacagtatagtcagcggaatacgaaccgaaagagacaccaacaaaaccattctatcgaatggagaactgccaactg

SEQ ID NO: 1598 - DNA, 1501 bp, Oryza sativa
tatttgcaaagtaactattatttaaaaattattatcactaaaagtaatgataattgtcgtctcaactatatacatggaaaaataaaaattaaagatgtttttaccggtactttggtacgtcatccgtgtacgagtcagtttttaagttcgttcgcttttgaaaatccatatccgtatttgagtcggtttttaagttcattcgtttttgaaaatacagtaagagtcgtataagaaattcttttaaaaaaactcgcatgctaacttgagacgatcagactcataactgctcataattttctaaaaaaaatatatccaacggtttatatattggacccaccgatttaaatgaaaatttagggatagatgttttgtttttttctctgattttctactattttctctaattactagattgtcacatggcgacttaaaagcgttttgagaaattttaatggacttttagtatataatagataagattgttctccaaatatagcctaccatttgcttatagttttaactgcgccattattattattagtagttcctttggaatgctggatttcaaaaacataggaataggccgaaaaatgcatgattggaatgccatgtgttaaaacttttaagaatttaatacacaaaaatttgaatgtgttgagctatataggattgcaattaattcaaaggaatttgctcacctccaagactatgttccagacatgcaaattagagctatataggattgcaattaattcaaaggaatttgctcacctccaagactatgttccagacatgcaaattagaaaaaattcctaaggatttgattccttcaaaattcctatgaaaatccttcaatcaaaaggagcccaaagattaggattatgcaccagacgagtaacggagcagggtacaaattaatccgttagagattcataatgcgagaccctttaattactaaaatccatgaaaaccgacgatacataatttgcaaatcaaaatatgaatcccatgcaaaccgatcgaatagtaagctgatatccaacaagctcaaaaacaagcaggcctcaaagaaaggaaaacgaaaacacagtgagggagctcgcgcaacgatgccgcgcgcgttggattatagaaaaaccccaagtatattaggcatgcgatcaatgcaacaagcactattaaccggccaaccacacacacatgacaacactctcacagacaaacatacacattccacacaagcataagacaagaacatacagttgtcatacagctaggctatccctgtagcagttctagccattttatgctattaattttctatatcaaacgcaagctaggagtaggaggcacacatattacgtacgttatgtcctttgttgcagtgcctgcaaatcttggcagtaaaacagtagcaaacttattagcagttagccggcatggtgaggccacacttggctggcagctgcatggcgcggttggggtcgatgttgtagatgct

SEQ ID NO: 1599 - DNA, 1501 bp, Oryza sativa
tatttagtgcttaattatcctaattagcaattaattaataattaggatgattaatcactaattattaccaattaataaacactaattaattttcaaaaatgacctcgctctttggttgtgcaagaccgcacgacatcatcacgccacgtcattctcgcgtatataccggcggtatatttgtgaaaaaatttgaaccccgaatatttttaagaaaaaaaaatgatagtatattttcaaatttaattccaccaccctcacgtaaaaatagttatttttgcaaaccatttgtgcatacggatcgccctaccacctgcgaaaaccgggattcgaccgtatggaaaaaccggatttgtagtagtgtcttctgttccaaggatatgatcaccaataatgtctgcaagagaatactccctccatctcaaaaataaacaaatataatataagatatgacctcctatttaaattaatagcactaaaatatactctctccgtctcaaaatatagtaacttctaatactcagaatttgttccaaaatataataactttccaccaacactcttttcttaaccaaccacaaccctccaccattcactttttccacccatcttcacttttccaccaattacaacatctttccatttaattctacctgctttattaataaacatggccaattctaaagcttgtatcataggccatgtttagttcccacacgaaaaatttacaccatgtcacatcgaacgtttgaacacatgcatgaagtattaaatataggctaaaaaataactaattacacagattgcggctaatttgcgagacgaatattttaagcctaattgctccatgatttgacaatgtggtgttatagtaaacatttgctaataacggattaattagtcttaataaattcttctcgtggtttactgacggattctgtaattagtttttttattagtgtctgaataccccatgcgacaccctatataatatccgatgtgacacgccaaaaccttacccccctagatctaaacacccccatattttatctatatttattcattttaacgaaggaagtaatacaccattcctactaaaatatactaactactcattacctctgtactaaattacttattgtttatgttgtttggcatatactaggtttaaactaaaagactataatataatattgttatcaaataagttatgattaagaataaaaaggtgattgagagtaaaataggaagaaatctaaatgggacgtgattaatactccattcgtgttattttaagcgcagccatgagtttccgtgtctaactttaatcgtctgtcttatttgatattttttttgaaaaaagtaacaaaacataattcatgcataaaggattattaatgttttatcatctaacaatagtaaaaatactaatcataaaaaaatttcaaataaaacaaacaattaaagttggacacggaaactcataactacgtttataattgag

SEQ ID NO: 1600 - DNA, 1501 bp, Oryza sativa
taataacactaaaattaactctaaaccagacaatattcaacttttaagtttcaatatcgtgcatttttcaactttggcttgaatttagattagttttagatgacatggggaatttttgtagggctgtttttttaattattataaatatagttatttacttcaaaaggactttaaaaactagaacttattttcaagagtatttttaacgtaaagatattaataagctctaataattggcccacagaagatactagtactgaaatatgaacaaaattccgctcaaagaaaacaatattttaggtgaaaactatattccacgacgcaccaaatttatctaggttttcacgaagtgagcgtatcttaactggttaggtttcttgtggtgaaactagctcaccagagttaaaatttagatttaacacgggtgctcgtatttatggctaattgttctttcagtaataggcgacaatgaggcgccggttcgtggtgactttgttaatctcaagatatgctaatccaatcttccagaagtgcttagaggtaggttatacgcgcgtgctcataggggtgagtgtacgcgcattgtggatgtctgcgtttgtattatatttctaaaaagaaaagaatttctcaatcgttcaatgcgcaaaccgtgatgattagacaagcttaaaattaccctatttgacgtttgaagcatagctgcacagagaaatagacctcgtttgacagccatttttgctgctacagattacagccgttttaaactactgcagccgcagctgctgccaaaaaaatctcttccaaacacacccatagatgaatatccatttatctttcccttttcgtacgcttggacattgccatttgccctacataaacacaccactcgtacagtgtacttgattgagttgacagtcatactctactacaacggatgaacatgtggaaatgaagacacaaatccactccctacttgctttcactgtcaagtgggccccgcacgacagtggcgagcgaaacgggagcgtgctttttccatcgtgattccttcaccgtaacgggatcatcggtagtaaggtcttaccgtgcagccaccgccaggtgggccccccgacccgccggcgccgcccactcccgtctcgtctcaaaccccacctcccctagtcccctttcccgacaatggcagcggtgagccgctgaccttgcctctccggcgaccacgatccgccgccgccggccggcgagatggcgccgtggtgccccgccgactcgaccaagccggtcttcgtcgggatctacggcgccgtcatcggcgggttcgccgtctccgcgctcttcttcctcctctcctccttctcctcgctcgccgcgcccccgctccccatccctcccgcgtccgccgccgccgccaacctctcgggcgcagtctccggtgtggcgcagccggagaccatgtacaatcggcccatctggaagcccccgccgcggagggagcgga

SEQ ID NO: 1601 - DNA, 1501 bp, Oryza sativa
attcagacactaataaaaaaactaattacagaatccgtcagtaaaccacgagaagaatttattaagactaattaatccgttattagcaaatgtttactataacaccacattgtcaaatcatggagcaattaggcttaaaatattcgtctcgcaaattagccgcaatctgtgtaattagttattttttagcctatatttaatacttcatgcatgtgttcaaacgttcgatgtgacatggtgtaaatttttcgtgtgggaactaaacatggcctatgatacaagctttagaattggccatgtttattaataaagcaggtagaattaaatggaaagatgttgtaattggtggaaaagtgaagatgggtggaaaaagtgaatggtggagggttgtggttggttaagaaaagagtgttggtggaaagttattatattttggaacaaattctgagtattagaagttactatattttgagacggagagagtatattttagtgctattaatttaaataggaggtcatatcttatattatatttgtttatttttgagatggagggagtattctcttgcagacattattggtgatcatatccttggaacagaagacactactacaaatccggtttttccatacggtcgaatcccggttttcgcaggtggtagggcgatccgtatgcacaaatggtttgcaaaaataactatttttacgtgagggtggtggaattaaatttgaaaatatactatcatttttttttcttaaaaatattcggggttcaaattttttcacaaatataccgccggtatatacgcgagaatgacgtggcgtgatgatgtcgtgcggtcttgcacaaccaaagagcgaggtcatttttgaaaattaattagtgtttattaattggtaataattagtgattaatcatcctaattattaattaattgctaattaggataattaagcactaaataagtcatcaaatgacaagacatcgggtctcgcttgttgtcgtacaacggtctcgctctttggttgtgtgagaccgcgcgcgcgagagcgagcggactcgcgctgttgccgcacaacatcgtcagtatcgtcacgctacatcattcttgcgtatctgttgagcgataccaacggtatactgccaaaaaatttaaaccccgaatatttttaagaaaaaacaaataaacaatatattttcaaatttaatttacggtggtgcatccgcaagaaaaaaatcaaaaaaaaaaccaaaaatcaaaaatcacgtcctcgtcatcatcgtgggggcgtaggaggctaggggccgccaggtctgcccgctcctatagccgttgtcgcctcgccagagacatagccgaatcaaccgccccacgcctccccaccgcctaatcagctgacgccgtgcctccctaccacccgatccgccgccgccgtgcctccctaccaccagatctaccgctgctgaacggggggacggccgccgcgcctgatgtgacca

SEQ ID NO: 1602 - DNA, 1501 bp, Oryza sativa
aaatcctctaagccttatttgacttttaactttgcacattttaattgttggaggctttcacacggattttaattattctaggcataatttagaggatatattttagggtcgttttgggacgtgacagcatctctatggtgggaccacttccagctacgcagccagagggacagcctatcacctgggcccatttcaccgccgccttccggaggacccatgtgcccgccggagtcatggcccttaagaagagggaatttcgggagttgaaacaaggcaaccgctccgtgatggagtatttgcacgagttcaataatttggcccggtacgccccagaggatgttcgtgaagatgaggagaagcaggagaaattcctggcagggatggaccctgagctatctgttcgtttggtctccggggactatcctgatttccagccctggtggacaagagcatccgcctggaagccaagcacaaggaattggagtcgcacaagcgtcgcttggcgaatttccgcaaccaacagggggctaaccaaaggatccgctacaccaatccctatccagggggatcctcctcgcagccgcagcagcaaccccgctccgcgctccgacctcaattcgtggtgcgcgtcccacagccgcagcagcagcagaatcagcaaggggcccatgcaccccgccctcctgcaccagccgtgcagcctggacaaggccgcagggatgctcaaggtcaacagtgtctgtgcttcaactgcttcaagcccgggcactttgcggataaatgcccaaagccgaggcgacagcaaggccaagcgcctccccgccccaacaacggtggtaaggatgtcactcggggccgtgtgaaccacgtgactgccgaggatgtgctgagaactccagacatcatcgttggtacgttcctcattcattccatccctgctaccattttgttcgactctggagcttcccactcgtttatatctgtgccattcatggggagaaatcagctgggggtagaaaggcttaggaaccctctgctcatcaccacccctggaggggttatgacagcaaagtattatagccctgccgttcctatagaaatccagggaattgctttcccctcggatttgattcttctagacaccaagaacttggatgtgatcctcgggatgaattggttggctcaattccaaggagtagtggattgcgcaaggcgcactgtcactgtgtatcggggccctgatcaaccggttgttttctttgcacccccaacttccgccggcagttcagtacttcatcagctaggattgccagaaatacccatcgtcagtgagttcggagatgtgtttccggaagaactacccggtatgccgcccaagcgagagattgagttccagatagatcttgctccaggaaccgctcctctgtacaagcgaccctaccgtatggcggcaaatgaactggccgaagtcaagagatagttggaagagttgaaagaaaag

SEQ ID NO: 1603 - DNA, 1501 bp, Oryza sativa
tattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccagccctgtgccatgacatctcgactaccgagccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccataataatccatccattccatgttcaggtgatgagaatattcccaaagtgtagagttgtaaaaccacctaatgttgcctaattaaccagcgaagcatctacctaaattcatactagtggttaccatgagtagagtgcccactagttggggttttgtttattctagggtgaacaaggtattaatatcaataacaataataataaggtcataacaaaggtaaataggcatggctaaataaaacagtgataacgcgggaatttaagtaaagtggtaatgcaataatttaaatcaaaataattttataaactgggattcaatatgctcaaggatgatgtgacttgccttgctcactttcccaaacgtcggcttcaacctccacgaagagcggatcttccgaagctgcagcatctacacgaccatcggaaaagaaaatgattttactctaataaactccatataactagcaagaacaaagcacaaaaatgggttcttgacttcttaaggaaaaattagagacttaaatgatccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccatgcggcagcctcacgatccacggtggatcgggtgcacccgggctcacaccggccggcgccgtgggccccacgcgtcagccgcacccgagggcgcgggcggctgacggccgggccccacgcggtccacggtggcggcacggctcggctcaccctaggtcgatggcgacgatgaaaaaggcggccggagcggaggaaggtggcggcacggctcgggtcgacggggacggcggcgctccggcggtcggcgagatcgacgagggggtggacggggacggcgacggtacac

SEQ ID NO: 1604 - DNA, 1501 bp, Oryza sativa
ctccctggggcccacctgtcatgcccattcctcaacccaatcctctctctctcacgcacgcgctcggacggccgactgccgaggaggaggtgcatgcgctcgacggccggtggcagaggcggagctcacccgagcatccgactacggatgcggagattgcccacgccacaggtggctgagatggagctctcccgggcgaccggcggcgaaggagctggaccgggcggccggcagcagccagcaggcgattgaggcggagatcccctaggcgacggtcggctgaggcggaacacgaccgggcggccagtgttggaggcggagatcctcactgccgtccgcctcatgtgcagctccatctcgtgcgttgccgccgtggatgcggccaccgacactcgtgcgtcgcgtctgccgtcgccgctcgccctccccgccgtgcccaccgtgccccccgtggcagagagagaaaagagagagaggggtgaggtaggaccatgggccccgcctccgccctcactcccgcccgccgctggcctcggctcctcatccgtcagccgcagccgcctccgcccccgcccaccgcctctgcccccacctgccccgccctagctcctcgcctgctgctcaccaggcgctagccacctcctttgttcaccctgagagaaagagagagaggggcagagaaggagagagaaaaaacactgactggtgggccccactggtttttatttgttttttgctgactgtatcgccacgtatgtgccacgtaggctaaaccgcttcgaatcgagttaaggtggtaatttatacagttttaagagtttggggcatcaaatatccggtattatagtttagagggtaaatcgtactaccataatagttgagagggagtaattcatactttttaatctgtgatggccaattaagaaaaagtgagacatcaatcaaacgtcgcaaacaggcagcaccgcacaagcgtgagcttaaaaatcagcaccaatcacggaaatcaatcagccagagcccacacaggcagaaaaacaaagaaaccagaaagaagtgccatgaaaagtgcagcagctgtcttcagtttttcacccacctagctacggcatgccggaaagctctactacgcctctatggccccagcatcaaagttcaaactccaagtcccaatagcagcacaaggggcaaaaaaaaaaagaatttgcatgcacatgtacaccacacaggcacacaccacggaacctcacatacggacataccattgcacagtccatcgcttagccgccaaaaccctccccactttaaaagcgttgcaactccctcgtctctcctcacactccaaggtcactcacacacacgggcagacacaccaagaacctggtgcctggtggtagcaagcgagccatgaagtgggggcttagaagtagtagacacaaccagagagagaagcagcagcgcacacaagaggaagagcacaagcacgagcagcaagaggaca

SEQ ID NO: 1605 - DNA, 475 bp, Oryza sativa
tgacgacgacgagaggatgccggcgggagaggcggtcggcgcgaagacatcaccggcgacaagaggcggagggaataagtaggaaggaggtggtggcggctagaaagggcgaggcagcgagagcagatggatcttcatctatgggcggcagcgacggagctttattgccgcgagcaccccgttgagaccaacggcgccccacagccgaccctcggcctactttggcttcgtcgtcgacgccgcccccacatgccaccctagatctgccttgcctggaccacctagggaccttcaccaccacctcatcaaccaccccaccgtcggcacagccctccactgaccccgttgcctagcagccaacccacctccgtcgtctccatctcagactcctcccggcgcgagctcgcgctggcctcggccctccactgtcggccgctccactccgccgctctctcggccctcctctctcgccagc

SEQ ID NO: 1606 - DNA, 1501 bp, Oryza sativa
tagccacttgaagcatgtgaggtggagagaagagggggacagacgcgcgcttgctcgccgggctaggccggcgatgcgcgtgcacgacgtacgtgtcgaattgtcgcagatgcagcctccttttgcagttttgttttgctgtgggaaattcagatttgtttgttttggaaacataccgaaaaatccattgcgtgaaaaacggcgtggcatctggataagttatgcgcgacttatctggttcggttacgcggagtgtatctggttcagttacgcggagtggagatcgtgcgggcaccctgattaagcgacgcggagtagagatcatgcgggcgccctgataaagcaacctttctctatataaaccgagccgccgcttccacgcaacacacgcgaaatcatccagggtttgcctcctactctgtgctgcgccgtcgctcgtatactactccatcctgctcgccggcgtgcaccggcgatcgggagagcagttctccagaacctctgccttcgactttctgcaccgggagaggcggcaataatgtttttgaaagcgcttcgcacgactgctccctgttcgtccacgacggctcgtcttcctcttcgctcgcgtgttgcacgccttcgtcaacgcccacaaccacgagtaattcctgctgagcaaccgatttttcggcaacctcggtacgtgttcaatatggtacgtatatttgatctgtttatgttttactgcctagtgtacatgtgtagatccaatgatacgttcatgctagtttgcatctgcaatattatgatttatttatggaataaattaaatcattatgtgtttataatctcaacaagaggtttccaaaattacatgaaagccgaggacggctttgcttcgaggtggatagagtgatgggaccaagatgccttctaatatataagatattttttttagagcctagttagttggaacaaatcctattcaagtgaatcggaaccatagggttgaatgcaagggacttataattggttctacagggcacgagaggaagaaggaggatataccagaaaggccagaaattaaaaatggtggtgtcccaatccagtatatctattccagtcacttcatgtcacacactaaaaatcccaaatatttaaattgttgtctaaattggaattattagaatttattttaaaagcctagaagagaagatctagttttaattaataaatttcaatataaaatggggccagataaaatttcattaaatactttgcttaattctataattcctagatttttctgggatttatttgagctaaggaagtatttttaataaatggaattgcatttcatgaataatttaaattggaaaaggttttaaagttctcttttggaaccttctctctctcctggcccaatccggcccgcagccgagctcgcgcgcgcgcgtctgcccgctgacaggtggggcccacctgtcagggccgttgtcttcctcgcgccatcgcccgg

SEQ ID NO: 1607 - DNA, 1501 bp, Oryza sativa
tagacttacgaatagaagtgctaaataactgaacgtattgtacacatgaaaaacttttatatagtcagtaacttcaaacattaggtcctgtgctccatcctgtctagaattgacagtattttgctcaggaatttcacatgaaaaacaattaactctcgcgtatttgaagcttttccattcctaagtttcatagtacaaatatattaaaaggtgcagtgtatctactgaatccgaatatatgctagctagcttaacgaagatgaaacccacccaaaaaagatgtgatgcatgaccatcactatagttattctccatcacagttgtgctcagctttgcaactgaatagacacaacgaaacagtacacaatcagcgggtgggtgatctatcgatacaatgcatgcgtgggcttctcctattggtgtagcacagtcttctcgagaaagagtcgagtgatgagagattgagaggaggaattcaatgtgggcttctcccacgcaattaaggttggggaaatttgagggaaattggagagatgggggcgtgatctcaccagagctagcttctgtcctgctgctcctgcaccctgactcctgctgcccctgtgagcctgtctgcggcgcccccctctccctgcatcatcctatcgatctatacttccatagccccaccctaccaatctctctcttcctccactttactcacgaaggagaaaaaaaaagagagaacaaaaaaatgagtacagatatatatatatatatatatatatatatgatcgcttgaatagtgataattaagcaaaaaacacacatgctttttaacaattatcttgccttttgggagctctttttttttcttgatcttcttttggcaccctctaagggtagccagtactgcgagctgagctagcaagagcgagctgcgcacaagcacaaagcgctagattgccaagataagatctgcactgggctagctgcgctacgctgcgctgccctcttttcttgtcactttcacaaaagagaggccggccgggcggctgcactgggcgccgctatagctattaagctgctgcgactgtgtgtgtgcgtgcttgctctgcccatggagctgtggggttcccatggccactgtatcttttttccctctcatcaggatggcgagctgagctgagctgagctgagcttggcaaaccccatgcaggaatagaatttagcttcttgttttaattttcgctcttctcctttccggttaactgtgggtgagagggagctcaagctggaggaagacaagaaccagttgtccaagggcttagacccttggacgagcaaccctaccgccagcgcgagcaccttgcactacctgctccaggagaaggagagggcgcagcaagcgcatgagcagcttcagatctaccagcagcagcagggattcggcagcttcctgcaacaccggatcaggcagccggcgagccgggggccgggaggtggaggcggcggcggcgat

SEQ ID NO: 1608 - DNA, 1501 bp, Oryza sativa
aaataagcgtaggttatccggccaaatcatcaagtccttggcaaaaattatttgtgccttgatctttttgttcattaaggactacaatcggctggatctaccatgcacgtacaggtgatttatgacactgcagtccctaactagttggtacccggattatatattattacttgcgagttattcattgtgtgtagttatatttataataccatatttttcactaaaataaatagtcagcttgtatttatattgtaagtttctaaattatatatataatttaaatgcatttacaatgtaagtcccaaaattacatatgtaaagaaaaaatcacagcaagcagcacaattgcatgaaaagaaaacgcaaaagaaaacgatactgatcagtatcacagcaaggagtacgaactaagcacgcgtgcatgcataagtacaaactagtgtttgcacgcacgatggcaaagcagtcctgcacaaaatctataaggaaattggagagctaacaaactgaactttaatcagagaatatttatggcgatataattatagcaaaaccgtattctttttgcgaaatggaagaatccgatcgagctagtctccccacatgcgtaggcccgtaatatagcggctgggtttaatattgtaatctgcaagaaacgatatgattttacacgtgctgaaatcgcagcgcttcgatgtttataattctcgcgagaggacaaatgttcaaacaaatatatgtgaagatgattgttttttttcctccctgtagatcagaaattattacctctcggtatacggtaaacagtaatcccgatctcggctttgtctgcatctcaatgtctgtatatatagtcgctgtagctgtaaatgctgatcacatgaatcccgagcaagcaatggctcactttcatcataccgatcgattaattatcaggcgacctagacatacattgaagctatacacctacagaaggaatgacaggatttcagaatttaatgccactgatgatacctttggttgcagaattgaatatacggttaacataagtatagaagccggccaacagttaggatagcagccaacccccctgactggtacgtagcttgctagttgctagatgtggttgtgtatactacgtatgtagtacaagtctcgatatgattaattaagcgcatggtcagtataagcttaatcgttctcaaaatttccattgcgttaacacgtacagtgcccaacaggtagaaaacgtaccagccgtgttgatccgttatactagtactaccactagcttcggtggccggccggcctcctgcgccgcgtttcttttcagccttttcctggtctccaactgtcccgccgggcttgcggggccgcgcggctagctgcaggctggcaaagcgcgcgcgcgctcgctgccactgcgagctcctgctcgctcggtcggccggcccgtcgctactcgctaggcgtcactagcgccaacccgccacgccagctc

SEQ ID NO: 1609 - DNA, 1501 bp, Oryza sativa
cctttctgttgctgctcccaaatcttccccattcttctgcgccgccatgtcaagatccgagcaggcttggagcttgttggcgatgctgccgagtgctgacgaggaaggggagaagctggagtatgggaaaaagtggtggggggcaggtcgggtcgcggtgatggcgaaggaggagcggtcggagaggaatgagcgaaatgaagactagggcaaggaggttgatccactccgccagcttactcgattcctcactggggaaacttgatgtagcgacagccggagagctcgtcggctccacctcaggggagtgccgcctcttgatccgtgccgccaagagcttgccgtccacgccacccctgatccgtaccgcccggagcttgttggccacacgcccctcgatctgcactagtcagagttcgccagacacatcgccccccaatctgcgcccaccagagctcgccggccgcaccgcccctcgatctgcgttgtcagggctcgccggccgtgctgcctgtcgacatcagcaaagagaggaggggagagccgatgctcccgagtgagcaagaaaggggatttggtgatgtgcactggggttcccgatcttccgaaaggttctgataaacaacgatttgggcagagtcgcgacacaaatcgatccggcttcttgaacgcgcacgctcttgagccccgcaatcgcaacaccacgtcttctctggttatcacccgtgtcgaaacacggatgacctcgccgagaaggctaatccctgtttgccaatcgaagaacacaaacaagagcgagatagaaaacaaccaaaattgcagatgaatgattaagctcacgagttggggtcttacaaaccgatctagcggcgaaactattctcgacagattaatctaagcaaaacccgactctaaacgatgacggctactgaataaatatgattaggaacgtcctaaggtttccatagggcgcacacccccttgggctaagcccacgacacaattacaaggcccaaaactcaaaatcagattcggactggatgaggtgcatgacttgttttgcagattcccggcagctcggtaggagttttgatgtggaaccaaaaccatctgaaagtagacttcataagctttccaacaagtactcatgggccccgaaatttcttctagatcagcggctaggtccgtttgaagttgatgctgtcaggaggcccgagtccaaaacgtatagaactttatctcttgtcttctatggaccaaaagtgacgtggtgagatgaaagaatacttggaaaaggtcttggtttggtccccaatcaacttcttcaatcatccatgcatttcttatgctcggtctcttttctttcgtccaagcaagtatctctgcaaacaaaaacacacgaaactcattgtgtagcaacggttgttcaaatatataacaagtaaatctaatgtagaacatatgtgcctttgatttattaatacataaggtagtcatggtt

SEQ ID NO: 1610 - DNA, 1501 bp, Oryza sativa
agcagatttctgggaatcaaattgggtgggacaccagccactcaaatatcttgcaccaacgctcttcactcattccaaaggaaagcaccgaacagtacacaaggctttgagcgataatcaatggatcagggacattaggcatgacttaaccttggcgctggttcaagaatttgtccaagtccatcaacagatttgggaaagtggaataactttagtagaggacaccgaagacactatcctttggaaatggacaaacaacgacaagtattcagcaaaatcggcatacatggctcagttcagcggcggaactggatcaagagctgccaatctgacctggaagtgttgggcaccatcaaagtgcaaaaatttcatgtggctactactgcaaaacaagatttggacagccgatcgtctacaactccgccaatggcccaacaattacttttgtcagctttgctacaggaacttggagacaacgcaacacctcttcaaagactgcccctacacaaaggaagtatggtagagggtcctctcaagattaaattgcaatcacactcttgcaccacacaacgacgatgagggcttgctggaccggtgggaaagaagaactagccacggcgacaagaacaaagcgaaaggaatgcgctccattcacatgttgctcggttgggagatttggtgcgagcagaaccggcgagtgttcaaaagcaaagaggccacaatgtcgtatctggtgacgaagattgtggatgaaatcaatatttagataggatgcggggcaaaagatttagctagaatagtgcacaatagcgcctgattgtaaccatcccactcctctgtagtccccctgccccctctatcttcctgtatccaccccccccccccccccctgttttccttttcttctctgctcctcacctcttggtgaatctgtacagttcttcacctgcttaatataaacccagcagaagctggcttaaggttttttttaaaaaaaaaacaaattgtaactgtgatcgttcgaaagccaaatcgaagggcgaaagatgcttcacaaaccgtccaaaccgctgactccttgttgcctgctcgcccgtcacgggcacgtacacgctgttccgcttgctgaaagacgggaagcacaccaagttttcagcggccgctcacatggagagtggcaggaggcgccaggccgccggccactggaccaacacgaaatctccctcgttggcgagacaactctgacatgacattgcttagcacgcagaggtcgtccgtccatggcagagagctcgcttgcacggatacccaagcaggcacgagctgccgcagcgccgggcaggggtcacaggccctctcttgttctccatctctcgtcgcgcacagttctcccgaaagcgaccgccccgcccgcgtcgcatccgtccgtccgcatgccaaccaacggcccgggatctcggcacggcccggtccatcccgcgctttcgcaggacaaaacatc

SEQ ID NO: 1611 - DNA, 1501 bp, Oryza sativa
gaattgcagttaggagtccgatcgtctcaagtaatctgcttggatatatattttttcagaaaatctaaacatgagctacaattaggagtctggttgtctcaaattagcatgcgagttttttttaaagaaatcattttgtattttccaaagcgaacaaacttaaaaaccgactcaaataaggatatgtatttccaaaaacgaatgaacttaaaaaccgactcatatatggatgacataccaaggtaccggcaaaaacatctttattttttataatagtagagatagagatggaaggaataagttcaccttgactcccttaactagtggtcgtattggattcgtattcttgaaccacaatactggatatcccaaagttatgtaacaatagtaacaatagtgataaactctaaaatatatttatattttgtatatctaacagtgaagccaatacctatattacaattgagcggttacctaaactctgttggtgttataaatacagttgagttgagcagttacctgaactctgttggtgttatcatgttggtgttatcacttgataaaaccaacagagtggtaaccgctcaactgtaatataggtattggcttcaccgttatatatatatataatataaatagattttctttaaaaataacggtaagtgaatatctgtacttagcatgaatatacaactgatttttatagactgattggacgattgtaaaaatttgcagagaaaacaatgattatacccttatgtcttgtttagttcccaaatttttttttaaaaacatcacatcgaatctttagacacatacatagaacattaaatagataagatgaaaaactaattgcacagttaggggagaaatcgcgagacaaatcttttaagcctaattagtccatgattagcgataagtgctacaataacccacatgtgctaatgacggattaattatgctgaataaattcgtcaagcagtttccaggcgagttatgaaattatttttttcattcgtatccgaaaaaccttccgacatttggttaaacgtccgatgtgacacccaaaaattttcttttccaactaaggccgagtttagttccaaattttttcaataaactttcaactttttcatcacattaaaacttttttatacataaattttcaacttttctatcacattattttaattctatctaaacttttaattttaacgtgagctgaagaagacagtaccgaaggatagaatttctccaacagaggcgctgcaggtttccgtcaatgtgagcgtccatctaacaagcaaccgggacggcgacgcctttgcttaattaacaccccaggcggccgcagaccaaaccgaccaccaagtcgtcatcctcctccctcctcttccttccagtgccaatcaacccaacccccgcttccctccccccctcccctccctttccttcccctccaaggaagctatccccgtctcgcctaaaccctagcgcgccg

SEQ ID NO: 1612 - DNA, 1501 bp, Oryza sativa
ggaaaatgcagggacgccggctcaactactactcgacctccttggctcctcctcccttagaggcggtgatcgtcggagtggacgatgacaacggagacctattagatgacggcggcgacggactgtagtcagtgccatgctcctcccaccttcctcatccttcggtgcccaactcccctcagcgcctccactcaggtcgggtcgtcgggagatgttgaaaatgattaacccgcccattgattagttcaatcggattttttccttttccgatataggtgtatatgtttgtttgcacaagcagtatcgcagagggcaagatctggtttgggaggtattcatgtgtttccctcgaatccctacccattcaatttttcttttgttttttctcctctttctctcgtgctcatgagaagacacatgtcgcagtccatggcgatggagattcctggcctcgatgcgcgacggcggcgcgatagcggcaacggcctccatgcgtgacgacggcgcgacggcctcgatacgatggcgtggcgggctcgatgctcgacagcggtggcgggctccctgcgcgacagcggcgcgacgcagacggctggcatggacggccgtagatggaagagatgagaccttatttttgttagcccgatcatacccctgataaactaacagttagattaaattgatatctcgtacctcatattacctcgtggtacctcctcaaggattggaaagatgctcctcccacaaaggacgcgacgtgaaacgttgcttttttttttttttttttttttttgcaaatatgccgttttggccattggtcggttagcttatttcttctcgcgaacataatcttttatcgagcattatagaggttcaaatcagggctggcatttctaccactccaaccatcatagacaggatattcaagtttgttactactatacattgtttttccctcagcatcccaccaaatcggcacccgaggaaagttttacaagtgcgcgatgatgtatccacacgagtacaatatatatcaattaaccagtgcgaacaaggtgatagtaataataactcaggctcgcatcaacacttcgcatcgtgtgcttgcaactcacggctcatatcatgggaggcatttaaaaactcacgctgccaaaatgctcagtggcccagtgctgaacttatcacttgttgctcgtccttgttcgtagctcatggcttcaatcactgcgaggccgaggcctacgctaattcctcatagatctcgcatgcaggcagcagcgtgtcccaattaccatcgcgcacagcggcgccatgcacgcacgcacgctctccccacaatccccgccccttcacgcgctggcgagtggcgccttttgatctaacctgcccgagtttgcctgattgcttctctgttcccattccctttctacgcacactgctgcgaaaccagtgctcctcactgcaattgtaccacaccgctagtgggcacagatcggcc

SEQ ID NO: 1613 - DNA, 1501 bp, Oryza sativa
taaccccctctagccaagcacaccacacctcaggtttcacccccgtccccagcgggcaacgggcagtcccctctcgtgcctacgtaaatccggaagcgacagaggccgtcgcagggcctgtcccgctccatcacgcccacccttgcctggatgtgtcagctagagcaaagctacactacaagcccagccgttacccacgctggcttgtggtaagtacgataagttcttccagggcatcccgcgaaccggtccttaagtgccatgggcgcgaccatcaaaatcatgcacccacagccaaccatttaatatattttaattaatcaacaccattgcggtggtactaatccaaagctatgccaataatcaaagtctaggcattaaagtgatccccctttgtgtactggttgaactaagcatggctaagcattccctaaaccaacatctaatcattttaatacctaagttatcaatggcaaaaggtaaacaatatatggccgagtagtaggacccatcccacatgacattgtaaaacaatgcaacatttaatagaaatacgggacatttgtaaattgggtacaatatgatcaatcgtaatgcatgacttgccttgctttgctgctggaggaacctcggcgactatttcaaagtacaccggagcgtcgggagaaccggaatctaagcgacatacaaaacaaacaatacaaacaggccataagactattgaaacagagaacaaaaccatttttaatggattctatgcatttttcttgatttactaagacttgaatgggcttaaacggagcaataattaaaatccttaattgatttattgcgcaataattaaaatcccagggagagagagggggcggcgccgacatgcgggcccacatgtcagtgactcgggtggcggtccgcggtggactgggtccatggaccggggaaggggcagcgcaccacgtggcgctgatgtggcgccgacgtggcgcacacgtggcggccacctggcagccacgcgggcagctgaaccgacggccccgatctaccctcagcggcggaaccacgcggccggcgcgctcgggcggctcaagccggcccggcggccatggtgcacggcggcacggctcgatgccgtggcggcgcaagtcggcgaccggcggcgaccggctgggggcggagggcggcgacgtcgcggcgacgcggacggcgctagcggcggctaagcggctaggcggcggcacggcggctaagctgcgtgggagagagggaggaaggggaggaggtgcctcaccgacggcgattgacgacggcgagcgacggagggcgatgacggcagtggcacgagctccgaaaccacctagcgaacatgataaaaggggttagagagagagaggtggatagaagagggcgaggacgccagccgaaggcggcggccatggcggtgctcaccggcgcacgatgcggagtgggttacggcggcggtttctgacggaggagaggtgga

SEQ ID NO: 1614 - DNA, 1501 bp, Oryza sativa
gaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaacctgatgtatgatatcgggttgaattaaggcgcttcaaggtgattgccgcacatggatagagtcctgagaaggcaattgtatctattaattaggatgttttatgtaatctccttggagatatgcttgggcaaaagtctgccgcaaagacttatggtatcttagagtttcttagagatagtagttgtgtccgttaggacatatcttgtgattttcgggtataaatatacccgagccctatgtaacttttaacacacacgttcaatacaatctcggcgcatcgccacctttttgctttagttttattttgacgagttcttgctttcgggttgagctgcatcggtttcgatcttcaccaagaggtcaaacttgttatggtggcttgcgttctcgggattagtgtttccatctttatgacactctaatcttgtttatgtaattcgtcgagttatcatatatcctacataatccttggcaatatcgatatctaacctacaatcggctaacatccgtcaatagaaggcagccgactaggttaaacaccgatgttgacttagattatataggatatctaccactctatgacacatccaacggcttgattgtctagacattgttcttcttttcatacttatagctgcatcagttaagtatgatcttatgagtcgtgattagaatctcaatctctagcccgcttcttggttgctgattagggtagtatcggagtttcagctgatcttacctgatttaactactttttatcctatatgtttgattgacatgttaaatctgccctttacgttaagatcttgctgcatttaagtatattaggcttttgtttagtatattctactcgctttaatatcttaatatagagtgatatcggagtattagccgatacatgctagatctatctgatcggctatgctataaacgtatatagtctcattattaatatatatttcgatctatgtgatttatactgtctcggcatagcgaccgatctatcccaatcacttgatttaagtatatatcgatataatgattatatattgttaatatctacagccaatcgagtagatttagtcccttcttatttcttaatgactgccgatcaatgtatatatgacatcggcacctagccgatcggctattatttatagatttaactgcggtttctttgcttctatttcttgttgattacaggatcaaatcaactggcatgctcatacattcgaaggtgagatttggacctgtactagagttaagtaaatctcccaggcctcgtgttttctgtcaacacgcttttggcacgcccggtgggacatttaagaagtcagccaacaattcgtcctca

SEQ ID NO: 1615 - DNA, 830 bp, Oryza sativa
gggcccacggcgccggccagtgtgagcctgggtgcaaccggtccaccgtggaccgtgaggctgccgcgtgggccccactcccgtggacccggtccgcgcgccccctccccctcagctgacgcaataaaccccttttttaaattaaaatttaaatgaagaaattcgcaaatattcatttaaagagcatataaacttcaaatggccataacttggccatttgaactcggaattggaccgttcaagtctctaatttttccttaagaagtcaagaaccaatttttgtgctttattcctgcttgttatatggagtttattagagtaaaagccttctcttttccgctcttcgtggaggttgaagccgacatttgggaaagcgagcaaggcaagacacatcatccttgagcatattgaatcccagtttataaaattattttgatttaaattattgcattatcgctttacttaaattcccgcgttatcactgttttatctagccatgcctatttacttttgttatgaccttattattattattgttattattaccttgttcaccctagattaaacaaaaccccaactagtggacactctactcatggtaccactagtatgattttaggtagatgcttcgctggttaattagccaacattaggtggttttacaactctagactttgggatatttatatcacctggacactatggaatggttggattattgtggaattagattcacacctccccctctattcaaaatcctcaaaatggttttaggctgggctcggggtgcatggttttgatagtagcacctcggccatataaggaccggt

SEQ ID NO: 1616 - DNA, 1501 bp, Oryza sativa
acagccctagtgccgttgccctcctctccgccgccaccgccaccgctccggccaccgctagccgccgttagccgccgtgccgagccgtgccgtcgatgccgttgcgttcgccgtcgtgcaggccgtctcgtccacctctcctccgtcagaaaccgccgccgtaacccactccgcatcgtgcgccggtgagcaccgccatggccgccgccttcggctggcgtcctcgccctcttctatccacctctctctctctaaccccttttatcatgttcgctaggtggtttcggagctcgtgccactgccgtcatcgccctccgtcgctcgccgtcgtcaatcgccgtcggtgaggcacctcctccccttcctccctctctcccacgcagcttagccgccgtgccgccgcctagccgcttagccgccgctagcgccgtccgcgtcgccgcgacgtcgccgccctccgcccccagccggtcgccgccggtcgccgacttgcgccgccacggcatcgagccgtgccgccgtgcaccatggccgccgggccggcttgagccgcccgagcgcgccggccgcgtggttccgccgctgagggtagatcggggccgtcggttcagctgcccgcgtggctgccaggtggccgccacgtgtgcgccacgtcggcgccacatcagcgccacgtggtgcgctgccccttccccggtccatggacccagtccaccgcggaccgccacccgagtcactgacatgtgggcccgcatgtcggcgccgccccctctctctccctgggattttaattattgcgcaataaatcaattaaggattttaattattgctccgtttaagcccattcaagtcttagtaaatcaagaaaaatgcatagaatccattaaaaatggttttgttctctgtttcaatagtcttatggcctgtttgtattgtttgttttgtatgtcgcttagattccggttctcccgacgctccggtgtactttgaaatagtcgccgaggttcctccagcagcaaagcaaggcaagtcatgcattacgattgatcatattgtacccaatttacaaatgtcccgtatttctattaaatgttgcattgttttacaatgtcatgtgggatgggtcctactactcggccatatattgtttaccttttgccattgataacttaggtattaaaatgattagatgttggtttagggaatgcttagccatgcttagttcaaccagtacacaaagggggatcactttaatgcctagactttgattattggcatagctttggattagtaccaccgcaatggtgttgattaattaaaatatattaaatggttggctgtgggtgcatgattttgatggtcgcgcccatggcacttaaggaccggttcgcgggatgccctggaagaacttatcgtacttaccacaagccagcgtgggtaacggctgggcttgtagtgtagctttgctctagctgacacatccaggcaagggtgggcgtga

SEQ ID NO: 1617 - DNA, 1501 bp, Oryza sativa
cccgaccctgggtcccagctcatcccaagccaacccaggccaaccattccacattttagttgttaagcaggttttaagaattaaaaacactaacttgggtacattgctcggcttgcccataaccgagggcgcggctattcgaataggttatactctaatcagaggtgtacatctttacccacaagacacatcttcctcacgtgtaaccacgtgccacataccaccatggtatacggacggaagacgtgacatagtttccaacccatcctagccatagacaagagtaccgacccaaccccacctacggccggaacccccgggacaggtaggcaggactaagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaagagaggcccgaagaccggtccttatatggccgaggtgctactatcaaaaccatgcaccccgagcccagcctaaaaccattttgagggttttgaatagaggggaggtgtgaatccaattccacaatgatccaacaattccatagtgtccaggtgatgagaatactcccaaagtctagagttgtaaaaccacctaatgttgcctaattaaccagcgaagcatctacctaaaagcatactagtggtaccatgagtagagtgtccactagttggggtttggtttaatctagggtgaacaaggtaataataacaataacaataataaggtcataacaaaggtaaataggcatggctagataaaacagtgataacgcgtgaatttaagtaaagcgataatgcaataatttaaatcaaaataattttataaactaggattcaatatgctcaaggatgatgtgacttgccttgctcgctttcccaaacgtcggcttcaacctccacgaagagcggatcttccgaagctgcagcatctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaggggtttattgcgtcagccaagggggaggggacgcgcggaccgggtccacgggagtggggcccacgcggcagcctcacggcccacagtggaccgggcgcacctgggctcgcaccagccggcgccgtgggtcccacgtgtcagccgcacccaagggcgcgggcggctgacggccgggccccacgcggcagccactcggcgcgcacgagggcggcca

SEQ ID NO: 1618 - DNA, 1501 bp, Oryza sativa
cagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttattgcgtcagccgagggggagggggcgcgcggaccgggtccacgggggtggggcccacgcggcagcctcacggtccacggtggaccggttgcacccgggctcacaccggccggcgccgtgggccccacacgtcagccacacctgagggcacgggcggctgacggccgggccccacgcggcagccactcggcgcgcccgagggcggcca

SEQ ID NO: 1619 - DNA, 1501 bp, Oryza sativa
tggaaattactgaaaaaatcttgtgccgcatcactattctgattatgatttcctccttgcaacccctgagcaccatcaccttgcactccatgcaccccgtcaccttgcactccatggactccttgagaattgtcaccttgatttcctagagagctgtcgatagcacttttgttactcagctgagccgagccgtctggagcttgttttccatctccatccttagaagaactggtccctggatcatcagcaaccacttctattttgtacttctaaacaagtgtccccttgcgggtctgcatgaatgagttcaagaactgatcccgtgcttgctgcaacattgcttcaaactctatcttctgctcaggtgtgaatttttctggatcgatcggcacgacgtttccttcattgacgtcagtcaaccctaatttcagcaccttttccttaacagagcctgggctagctggggatggtggtggtggttgtttctcggccatgaggacgaattgttggctgacttcttaaatgtcccaccgggcgtgccaaaagcgtgttgacagaaaacacgaggcctgggagatttacttaactctagtacaggtccaaatctcaccttcgaatgtatgagcatgccagttgatttgatcctgtaatcaacaagaaatagaagcaaagaaaccgcagttaaatctataaataatagccgatcggctaggtgccgatgtcatatatacattgatcggcagtcattaagaaataagaagggactaaatctactcgattggctgtagatattaacaatatataatcattatatcgatatatacttaaatcaagtgattgggatagatcggtcgctatgccgagacagtataaatcacatagatcgaaatatatattaataatgagactatatacgtttatagcatagccgatcagatagatctagcatgtatcggctaatactccgatatcactctatattaagatattaaagcgagtagaatatactaaacaaaagcctaatatacttaaatgcagcaagatcttaacgtaaagggcagatttaacatgtcaatcaaacatataggataaaaagtagttaaatcaggtaagatcagctgaaactccgatactaccctaatcagcaaccaagaagcgggctagagattgagattctaatcacgactcataagatcatacttaactgatgcagctataagtatgaaaagaagaacaatgtctagacaatcaagccgttggatgtgtcatagagtggtagatatcctatataatctaagtcaacatcggtgtttaacctagtcggctgccttctattgacggatgttagccgattgtaggttagatatcgatattgccaaggattatgtaggatatatgataactcgacgaattacataaacaagattagagtgtcataaagatggaaacactaatcccgagaacgcaagccaccataacaagtttgacctcttggtgaaga

SEQ ID NO: 1620 - DNA, 1501 bp, Oryza sativa
taaacagagcgctatattacatctttgcctacgtgagatgcaaggaatccaactgggatattacaatttagctacacatgaaaagcctagctttgctcgccgtgtgcctctccgtacagaatatctgctactgctcgctagctggctgctccaacggtggatggatgggcctaccccgattggccgatttcatcagcaaaactacgtagaaaaatgggagtaattggccaaaggccaaagcatgcatgaaccgaaccacatgatttgcacccgaggaggttgcgaaatcacattttgcatgacacatgatggccccactttagttaaaaataattaatccttccatttccagagttccagacttccagtgctagctcttcctcgggttcaaatagcgcgacaacatcacgcatcgcctcctacctgacacaccacactgcaaaccactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccgctggcgggcggcactaccgcggtgtgaggcggcggccgtgggggaagtacgccgcggagatccgtgacccgacgcggcacggcgcgcggctgtggctcggcaccttcggcacggccgaggaggccgccgcggcgtacgaccgcgccgcgttccgcatgcggggcgccaaggcgctgctcaacttcccgccggctgtcgccggtgacggcgcccgtcgcggcgccgccgcggccgcgaagcaggtcggcatgagcgacggtgagtgcgtgatatgaaatgaagatcagtttgacatgtacagcgcgtaggatgaggatcaaaacccagggttaatttgcagtaggcacttggcctgagtgttagtgtggtaatgttctgccttattgatggtacagtggtaccaagagcatgtcatgtagtttgttactctgtgcttagtgctcacattttttatgatatctttcgtggtgtgataccaattccgtgagcaaagtttcacttgaaggcatcaatcgtgctttccaagcacgaagaaaatattgtaacatggcgatatgtccaagatatcatcaaagtgcagcgttctagattgatgacagtttagcctgtgtaaagc

SEQ ID NO: 1621 - DNA, 1501 bp, Oryza sativa
gttatttatagtctctctacaaaatattcatatcagcatattttcttacttgaaagaaattaaatgaatagagagagcaaagctatatactaacctggagatagtctatatagaaaaacgaggcaatagattagagagctatagatacccatgtagacatactattgagatggtttactattaatctagtttattgttgagatgtacatgttttatagagagcaccttaatttaccattgcaggtgctctaactactatgtaattgaaccactgacatgtggaacataacaaagtgggacttatatatcagtgactcaattgcatgcgaagttaagttaggctgtgttcgatacccttgagttcctcgtgtacgcttttcaaattgctaaacgttttttcaaaaagtttttatacgaaagttgcttaaaaaatcatattgatcttttttttaaaaaaaaatacataatacttaattaatcacgcgctaatgcaccgttccattttcgtgtgcagtatatgtgttcccaaccctgagagccaaacacagccttagaggaggatcttcttctattggtcactagagtaggtaaccatacatgcatatccgtgcattaataaacagagcgctatattacatctttgcctacgtgagatgcaaggaatccaactgggatattacaatttagctacacatgaaaagcctagctttgctcgccgtgtgcctctccgtacagaatatctgctactgctcgctagctggctgctccaacggtggatggatgggcctaccccgattggccgatttcatcagcaaaactacgtagaaaaatgggagtaattggccaaaggccaaagcatgcatgaaccgaaccacatgatttgcacccgaggaggttgcgaaatcacattttgcatgacacatgatggccccactttagttaaaaataattaatccttccatttccagagttccagacttccagtgctagctcttcctcgggttcaaatagcgcgacaacatcacgcatcgcctcctacctgacacaccacactgcaaaccactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccg

SEQ ID NO: 1622 - DNA, 1501 bp, Oryza sativa
atatccatacctgattttccttcatagaacatctttagatccccaccagcggaaaatgcacgtccagccccctgttcatcagcagaccatacattcatatgcttgggccaatcgatgggtatcatacaaagtcataacaaaaagtttcatttgtgacatgatacgcctcatttcatcgctgtcttattgccaaacttatccatatcaaaacgttaccttatgtatcagtactaactactgagtaaagtccaaatgttgaccaggcacaccttaccgaatccttaaacaagcaacacgtttctctacatagtttgtactactagccaagtgctccatgcattgcaaggactttgaagaaacaaactagagtaaggtaaatgatttgtttgagctgtctcctggaaacaaatcacgcatgacatcactaggctaaaacctatccttgtctgaattataattagttatgttctgccctagagctttatcaatgcagggtgctaagagggcagcagtgcgcgcaccttgaagatgaccagcttggcatcctcatctttctcccagctctccaagaactgggcgaggagatacacctgcaaccagaaaccgagcacggcccagccaattacagcttccagctgctgcttccggcataagatcggaaaatgcacgaagcgaaagaaatcgcaccactctatcggagatgacgttcagctggcgcggccggttgaggatcgccaccctcgcgccgccggtctcctgcccgagcaccacctgcacaaagaaacggcgccgcgcgttctcactctcaccacaccacatactacaagagagaagaaaatggcctcgttcgcgtggggctgatcggtacctcgtcgggattcgcctgctgctgctgctgctccggctccgccatcagggagggacccgaattccgcgggaagggagctcagctcgagttaggtgctccaagagaacgagttgggcgaagcaggcgtggagggaagtttggtgagggggagccggtggaggggatggtgtagtagtagtggtggagcggtaggcggggttggtgcgggaagaaagcgagggcgaacggaagaagaccatggacagctgggtcgatgcagtttgacttctaattcacacctctttgagaatttatcggttttcacttcgggatcattttgaatgatgcgttatcacttatcagtggactagtcctccctccgccgccccatttccttttaagtgtgactttgatttttcgtcttatttaaaaaaaactaaaatataagtcacgtataaattactatccatattttatcatttcataacagtaaaaatactaattttaaaaaattttcaaataaaacggaaaatcaaagttggatacggataatcatagttgcacttaaaatgagacagagagagtactccctctgttttagattataagacgttttgagtttaatcaaagtcaaactgatttaagtttaaccaa

SEQ ID NO: 1623 - DNA, 1501 bp, Oryza sativa
tccttgtgaaagcctccaaaaattaaaatgtgcaaagttaaaagtcaaataaggcttggaggatttttgtatatttcctaaaagcctaaaatatgtaaataaattttagtggaattttcagagcacaaataataattgttaagaaataaacaaagttgaaaaggttttataaaaagaaaaacaataaaaccctccctccctctcttgggccggctcggcccacttccctccccatctctcctcttcccccgtggcccactcggcccctccccgcgcgcgcgccgctgatgggcgggcccgcccgccaccctcgctgacgggtggggcccacccgtcatctccttcctcccgccgctcccgccgcctcacccgcgcctagcgccgccgccgccgcgaatcccgccgcctcccgccgtccccgcgtgcaataaagtggggggaatcattccccgtgatcccctctccctttccccccatttctccctctttctctctcgcattcaaacgggcggatttgctcccgcaaatctcgccggcaccattgatggcggccggacctcccggccggtttccttcctctcccggccgccctctcccccttccaaccctatttaaaccctccccgcacctccttcgcccgtttccaccctttgccgcaccgtctcctcgccggaatcgagctcgtgccgtcgccctctctctcctccgtcgctgacgacctccggccggccttctcagctcgccgggaccgtctcctgtcccggcgtcgcctcgtccggcttcgccgcaccgccgtcgaccccgtccaccccctcgccgagctcgccgaccgtcggagcgccgccgaccccgttgacccgagccgtgccgccgccttcctccgctccggtcgcctttttcgtcgtcgccgtcgacctagggtgagccgtggaccgccgcctcgtttccccctttccctcccctctctcggccgccgctccgccgtgcctatggccgccgccggcgaccataggggggcgtgggcgcgccgcctcccgccgaccgcgccggcatggccgccttcgggcgcgccgagtggccgccgcgtgaggcccggccgtcagccgcccgcgccctcgggtgtggctgacgcgtgggacccacagcgccggtcgatgtgagcccgggtgcgcccggtccaccgtggaccgtgaggctgccacgtgggccccactcccgtggacccggtccgcgcgcccctccctctcggctgacgcaataaaccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatgaagtgtcacgaccggaattaacccaacgggcattccttacgtgcatgtattattccttgtccc

SEQ ID NO: 1624 - DNA, 544 bp, Oryza sativa
cgagcccgagcgccccgagcaccgccgccgcgccggcgccggcgccgccccgcccccgcttgcgcgcgcggagggtcgccattggggacacgctggggttagggtttgatgaggctggggttgagtggagcttgagttaagactggttggagttggggtttttcctgaaaggggaggggaagtggtgggagtgggcgacgagacgagcagagagagagagagagagagagagagagggagaggagtttggttcgtggattgatttgaacgagagggaagtttgcagccacgcccccttcacagctcgtacgccactgacacgtgggacccacgttaataacgggcccacgtatcagtgacttgcggtagggaacgtccctgtgcgctccgagatttgggggaatcaggacgctactgtttctcgtgatgctgtgtgcggctggtgtgtgggcgactccgtctgtggcgcccaggaagtcggcgagtacacccgcgtgagagcacactggtgcgtggcgaggtgcgaaaggcttctgaattctga

SEQ ID NO: 1625 - DNA, 1501 bp, Oryza sativa
aatgctagtactactacttgcacaaacagtagtactaccacacatttcttaatagggcactaatttaatcagatgtcgcgcaagcaagctaagctagctaggaaagggaccacgcacaacacaccactgcccactggccaatccatccatgcagaagcagaaccatgtgcgtctggatcatggcatgacatgccattgccactacgtctacgtgggctggttggtgccgtacggggggtgaggtgaagtaagacatccgcaggcgtgcatatgcacgagggtgggggctcacgctctcgctcatctcctcgccacattgtgtgctattgccagccaaccagtgtggctgtgtccatcggtcggtctcaaactggcgccacttctgtccgtgaaactcatcgacgggtcgcttactacatcgcacagaatgcagattgcacagccacgaacggttgatctgacgtgagtttgtagagttgaggtagggtgttcggtttcctagctaggattcagaattgtgccgcgtttcgaaacgagcgtcaactcggcttgctagagctcgaagagcggattggtatagggtgtgataactagttttgagtttggtgttgtcgtcgttgatatgttcgtattgcacgtatatgtatgtatacctgcagggttgtgacgctgcgctcgagctcggagatgtactgaagcttcctcactcgcgacctctgggccgactgccgattagccagtatcctgaagacatttccaaagaagagaacacggtaattaatcgaggaatttatagtgtcgtaaagtgatttgtaattgatcactagatgcatgcatggacgcagtgcccaaccgggcgcgttcgctcgcttacctcttgaccctcttggggtcccggatcagctccgtcggcgaggtggccgccgcctgctcctgcgtcggctccccggcggcgtgctgcccgtcgtcgctctgcgccgcggcgtgcttgtcgccgccgccgtcgctgtcgctgccgccgttgtcggaccccggggccgacgacccgccctcgtcggggaacatagacatgagctggtcgtcgtcgagcctgtcgaactcgccgcccgccccgcaccccgccggcgccacctcgacgaacgccacggagtcgctcagcgaccggcggtgcgcgccccgccgcgacgccgcgaactcggcgaactcatccgcccacgccgcgtcgccggcgcccccggccgaggcccagtgctggtggtgccccggcgccgccaccgggatcttgggcgggagctgcgccatgtacgtgtccttagcctatagtagcgatcgatctcgcgagcttgggctaaccacctagctctggcgcgcgcgttggacggcgccgcaacatggatctgccggtttttgttttatactagcatgctagtactactacagtatgctagctgcaaagcgctatagccaccacgccaccttgttactacgacggagggaattg

SEQ ID NO: 1626 - DNA, 1501 bp, Oryza sativa
acctcccgactaatccatctcgtcatctcctccctcctcaatcgaggcagcgagtatggaggtcggcgtgaggtcagatgtgacgggttttataaatggtgggcccagttgtcagtatcacaaacttacaaaataagtactccctccgtcccataatgtaattacctaggatgggtcaatgtatctaaacatgaggcatgtctatatacattatcctaggatgagtctcatctcatccttgttgctacatattaggatggaggtagtattaaacactttttattagtagtcatggcccatatgtcatagggacaactgattactacctccgtcccaaaataattgtaattctatgttgtttatcatatattaaggtttgagaagaaagactatggtgcccctcattaaatggtgtttatgtgagagtgggaagatggttaagggtataatagggagaaatttgaatgatagatgattgatggggcaattagtactctaaaattacaattattttgggacaaagtttgaatcatagaaatacaattattttgggacggaggtagtattagttaacttaactacttatgtcccaaaaatataagaacctatgattggatgagacatttcctagtacaacaaatctagacaggctagaaaatgtcccattcgatcatagattcttatattttgggatggagagtattccattagacttaatcagatttttctcttctctcgcgtgagcacggggaggcgccaaccggagggggggcggccggcgatgggatgcccaggggaaccacggccaccgcttgggtgacgccacggtagctagggacaggtgtggagccggtggaggttgggtgcggcggcgacggtctccgggaactaggcacaccggcgaagccgaggccgacgacggggtctaggagcgccggtggggctcgccgaagtacacacgaaggcgaccggtggctgggatgggtggtggaggtggggcacgggacgacatggggatgatctagaggaacaaattcatcgtggttgaggcgcaaatggccgggacgttgctccgaggagcatcaccgccgcaagagagatgattgccttgcttggcatggttggggagggctgctagtggtgcggtcggcggcggcctccgcacgggcgccgtggggcagcagagcagctcgcgcggctcggcgcggagccgagtaggagaaaattggcataataccatattaccatcgtcaaaactcaggatgggaatggttaaggtgtaggatcaagaaggccgactagaggggggtgaataggcggtttttcaaacttttggctaaaaccgagttttgtatgcggaagcgtaaatcaaaatggttttgcacaattcgaaacctaaatcaactagtctcaagtaagtgcacaaagaagctagcctatgttgaggtttgcaagcctagggtgataatagcacaaagtatgtaaacttgctcaaagtaaa

SEQ ID NO: 1627 - DNA, 1501 bp, Oryza sativa
tgggcatcggtgctatcaattttctgcatctattcagccaatccaatagcacgtactacgtaggccacactagagaaacgacatgctaaaaccattcactgtaatccatttcagattttaataaatgagacaagcaaactacggttctaattagtacctgaagaacgcacaaacaacattgcaacactgttattcagccgaattaaccgaataaaatctccaagatttcagcaattgaaaagacaacaagtcatgacagcttattcaacaaacagatcccacgcaacagtctgagcactccaaaatactccctgtccaattaaaacagtatggagaacaaaccgaacggagagtccttctcccggtcgcagtctcgaggcatccaccggaggcagcactcacagaaacttcctgtacggccggccggcgtcctcgtcctgcatatgctgcaaccaaacaagcacgcacagagagagattcttcgttaggacctggataacccaagagggcacggcaaggaagaggagggggggttcggaggaggggattacgaattcgcggacgatgcccttgtagacgaggatggggacggcgagtccgaagaggccgacgacggcgaggctgcggcgggtccagcggaagttgaactcgaggttctcgcggcctgcgttccactcctcgatccacttgttcttgtgcacctccatgccgccccccatcttctccgctccctctcctcgatccgccgccgccgccgcctcctctctccggctgcgagaatgcgctggtgggctcgtgaaaaggggcaaagacccgacgccgatctggtttggggagacggccgcaaggtcgctactgtccctggcgtttggggattaccaaggatgccgcgaggattgcaacccgcatgcggagaacgagagcgtacttccgggctcacacttgcgggttatgaatgcacatcacccagaaacccgtgtcagcttcgggaagacgggtttccataatacgttgcctttgttgaatccagaaaagatttaatccggaaaataaagcagttgcgtcttgcaaacagctgaattctcgtttgaatttttttaatatgcgtaggaaatataaatagcattgtattttaaatcaatggaggatcattatgggttgttttgagtagttatatatagtttttatgtacttcctatatcctataaaaaagcaaattgacaggaggaatttgcacatagttctacagatttattttcatgtgacggagggagtacacttcatacacattaagaaacattagccaaaagggtggagcaatttcaatttgttctcccttgtgatttgggttgtaaaatttggcgatatatatggatttttagttctaccctcacaactaaaaggatttatattaggtagatgaaactaattttgctacttgtgttttcatatgatctttttttaaacactgtataaacacatacgctcacaatacttaaaa

SEQ ID NO: 1628 - DNA, 1501 bp, Oryza sativa
cttctaaacggcgtgtgcttaaaagcaaatatttataaaattttatttgaatacttttctaaatatgactttttaactctgtagtagttaatttatttatttatgtcctcagatagtataaaaatagattattcattaatcctctaatttcaattatctcagggtttgtttgacacaattctagctctaactccatctctcgtggagctgaatgttagccaaacagtttaatgtccattaaaaatagaagtaaaactagatcgagcgctctaaacaaataaatatagagatgagactagtttaggttgctccacgaaacatctttgaaatgtttaggcaaccgatcacctgcaagattgtaagcttttattgtcagctcgtaataggacgcaacagtaataggtagacaaatccattcaacacaaaatgcatagcctttcttggcactccagggcttccaaagtaatggagcaattccatgctagattgaccctaacgaagacaagagtacaaagaccagtctaaaaaagagagtagtacaaagctaaactattccgaataatctcgccaatgcaaacagttgatcaactcttcccccttagccccatctcaaattcacaatcttgtgagcgaattcagagatgcgaataggaatattttgtacgtgtgtgaatacatatgagtaagtgcgtaagtattgtgagtgtttatatagtttttttaagtattgtgagcgtatgtgtttatacagtgtttaaaaaaagatcatatgaaaacacaagtagcaaaattagtttcatctacctaatataaatccttttagttgtgagggtagaactaaaaatccatatatatcgccaaattttacaacccaaatcacaagggagaacaaattgaaattgctccacccttttggctaatgtttcttaatgtgtatgaagtgtactccctccgtcacatgaaaataaatctgtagaactatgtgcaaattcctcctgtcaatttgcttttttataggatataggaagtacataaaaactatatataactactcaaaacaacccataatgatcctccattgatttaaaatacaatgctatttatatttcctacgcatattaaaaaaattcaaacgagaattcagctgtttgcaagacgcaactgctttattttccggattaaatcttttctggattcaacaaaggcaacgtattatggaaacccgtcttcccgaagctgacacgggtttctgggtgatgtgcattcataacccgcaagtgtgagcccggaagtacgctctcgttctccgcatgcgggttgcaatcctcgcggcatccttggtaatccccaaacgccagggacagtagcgaccttgcggccgtctccccaaaccagatcggcgtcgggtctttgccccttttcacgagcccaccagcgcattctcgcagccggagagaggaggcggcggcggcggcggatcgaggagagggagcggagaaga

SEQ ID NO: 1629 - DNA, 1501 bp, Oryza sativa
  unsure (1)..(1501): unsure at all n locations
atttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctanagtcctggtttgataagattgtaaagtagatttaggaaaccgataccggattggttaaggtttctatcttgtaaccctgccccccaacctatataaggagggcagggagcccctctagggcatga

SEQ ID NO: 1630 - DNA, 1501 bp, Oryza sativa
aaactttatttaaagagaaaaaaggcatacatgtctatctcaatccttcctgctacgtgggtatgtcagactgtctgcagccaagtactagtggagaaagcgataacgtaagccgaaaataaatagataacgagatcggacggtcagaggtgcgtcgcgcgattagactaaaacgagagcgcgcactgtttagattttacgatgtgatatatatatatatacatacatatatatatatatatatacatatatatatatatatacatatatatatatatatatatatctgtgtgtgtgtgaaaaataaacttatttttggaacggagaaagtcgtcgatgcttcttctcctttgtgataatggctgtatttagatctaaagtttgtatccaaagttcagtcctttttcatcacaattttaactaaaatccaaactttgcgctgaactaaacacagccaattttgttctgccctcatataggcctgcactaggtcggatttttttttgaaaagaaaagtttgccagctaattaattgtggtcacatcaacatatatatagaagtcgtcgttcacagaaaagaacaacacgtacagtatttaataaactaaaagcatcgtgcgataatgtttaatcaaactttttgcttgaatgaaaatctctatgatggcaagttaattactactccagcagtccagctgataatatatatttgagaattaatacaggaattattaagcttttaaaattttgattgttgattagatgttaacttttttaaataaaaaagcaagcagaatatcattatatatcataaacttattacattcttataaactcatgataatatagaactgatgcccgaagtttcgtataaattttaaatgtttgaccgaatcatgcatgttatatataagcaccaaaatattaataaggagagggagtctaatatttgaaggtaccttccaaaaagtaaatgcgtgcatgcgcgcatacatatatattgtaatgttaattctgaataaactcatcttgacatctgcctcctcgggtgtaaaaaccgttaattgttaagtttaagttagatgtgtatgttatgtagcacttttggtatgtgtggatggatatatgggatgtcatagttttgaacttttcttgggagggctgtctgtggttctggagtttatcctataagatggctgtctatggttttccgctggcattgctatatttggaggtttcttgggagtgtagtgtggccctgcccccctcccactgatcggagttgcgtttagccgccgcagtagtctcttttcctagctacagttgttggttttgctttttcttccttcccctggcatagaccagtttggttggttgtgttgtgtaaaaaaactattttttccttctaatatatcgacgtgcaatctttttacgtgttcgtgaaaaaaatagttatgaatttttcaaagtacaacaatacatgactgcgtcctcttcgtcc

SEQ ID NO: 1631 - DNA, 1501 bp, Oryza sativa
ctataactgtttgagaagaccaactgttaaataccttagcccgtcttttaaaacactgaataaatgtaatatatgtctgtctatatggtggtatttctttttctatcttatcgatggtctgttatgagttggctgaagttatctggacacatattgaaacaagtggctatagtctttttaagcaaatcaaataatatatattgttattaattatgttaaataaatctagctaggccatatgtgcatgcatcatcagagattcagaaacaatatttccttcgcctaattaataattagtcgtactctatataacttataagctgtactttttaatgaaaagatatcttgaatccatgcatgcataatgaagcatgttcaatttactaatccttacgattttacaatccaatcatcatgctgtcgaattcccaagaatcagcgatatagcgtatctcgtgaaagtgatatcgggggctccatttcttcgccttgttttgtccatttcttcctcctctgctgctggcatgcacgcttctcctttattttttttccatgcatatgatctcatgaacagggccatcttgtttgattcttccctttaaaactacaaaatgctttctccttttcatctttttgagttgacatattgtctaacctatagctacttttaataaacaaacaaattaacaccttctagaatgatgagttttttaactttaaagacagaaattaatcatgttctacacatatatagtactatatatatcacctgcttaattagtaactgatttaatcctgagtatatatacatgtggcagctgaggaaaagaagtaattaaataaattagcaacgaacctagctagtcggctagctctaggtaggtatatagggcgtatttttggatattttcttggcatgagccggctaggtttgctgctgtgtttgaatgaagaaaataggtctcgtcgaaatcagagtagggcccacccgtcggtactgcctccaaaaggccaagcaaaacttcaaacacgtcgtcatgcatgcatggagattaattatttgcaaggattaattttattaactcgatcgactgcagtatattgcatcatttcaaatgcataactaaaataatactccctccattttttaaatattttattgagaaacacaggacaaacataaatacataatcactcataagtcataacgcgcgcatacttataccctcattctttttatatgatgttggtttgttcaatagtactctctccgtttcaggttaattataagacgttttaattttaattaaagtcaaactatttcaagtttgactaagtttataaataaatatagtaatatttataatattaaattagtttcatcaaatcaataattaaatatattttcataataaatttgtaatgggttaaaaatgttactatttttttttataaatttggtcaatcataaaacagtttaattttaaccaaagtcaaaaca

SEQ ID NO: 1632 - DNA, 1501 bp, Oryza sativa
atgggtgaccgccatgaacttcaccaatgcgggcctgccaaggaccgcgttgtagggcagattgagatccgccacatcaaagtcgagccgttcggtgcggaagttggtaggatcaccaaaggtgaccaggagcacaatatgaccggacggccacgtgtgtcccggggtcactcctatgatgggtagcgacgtcttaagcttcatccctggggccttgatggcgtcgaaggccgcgggggagatgatgtttagtgcgaccccgccgttgattaggacgcgcttcatcttaacgttgcagatggtttgcgataccaccagcgccaactgccctccccgggaaaccactggcgggtggtcggtttggtcgaaggtgagcttcacctccgaccagcgtgctcgccgtgtcgcctcatgggtagggacagcggccagaagctcgcgcttcatggccttaaagctacggtcggatgcgtgggcgcatgctccacagtcgacggtggcgatagtggtgtcaagctcctagaactccaggtcctcatcaccattgtcgacgggggccttcttcttggcctcctctcgccgcttgtcggccgaggtctccggggctttaccctcccggtgaccctgccgcttctcctgatgcgacttcttgacgcgcttggccaaggacttgatcgtgcgacagtcagcaaggctgtgggtggaggtattgtggatgatgcaccacttatctagtgagcggctctcacaaggggcggcggtgtccttctgtttgatgctcgcggccttttctttgtgcgggggccgcaaggtgccttcggcggtgaggacgtggtccttgtcgccggatcggaccgatctcttcttcttcctcttctctcgccgcttggagcaggaggaggactcaggggcagccgcagccgccgcgccagagctggaggagttccaagcccacgcctcctctttgcgggccacgtgatccgcgagctgaaaaagctccgcgtatgttttgtgctccttggaggcgaccttcttcagcacgcggttatgccacacgcccccctaaatgcgtagatgaccgcgtgaggagggatgcatgggatcgatggtgttgcggacctgacagaactgctagatgtatgagtggagggactcatcgtccttccgttgtaccgcacgctgttaacgacgaaatttggtaagcccaaagtcatcatcggcttagagtcagtatcggcttcagagttatggaatcagccgatgggagtcgtcaaatcaccagcaaccgtgttctcgatggagttggatcaactaaagggaatttatccagaagagtccgagttcaagaaggatgcggcatggcagtttatctattaattatgaatagtttgttagtttccttttatctttagaaagtgtgtttagtgtccgataaggattttatcttttccttttatctttagtttctttcctgtccgacaaggactagtatctccctatg

SEQ ID NO: 1633 - DNA, 1501 bp, Oryza sativa
tgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgttgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgtcatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatacacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 1634 - DNA, 1501 bp, Oryza sativa
tttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 1635 - DNA, 1501 bp, Oryza sativa
aaagaaaagaactccctctcaacgcaatccacaggggtggatcacccctaactcactttgcaagaactcacatcatgctcaatagagaggttttgtaaaaatatcagcatgtcgtttctcggatttaacaaactctagcacaatgtgttgacgaaaaatccacgcccagctaatggtgccaaatctgtgttgatgcgaactatgtcgacaaacacaatgccgggagatctgcttagctgccgggagatctgcttagcttcagtgcaggtccaaaaatttggattcgaatgcgggcgtgccagtcagtttgatattgcgactgacaggatagataaattgatgatcacatagtcgatcgaccaataaggcgatatggcgataccagacgatgttgataggattttgaacacatcggctatatgtccgatatagattctgacacttagataaataatgatataaagacaatcgactgatgataatataatgaaataaatatccaataaaccaattagccaacaatgatatgatagaataaatattaatctgatggttaaagcatacatcggctgggaatctgatgtcattagaatttaaatccaaaagattaggcaatcaataaaaccttgctgcaattggctaaaaccaacttgtatataatccttataagccgatgcaacatttaaataacttatcgactgaaaccccaatgaaacattgattcatgtttactaacttaaataaatctaacttacaaccacaaccctacagggcgaacacaactggatgtagcataaggttgataattacctgatagatttaagcaagccaatatgacaccaatcaaagtgatcatgtattaaatttgactaagacagtaaaatcatcaaagagaaatttaacacatcaaataaaccccccgatgaaacattagcacgaacctatcggcttaacaagactttgattattaataacaattgaggtcggacctaaccgatgcagcacgagattgcgtttaataatctgatctcaatgagtcgataaaactttctaatgcgatggatataacaaatctatttaaaatagcattgtgattgtagagatatgtcggctaagacaagatcagacctaaccaagatagtcctaactaaattgatgcgtctctaaacacaatgcaattaaaaatacaattcaaatatcaggtaggtaaaatataccaaccgaaccagagcaatccaagaggtcaaagcgatggagccttgaacaacaccaatataaccaatacaactaccagggccggcagaacttaggggttaccccttcaccgaagatcaaagacatgcagccccgcgttaggtgccaagttctgcaggtaacaaaaacctcggaaaagagggtgttatgcgccaatattgatccagagataaatggcaatgaccccaagtgtacatatttataccctcgggctgatacgagtcctaatcggacacgttacaagttt

SEQ ID NO: 1636 - DNA, 1501 bp, Oryza sativa
tatatctaagttctataaagatttgggttacagcaataaagagtgtgttctatgaaattcaaccccgttgagttttccatttttagagctagtatgaattttacaagttatgtgaccaattgtagtatttactagctatactatattttagaagttttaactctactccatccgtctcattttaagtgtatttttttggtttctgtgtccaatatttggccgtctgtcttatttgaatttttttatgattagcaatcttattgttattagatgataaaacatgaataatactttatctgcgactttttttaactttctcataaatttttcaaataagacgaacaatcaaacgttgaaaacagaaacccataactgcacttaaaatgggactgagggagtagtactatatgttctacatttaattcagagtaattaagatcataaaattatgagtctaacgaatgtagagccactgcatttgaacttataactaattatttataaattttagaagtttttatatgatgttttcttatcaacgaccaatgagcagtgactgggcctaaaccagtcacaaatgtcaaagatacatcattggtatcgaaaggataaggtgaaatttccagacttatcaatttcatacgactttgaggcagatcatgtgttgactaatgtaatggaatggacttccattgtcgaggaaattaccacgtaaatttgttcttacttttctattcttgaagtttcaactatttcatacctgtggacagtgacaattttcccatgattgacatgttcgatgacataatccaaagtaataacgatataagctctacaaatatagattagtgatctgccaaagaaaataacaaatacgtttaaaattaatatccatcatgttcctccaattagttttataaagcattgatattcctttttcctgacaacagggcaccataggacaaaagtgtttgtctaatgcacaaaatatgtaagaggtttgatagcacagtttactttgtggattgttaggtgaaattggaaaaagatcatgcttttcaaatgaaccatcagaagttcagaactggtctacaccgcgtcgcaaaataccgtcagacggatgttggaaaatgtacgtaggcaggcaaattgtcagttggtataactaactaataaggtaccattacttattttgctgaaaaataaggtctgaaagtttgcataataaaacaatctagtcaaagcttaattcaacaagatctccgtaattaagtccatgcacgcaacctaatcatgttcaacaggaattaatgcattcactatttgactaagaatatggcaccatccaacaatcaacatgggtcaaagatgtggccaatatatggttttaatgggtagaagatcttgacgcatcctagtccactataattaagaatcacaagcatctcataacttaccaccagcatactgtccaaaatacacaccagcaaattaagcaaga

SEQ ID NO: 1637 - DNA, 1501 bp, Oryza sativa
accttatttttcagcaaaataagtaatggtaccttattagttagttataccaactgacaatttgcctgcctacgtacattttccaacatccgtctgacggtattttgcgacgcggtgtagaccagttctgaacttctgatggttcatttgaaaagcatgatctttttccaatttcacctaacaatccacaaagtaaactgtgctatcaaacctcttacatattttgtgcattagacaaacacttttgtcctatggtgccctgttgtcaggaaaaaggaatatcaatgctttataaaactaattggaggaacatgatggatattaattttaaacgtatttgttattttctttggcagatcactaatctatatttgtagagcttatatcgttattactttggattatgtcatcgaacatgtcaatcatgggaaaattgtcactgtccacaggtatgaaatagttgaaacttcaagaatagaaaagtaagaacaaatttacgtggtaatttcctcgacaatggaagtccattccattacattagtcaacacatgatctgcctcaaagtcgtatgaaattgataagtctggaaatttcaccttatcctttcgataccaatgatgtatctttgacatttgtgactggtttaggcccagtcactgctcattggtcgttgataagaaaacatcatataaaaacttctaaaatttataaataattagttataagttcaaatgcagtggctctacattcgttagactcataattttatgatcttaattactctgaattaaatgtagaacatatagtactactccctcagtcccattttaagtgcagttatgggtttctgttttcaacgtttgattgttcgtcttatttgaaaaatttatgagaaagttaaaaaaagtcgcagataaagtattattcatgttttatcatctaataacaataagattgctaatcataaaaaaattcaaataagacagacggccaaatattggacacagaaaccaaaaaaatacacttaaaatgagacggatggagtagagttaaaacttctaaaatatagtatagctagtaaatactacaattggtcacataacttgtaaaattcatactagctctaaaaatggaaaactcaacggggttgaatttcatagaacacactctttattgctgtaacccaaatctttatagaacttagatataaactatacttagaattatttaacttaaataaagtataactaacatagagcttggtaaattcataactcacaaatgctaagtgataaaatagaattattgcttaggttagaattgttgcttaggtttgagtgatgtgggaatagttgatcttcaggatggttctactaggggcctacccctagtcggtttgctgtgtgctaaggtagataggcttttcactgaacctttatctagttgtttctaagaccatgtttggaaccagggactagagtttagtccctgtcatatcgaa

SEQ ID NO: 1638 - DNA, 1501 bp, Oryza sativa
caaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttccgtcatcttcgactataaatagaggggtggatgttagggaaagtagtgtccctttagagccccttggagtagtcccttaaaatctctttagtgtcccttctgcccatggatgtgtacttctttatgagagatagccttcagggcttttaagagtttaaattcaaaacaagtgaaggtgtatgattgcttgtctctttagtgttttctttttaacacctttcgtatcaaagatattctggagttggatttaatttcagtttttgcgctacggtctaagggaattcttcgctaaagattttttatgggtattcaatgaagaatttcaatacactatatacgacgactttgtccaaaaatgccatcgccgttatcgtcgttagggttccgtccattccgcgacattaagtgctataagatgaacaatgtacttaactccgcgacattaagtgctataggatgaacagtgtacttaacagtgcaaaatagacagaaccctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgcca

SEQ ID NO: 1639 - DNA, 1501 bp, Oryza sativa; identical to SEQ ID NO: 1634

SEQ ID NO: 1640 - DNA, 1501 bp, Oryza sativa
tctgtaggtcggcctatccattccgggccaagctaaaaaaaaaaaaggtgaaaaccaataagccaatagtgaaggagagaatatttgacccgaaaaaggccaagaatacgtaccagcagtgatctccagggcgctctcaagtctcaaagattctaagctttcccttctttttttttgaaaaaaaaaagttgatccataagcctattgaaatcacacacatggcaaaaaggatgtgctgtcacatacaaattaacagacacacgcacagcacacacgctagagatgcgtatgtagctttatccatatttcattccaattgttagaaaaggaaaaagaaattcctttcaagttaaaaaggaaaagagaaatgcttacgacctgtgtacgcatgcctcaattctttttcaatgatagaatcgagatgaatccagtctctatatatgaagatatacttaaaaaaaatacacgtgcgttgcaatgggtgaaggctatatatcttagggcttaggctctgttcgcaagagctggttcacaactccctgctctcgttttccgtccgcgcgcttttcaaatagctaaacggtgcgttttttgaaaaaaaaaatctctacggaagttgcttaaaaatcatattgatccatttttgaaaaaaaaaagaaaatacttaattaatcacgtgctaatggaccgttctgtttccgtgcgtactgtttgggtcaggaaccggttggagcgaacacagccttaatcttattattgttatacgatttagctaaactgaaattcactataggaatttacttgaatattgtttttacaagatcatgagctacaataattaggagtccgattgtctcaagttagcatgcgagttctttaaagagaattcttatacgactctttctatattttcaaaagcaaacgaatttaaaaacctacccaaatacaaatatgtaatttcaaaagcgaatgaacttaaaaaccggctcaaacatgaataacgtatcaaaataccggcaaaaacatctttaatttttataatagtagagatatattttgacatacatattttgttttcttaaaaacaaacacaattgaatcgagtctctacatcaaatatgtagttgaacatacatctgccgtcctaggaaatcaaattaaagacacgctagaaataaatttgtcagacctgtcaaaatctaggagaatttgtcaccgaagcgccggccggagaacgatgcatgcgaatgtgtgatgtgcaaggtcggcagtttgtaccctataaatagcacgcaacccttgtagcttttgtcccaacacaacacaaaccaattctatctacacagctagccatcgccgacgacaacacacacccaaaaaacatatacagcatatataccagctgcaagctcctgtagctcgcagtatttgttctcactgctgtctagctcaatccccagcacaatatagctagctagcaattcgatccaattaagcaaat

SEQ ID NO: 1641 - DNA, 1501 bp, Oryza sativa
agatttataagttgtttagccaatattaaggttagctcgagagattccattttagtcacttcagatattaatcataaattttatattgttcatatttcctttccaagcatcattgaaaataatgggaaccatggaaatcattacaataatcctcttaaactatggtataaaatttggatcagaaaaaaccttatacttggatgggggagtaatagttttctttatatttttatagaaaaaaagttatatatagtttgggaatttactcaactattcagtactatggggatgtttagatccatgatggcatgatgtgtgtaaagttttagcgtgttacgtcagatatacggacacatatttaaagtattaaacgtagactaaggtggtgtttggatccagggacttaactttagtctctgtatttagacactaatttagagtattaaatatagactacttacaaaactaattacataaatgaaagctaatttgtgagacaatttttttaagcctaattaatccataattagagaatgtttactgtagcatcacataggctaatcatggattaattagtctcaatagattcgtctcgcgaattagtccaagattatggatgggttttattaatagtctacgtttaatatttataattagtgtccaaacatccgatgtgatagggacttaaaagttttagccccatctaaacagggtctaataataaaacaaattacagattccgactgtaaactgtgagacaaatttattaagcctaattaatctgtcattagcaaatgtttactgtagcaccacattgtcaaattaatcatggagcaattgggcttaaaaggttcgtctcacaatttacacgtaatttatgtaattagttattttttcgtttatatttaatactctataaatatgtcaaacattcaatatgacatgatgaaaattttgccaggggattcccgggcttgtcgattagccatactttctgacggtcttccatcaactgtgcctccagtaaaacatttgtgaagagtttcacttgattgtcgactctgccactggtgggtaggtgggctttgaatcccaattttgttactcccttcggcctctcattggaccaacagataatcctcttttttgacacgccaaacaaaccaaacagatactaatcaattaatccctgatcacgattaaattaaatggataatcaccagcagttaacggagcacaccaacaaccaggagattaaagtgggctcggtcaatccaaacggcttggaaagtgattactatccgcagtagcagcatcagctgctgccatggaaggagagagaaagagagagagatcttagcttgcttggcgccaataaataggagcccgggtcatcggcgaatccattgccattgcagttgtatccttcttcttcttcttctttctctactcacctgcatctgtagagagagagagagagagagagagagagagagagaga

SEQ ID NO: 1642 - DNA, 1501 bp, Oryza sativa
tggcacatggaagaaaaaaaaaatgattgcactgctactggttggtctcctaacaactgaactaactgaacaatcagcactttcagaagctagaatgatgtggaaacccaattttagtttgtataatacttcgaaccagcattcgacagacaaaatgattctctaatttgaatatatcactaaaacaactaatgtagatatcattttaattagttggcagcatttactgtaacttgaatggtctagagttattataataaagattggggaatggatgaatgtaacacaggtatgtctttaaaaaataatagatatcattaacaaattatacaacagagggaagaccataaacgtactgaaatgttgtggacaaccatatgatgccactatagattacacaggtgtaattgtgcaaaagctgagagcaaatatctatgcaattcttatccaatcaccgggttaggtttttcatctattcaactcatacttaaggaaactgaaaattactttgcaagaaatatggaagaccatactctgttacaagtcttatagatattattattgtattagcaagaaaggaacatatcaattacttaatgagtgatgtccatagtaaatcatatataaactgttgagaattaagacatgataaagcaccttagaattaggtgacaagtcttgataggctatgactaaagcataagcacatgatttctcaaacagtaaaagagaagaacaaaagaaaatgtctaaaaaaattacaacagcactgataaacaaattcaacagtaaacaatttagggtaaaaaggcataccttacagtaactattcaaagaatttgcagccttgtagatctcatattccattgtgtgtgcgtaagggaagttcagccacgacctcaatgtactcagatcagtgacatcatgagttggaggttgtgaagcacgactgatccgatttatcaagtaaggttgaatactctctagacgtaccccgcaaacatcacaaaccctttgaggttctgaagtattaaatttcggtggcatcaagcttctaccctttgaacaaccaccacaaaacacaccaccacagaaacgacaatgatgtcgagagcacattatcggatgaaaacgcacgttacagagcatgcaggcgctggcagcgctgtcaggtaaccatattgttcgttcagtctctaggagctcattcgcaatgccagcattggcatctgcaagtgtttgggccatatccttccaagcttcttggaagaaaaacttggacaacatagacataccacgtctcccaagatcatacgatgcaactgatattaccttatcctttgccgcaacaaccatctcagaaaatacatcccacatcgtcatctccttgttctcttcatctatctcccagttaaattcgtcttctggaaagtagtcaccattatgaccaaagcccttatgccactcctcgtgatcgcgtttggtcattggcgggacagaa

SEQ ID NO: 1643 - DNA, 1501 bp, Oryza sativa
gggcgattggaggagggagggattaggtgaggggggcgttgggtgaggtcaggtcaggtggaggtgagaccgagacgagcggtggcgcggagacggtcggtgccctgcgcggcgaggggtggaggaggaagaggaggaggaggagagggcggcgtgttctagaggaggaaggggaagaggggaggaggaggagcgggtgacatgtcaaccttggcttcgctgcttcggtttcgtcttcgcctttctctatctctcgttgcgttgggatccgcggttttgccaggttttttttttttttttggttttggttttggtttttgttggcttgcggcgccgcggagtgtggggaaacgctacgcgtactggtgggggggtaaactttgctttcgggaggggtgtgacactggtgggctgggcccaccctgcagacagagctgtccgaccttatcaaggttcagacattttgttttttttttctttttttttcctgtctcgctctaacgtggttttgagatggatgaagataaagtgagcgttggcaaaacgagaaaattattagtttatgattaattgatttttaattattataaacttaaaaattaaatttatttgatatttttaagtgacttctatatagaaacaattttaaaacaaacgtaccgtttagcaatttgaaaaacatgctaataaaaactaaggtaaaatctgcatcgtaattagaaataaagaaatactccctccgtcccaaaatataagcatttttagctataaatctagacactaaccaaaagttactatattttgggacggaggtagtagcaagatataacagtagagttaactactactactgctgtatgtaaatccatctaaccataatattaggactaacatgtataattataagtacatgttaagattttatcttagtttccgttagcatgttttctaaactactaaataatgtgtttcatgctaaaactttctatatagaaattgatttaaaatattaaatatatccattgtcaaatttataataattaaaacttaattatgtgctaatggctttctcattttacgtgcatcaacttaatcttcatctttattagtttcaaacctaattggctataagtttatcttcaaatttttctcctcttccttttttttcacttatgtatttaattaatacatatatcttgaatcacttcattatctaaaaataatatcttgaagcacttgtaaagttagcttgatcgactaatttctttttttctctcttctctgctagttactatctccatcctaaaatgtaagcatttttagctatgaatctagataactgtgtgtgcagatttatagccaaaagttattatattttgaaacggggatagtactccacttctctaaggtcaagtgggaagagcttcatgtaaaaaaaatgtggggagagcttacctaaagttacaagtttaaacggtactctgtgttaattaagtccatc

SEQ ID NO: 1644 - DNA, 1501 bp, Oryza sativa
gtttcaccattattggttttacttgtgtcgtcagtccatcacttggttttatgcttttttttacttggttattcttatatgcaaattctgtatctctttgttcttcggggctaactctctaatggatatcaaagaaaattgaactgggtgtaatttgatatagcttgactttctatgcttgatgcaagcatcattaacaaacacggccactgaaagttggtttgcgagctgattggagcatggtagaagacctcctcagcataatttgtttctattgcttcatgactctctcctgagtgtatgtcttgtgtaatgcactctggtatgatggtttaaaattgggttggtgagacctcagattcttccttcttccttggatcttctcattttcttttgatagtatatcgttctttggggttttcttatataagagtacattggagatcgctaataagagtggtgactgggcggctctggcatacggagattttaacggctctatgaaaagcaattctttgacataatccagtatagtgttggtgatcttttgtggctatttagttgtagcctccgccgttggcctagtcacctccaaccgctcgtgttttttttttctttttaggtgtttccatgtgtggggctgtgagcactagaaggatcataggatttgttgccagagttggatacacaaccattgtgcgctcacttcgtttggctgaatgagcttaatcgaatcagccatctgatgggcttcggctgaaacgcccctagctcaatcagccatccgatggagtcctattttttttccacataatacaattaaattattgcataaatgattttttttcttagtgttcaaatgatccctccgaattttcatacacctagttaaatttcgagatattacaattttatcacatataagtggtcgacatttgctcattttttgacttgtgtccccattgggtcaggttgtcgtagctatatgatccatgtttggggagcttttgccagctgcactttctccgagaattagaagctctcataaacagtactacatttcattcagattttgagaagctatagttataaaattaaaaaataaactataagcgaaaaccctatttttctagaacaatcagctgtttctcaccgtacaaacgagcagattttgcttaaaatccacgctttcttcaattaataaaaactacgagggtgtcatcgtaaagcaccgccacaaaagccctacccttgaaccctctcccaccccgcctccacatctcctttgccgccgctgccgccgcctcgccatcccgagcgagcatgcggccgccctcctccacctcctcccctcgccgccttcccgtttgctagggctccggccgccttgccgttccttcccctcctcgtcatcactagggtttcgacctcgcgccgcgggggagtttgtagcccgactgacccgaagctgttgccgccgcccgccctcccggccgcgcca

SEQ ID NO: 1645 - DNA, 1501 bp, Oryza sativa
gacgccggagatgacgaacatgaggtagaaggtgatgatgaactcgaggacgagcgactgcacgtcggagccggcggggagcgtgccggggaagtgctcgtggcggccgccgaacatgagccggagcgtgccggcggcgagggtggcgcccagcatctgcgccgccgcgtacgccggcacctgccgccaagggaacctccggcacgtcgcgaacgccagcgtcaccgcggggttgaagtgcgcgccggagatgtgccccacggcgtacaccatcaccatcaccgccagcccccacacgatcgccacccccgggaacgtgatctgcccgttcttgctctggttgatcgtcaccgccccgcaccccgcgaagatcaagaagtatgtcccaaagatctccgcgatgatctacaccatgatcgatcaatgcgcgcgcccgccattgtcaagatcaagaactctcaagatcaggaggaagaagaagacatgaaatgatgatcaccttctggatgaaagggacggagaaggcgaggccgcagccctggccgtcggcggcgaactcctcctgcttcctgccttcctccatggctctctgctcgtgacctgagccgccattggtggtctgggagttgttgtcacctcctgccatctctctctctctctctctctctctctctctctctctacagatgcaggtgagtagagaaagaagaagaagaagaaggatacaactgcaatggcaatggattcgccgatgacccgggctcctatttattggcgccaagcaagctaagatctctctctctttctctctccttccatggcagcagctgatgctgctactgcggatagtaatcactttccaagccgtttggattgaccgagcccactttaatctcctggttgttggtgtgctccgttaactgctggtgattatccatttaatttaatcgtgatcagggattaattgattagtatctgtttggtttgtttggcgtgtcaaaaaagaggattatctgttggtccaatgagaggccgaagggagtaacaaaattgggattcaaagcccacctacccaccagtggcagagtcgacaatcaagtgaaactcttcacaaatgttttactggaggcacagttgatggaagaccgtcagaaagtatggctaatcgacaagcccgggaatcccctggcaaaattttcatcatgtcatattgaatgtttgacatatttatagagtattaaatataaacgaaaaaataactaattacataaattacgtgtaaattgtgagacgaaccttttaagcccaattgctccatgattaatttgacaatgtggtgctacagtaaacatttgctaatgacagattaattaggcttaataaatttgtctcacagtttacagtcggaatctgtaatttgttttattattagaccctgtttagatggggctaaaacttttaagtccctatcacatcggatgtttggacactaattataaat

SEQ ID NO: 1646 - DNA, 1501 bp, Oryza sativa
gagaagtggagtactatccccgtttcaaaatataataacttttggctataaatctgcacacacagttatctagattcatagctaaaaatgcttacattttaggatggagatagtaactagcagagaagagagaaaaaaagaaattagtcgatcaagctaactttacaagtgcttcaagatattatttttagataatgaagtgattcaagatatatgtattaattaaatacataagtgaaaaaaaaggaagaggagaaaaatttgaagataaacttatagccaattaggtttgaaactaataaagatgaagattaagttgatgcacgtaaaatgagaaagccattagcacataattaagttttaattattataaatttgacaatggatatatttaatattttaaatcaatttctatatagaaagttttagcatgaaacacattatttagtagtttagaaaacatgctaacggaaactaagataaaatcttaacatgtacttataattatacatgttagtcctaatattatggttagatggatttacatacagcagtagtagtagttaactctactgttatatcttgctactacctccgtcccaaaatatagtaacttttggttagtgtctagatttatagctaaaaatgcttatattttgggacggagggagtatttctttatttctaattacgatgcagattttaccttagtttttattagcatgtttttcaaattgctaaacggtacgtttgttttaaaattgtttctatatagaagtcacttaaaaatatcaaataaatttaatttttaagtttataataattaaaaatcaattaatcataaactaataattttctcgttttgccaacgctcactttatcttcatccatctcaaaaccacgttagagcgagacaggaaaaaaaaagaaaaaaaaaacaaaatgtctgaaccttgataaggtcggacagctctgtctgcagggtgggcccagcccaccagtgtcacacccctcccgaaagcaaagtttacccccccaccagtacgcgtagcgtttccccacactccgcggcgccgcaagccaacaaaaaccaaaaccaaaaccaaaaaaaaaaaaaaaacctggcaaaaccgcggatcccaacgcaacgagagatagagaaaggcgaagacgaaaccgaagcagcgaagccaaggttgacatgtcacccgctcctcctcctcccctcttccccttcctcctctagaacacgccgccctctcctcctcctcctcttcctcctccacccctcgccgcgcagggcaccgaccgtctccgcgccaccgctcgtctcggtctcacctccacctgacctgacctcacccaacgcccccctcacctaatccctccctcctccaatcgccctcgtcaaaggggtgcaagaatccaaggggggagtggttggggttgattggttcttggttgtggtggggcatggcggcggcggcgtcggcgtcgtcgc

SEQ ID NO: 1647 - DNA, 1501 bp, Oryza sativa
tttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaacattctttcactatttgctgaaacattgtttttatataaggtaaaacaacacccaattgaaacgagtgaaatattttcgatctacttagtaaaacaattccgatatacctggtggaacatcgtgcaacatttaaaaataattcaataataaggtaaattttttttcgtcgaaatatatgcctgtgtggccttgttttgaagatttaattgcagcgaatttaatgatgcaatcggattatgatatggataagtaatttaagagaaaaatcagtttaaaatagtttttcacgtaaagcgtccgatttttctccaaaccgatcagacgcacgatccgtagactcgtccgtccgtatatacatgtgggaccagcggtaaattcttaataattcccaatagtaagagtctgagcgtcttccccttccctttgtggcgtaaaagaaagaaaagaaaatctcccgtctctttgtctcctccgctccttgcgccgccgagacgagtcgcggctgaacaggggaggggcggcgatctccatcggggcgagcagagcaggggagaggattcatggtgagcatccgcatcctctttctgattcatctctctctctcccatcgggactacttttgtctggaatttgcttgcgttcgttcgttcgttcgttaaccctagcttctcttctagatctggaagaagctcttcccttaatttcagagccttaaccttaatacaagtaacagtttgtttattccccgagaagtttgaacccccatgtcccaagttggatccgctcctgtacataatattggcagcttgtggcactcttgaatggaggtcttggaagatactttagtacctgttctattagattggtgtgttataggccctgtgtggaatacaagaattttgctcggttttcacctttaattttccttgtatttccaccttgttttgttagatcgctgttgctcacttgcttgcaatgtaccgtta

SEQ ID NO: 1648 - DNA, 1501 bp, Oryza sativa
atttgagaatttaataaaacagttaagtaatatttaaacaatattaatccaacgctatacaacataccctgttgtataggcccaaccattctgaacaaccatacccggctgtacagatctatctccaaaccaggaatataccattccaaactaggagctaaacaaattattaccagttatagcatcttttattatgatgagaggtgtgagactaatcacgaaagacattgtcagacccgcccataaccgcgggcacggctattcgaatagttttactctgatcagaagtgtaccactgtacccacaagacacagccccacatcatgtcaccatgtgcctcaataccaccacggtacctcggaaaggagatgtgacaataccccttgcttaacacaatccaccgcagcgcaccattcctgcatcataatcacccccttataacaaggcatggactccccagcgacccccgtgggcttatctctgccacttctcagtctggccccgtgggcttatctccgccacttttcagtctggtgccccgcaataaactgtactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaattaattaatagtgaatcatgagttatcccaatagtgtgctaatgtttctaagcatggctaagcaatcatatctaatatctagttgaaccaatatatatatagcccaactagtcaagttataataacccaaggtatcaaggaataaagtaatcaaaatcaaaaagggctataacaaacaataggttaattccacccaatgacattcgaaaataaatgcaatagttgactagaaacagtagctttaaacgggatcaacatgctcaaagggttgtttgggatctgtgtgacttgccttgctggccttggaactcttcaaattcttcttctgcgaaaacggactctccggaaacgtcggaatctaaacagaaaagagcaaaaacaccaaaacagcacataaacaggcatgaacagtacatgtggatatttttaacatgtagatctcaattttagaaaaatttagagacttgaaccaactaaatccgagctaagatgaattagttatgaatttgtaaagattaaatcggattaaaacacttatatggattttaattgaattatgacgcaataatgaattatttttgaaaaggaaaagggaattattgcgtcagcggctagggttagcggtcgaccgggtgcacggcagcggttcacgggaacggacggccgagatcgatcttatccaaaacgaacggccgagatcgatcgggtctacggcggctcacggcagacggccccga

SEQ ID NO: 1649 - DNA, 1501 bp, Oryza sativa
catacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaaggacctctccttatgtattaccctctactacttcttcccctcgaccttgctcagtctgccaaacattttcagcttgtccaccttccaacggagtttcttccaccacggcatgacttgactcccccgatcgatcaacacatgttgtcttctgcaccactattgccaagctatagcctttctcccttactttactaacaaacttcctccaactcccagttgacgcaacctccactactctccactgccatccatgttgacccctcactggccacacggcatttatgacaaatttatcgtgcactagatctaccccaaacatattatacaaccaccctaacacgtcgttcaaacccatatgctccggtgcattcagactagtatcatggaaggcatatacagttaaatccaccccgctatcacatatttgtatagaagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaactttactgctggagggcgtcgccaacccttttctcccgaccggcgcctcctcggcctcctctccggcctgctatcccctcccctcgctccctccggcgctcacggcgacgatgtggcgactctcggcggcggctggcgatgtggtcctcaaacaaatcgaactcgcggccttggtggacggggctttaaaccggcctgtcgaacgcccattgttcgacagggtcggtggagggccccgtcgaacgcccccggttcgacaggcctcgcggc

SEQ ID NO: 1650 - DNA, 1501 bp, Oryza sativa
acagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagatctcgagatttgaggaattttggaagtcgaacggagtcaaacggatttacggttgggaagatattgaatttctaagattattggatttttggtctaaaggaaaaggatttaattaaatcctttttgaaaaagaaaagaaaagaaagaaaagagggatggaaattagacttttcctcgggcggctagggcgtggcccaagagaattagggcggtccggccgagctaaatgggccggccggcacaaggcggcccaagacggtcgcgcgcgcgggagggaggagagagagccggtggaccgggctcaccgtgcgcggtcccgggtgggacccgcttgtcagcggctcggctcaccgtgcggagggagtatgcggcgaacgcgcgcgggcgggggaaggacgcggtgcacgcgcgcggtctgcggaggaacggatgcggcgggcccacgcgcagcctcacggctcgcggtggaacgcgcgcacgggaggggctaaccggggtcggcccgacccgacctcggctgagctggcgccgacgtggcgcctacgtggctgccacgtgggatggcgggaggaagacgaaggcccggccgtgaatggaaggcgggcggcggtggtttctccggggcgccttgcgacgatgaggggcgacggggcgtacaccgagacgacgaggaagaaggagagggagcgagccaacggcttggattcgccggagggagtccgtcggcggcagatttcggcggcggcaaccggcggagagcaaaggggaaaacggcgacgaggtcacgaggggccaattcccagcggtgagagcatctacgcggccacgggaatccgttgctagcgtcggattgggcggagctacaccgagcgaggccggtgacgagcgggtgctacggagctcgggcggcgagccacggcgagcgacgacaacggtcggggcggcgccggctagctacggggaggctactcgtgctactaccaaaaactaagggggggagatagagagaggaggaagaacggagggaggcatcaccgagatgaggaggggcgctgtgacgagaggccgacggcgcgggagtgatctctccggcctcgggccggggaagaggaaggagaggacgcgcctggagtccccttccgcgtcctagtgcgcaccggctcctccggcacacacgcgacggctgcggtcggccagaaggacggcaatggcgcgggcgagaaacagggaagattgggaggggaaaaggggaagggagggcgcctg

SEQ ID NO: 1651 - DNA, 1501 bp, Oryza sativa
tcttcgcaatgggaagggttgaggctagaaggatatcgacttttgagagagaaaaattagggtttacttcgaggtttcaatcctagttcgtgagttgagaggggagtgttttaggtacactttgtaaacatatattgatgcaataaagttgatatactttcaagtgtttcgtcgatacgtgtttttctggatcctgacggttggaccggaggcaagtctgcagtctaaccactggcggtcacacccgcggcagggagacggttcaaccggcgacaaggcggcggttagaccggctgcgtgcgagtggttcgaccggcggcaatagaactacgtcgagatttccatcgatttgagggtaacttttattttcggtaaaagcttttggggttttggttttccttgccattcacccccctcctgataggcttggttattcgcgttcgatcctacaaactgcaacgaaccgagggagctaacgagatacaaggttttcacgagtcctatataattagctcggcttctagtctagtggcatttgatgaccctgtggttgacctgcgtggtgttcgtccccggtcggtacagcctcagcgggcacgtcgcgtccaccctcctcgtccggccggcgtgcaccggccggaacctcacctcgccggtgatcttcagctccagcgacgacacctcctcccccgcgcgcgcccatctccttcaccagctccgtcaacgccgcgccgccgagatgagccgccacgccctcgtcggtcacgccgaacctgtccgtctcggccgcctccaccctctgcccggcgtccgcgagatggacggcgtggaggagctcctccctggtggcgaggcggagctcggcggcgagcggccgggtgtactcggcgcggacggccatgttggggttgtgcacggcgacggtgagcgagatgccgtaggccaggtcggtgccgttggcgccggcgaggtcgaggcgtgtcagggacgcgtcctccaccgtgacgccgacgttgaagacgacgccgtacgagaggatcagcagcgcggcgaccagtaagagcaggagggtgcaacaggacgcgcacatcacgcagctccccggcccgcccgccattgttgcgatgacgccaagaaattacctacgtacctacgtgatcgatggatcgatccaccaatgagaacttcgccggaatcaccagcgtttatatatcggtggtagtgctgcttcttattatagttggccataaggcccgaggcccgaaggcccggcccacggcatgcctttttggcccggcccaagcacggcacggcccgacttgggttgggcccatgccggcccggcccgaccgtcgggccgtgcctgggcctccctaccagcacgctgggctggcctggcacggtcgggccggcccggcacgatgggctggcaggccagacccggtacacaaagtatagggactgaaaatagacatataaatgtcaatgtctaaagaatagg

SEQ ID NO: 1652 - DNA, 860 bp, Oryza sativa
tatattaaaataacgcttctgatagatattggaagatttccagatcaattggtgaaaaaactgatgcataagctagccatgatcgcaattattattattatttttacaatctgaaagaaatctgatcatttcagaagtgaaactatctctctcaaaaagaaaagaaaatacagaggagagaggttgagcttccccatcacaccacaggatgagggagttgctaagtactaaattagtatgctattctcagttgcttacctgcctcaagtaggttaactgccctctcacttcatccatgtcctcatgtccctttctcttccttgctataatctctctctctctctacgattagttaatgtcaggatcatctaccatatatgtgtcttctctcaaatttggagttattggatgcaacattagagtttcttggcaataatttggattgaaaagattcagatgttagcaacaccacatggcgacgaaatgtcaggactccttgtgaccttgtccatgaatacaagcatactatatttgcaaatgtaaactacttaaataagatgtgatgcctttagaattcatacaagagcaacaaaacatgccctacgtggattatcgccaatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggccaacca

SEQ ID NO: 1653 - DNA, 1501 bp, Oryza sativa
gaacccgcccccgcccccgtaggggacccggccccacgggggaaattgctgtcgaaactagatttcggcaataataaaagggggtggctatcaagctaggaaagtgtatgggtttggagacaaaagatttatacaggttcaggccttcttataaaagaagtaataccctactcctatccggggatgaatccgccgagtgtattattgattgtatgattcgggaaaaatcagcatatgcccctagaggcgcccggaccccccttatatatggggaaggagtccgggttacaaaagataatctatatccctaacggaatacgaaaatataagtaagatacagtcgtaaccgactaagtctcagggtgtttccttgatacacaagttaagaaacaaacccgaaatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggtgcctaaataagcatgctagccgactgctttttaaccacaataaaagaaatccgagtggtttacactctaaaaggttcacgaatgaacacactcgacaggcatccgaatataaaaactctaaagattacccatcaagtattataaagattatggtaataaataagtcaaatagcctaggccatgactatttaccatgaaaacaggcatataacacgccaaggaaataactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcgaatcaaatcagcacatttgagtgaaaccga

SEQ ID NO: 1654 - DNA, 1501 bp, Oryza sativa
tttattaccataatctttataatacttgatgggtaatctttagagtttttatattcggatgcctgtcgagtgtgttcattcgtgaaccttttagagtgtaaaccactcggatttcttttattgtggttaaaaagcagtcggctagcatgcttatttaggcaccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatttcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggataggagtagggtattacttcttttataagaaggcctgaacctgtataaatcttttgtctccaaacccatacactttcctagcttgatagccacccccttttattattgccgaaatctagtttcgacagcaatttcccccgtggggccgggtcccctacgggggcgggggcgggttcagtttttgacccgcgggggatgtggggccgggggcccgcatttttgtggggaggggacaggtgaggcatttcacccgtggggtgccgaagggtgtatattaaatctcaaaatgtaacccatagaagatctaaaagagccacaaaattttaagtaatagccttatcctctccactctccccatctcccctcccctcactctcactccatattaacttggagcgtcacaggctagttccggtcgggactagttcggggcgtgacattttttttatctattcgattgatttttctggtaggttgatttttcacatggaaacttttttttgggtgggtaattttttaaggcaacatggatttttcacgtgatggaagaagtgtgatggtgggagaagaggagaacgacgaccgcttttacagttgaaaagaaaagatgggaactgttttaatcacccggatggatgtccatccatttattacatgtcatttaaatggttatgaaaaaaatttaaaaacaattaacaagatagatcaatacgtaatatatcacttcacaaatattaaagttaaaattcaacttctacaaattgtaagaaaaat

SEQ ID NO: 1655 - DNA, 1501 bp, Oryza sativa
atctaatttgaaacttaatttgaaagccatattttaatctagatgtttttgggatgcttttaataaccaactaatgacaaatgttcttccttgtttagattctatttcaatcgaaactttccgcgttgatcctggtattcgagtactttattgaagaaatatacaaagataaaatttctctatcctaaaatataagatattttaaaaatattatattttgcgtatgaaggtagtaatcgctattgtgaagacacgaatgttcatatttacgcctaattatttttcagtggtaaaagaacatatctgtcacagtagaatacatatggcctcagccattctttaaaagatatcattacggataggacgtatgtgtatatgagtttgtacgtatgagcagctgcactactttgaaagaaacgtattttttgggttacactagctagagaattacttcctccgttacagctgcaatcttagaataaaatttgacctattctaaaacgttgaatctagactaacctatatatagattcgttattttatgataagtcaaatcccatataaaactaatagtatagtttactactaactctaaattatttatagttaatttaatatagtcaattcatacaatagctacctatatattacactatcgatacatggtgccagatatcatacacacattgtatttcgaagtccatgctacagctggctataaatttgtagtccgctgctttccctttcttttatcttctctttccctttctcttttatcttctcgaaatactccctccataaaaaaaaagacaaactctgggttttcgtatctaacgtttgactgcccgtcttataataattttttttatatttagtacttttattgttgttagatgataaacatgattaatactttatacgtgacttgtctttttaatttttttcataattttttcaaataagatggacggtcaaacattaggtacagaaacctagggtttgtcttttttttacataaagagtatgtttatagctggattatatagcacatgctctaactaatgttttgggacgcacgtactccctccgtctcataaaaaaccaaccactgaatatgacacattccagtactacgaatctgaacgtatttttattcagattacttgtactagaatgtatcatattaaggtctagattcaccttcttgggaacggagtgagtagcagcctgctagtgcaagcgaggcagcaggacaggacaggtgtccctgaaccaaaggctacgtgccatgccagggaagctttgaggtgccacgtggcccaacttcctcgatctgttctagagttgtcctccagctgagttctgcacttgctaaacatttcacacacacactcaacttgagaccatagcattctcagcttagcaccagctagctagctagctacctgaatactacactgaagaagaatcgatcgatatctgaaggaagtgaagtaagtga

SEQ ID NO: 1656 - DNA, 1501 bp, Oryza sativa
acgtaagtacataggtacatcaacatagattacgtacgtacgtacgtgggacacaagctgcatttttaactaatgttaccatatctttcacatgaccgttacaagccctttctggtaaaaaaaaaggttaaaattgtttattaagaaatcgacatggccggccggccgttaatttttgttataaaatatttggaaggcggtaaaattatactccatgtattacttaccgtctcaaaatatattaactaaatttaatttatctataattctgaacgcacaattatattttagtagtggtaaaagccgggagttatccatgggatgacccatagtctttcaaaacctccaaccaaaagaggggaggggagggcaagctagaaggagagaagatatcgctgatggcagcatgccgcatccatgtgtgcaacgctgaaattaattgaaccatgaaaaacgtatcgaattaggtccccagggtttggaggagaggggttggtggagggagcgtctttatagagaggtcatgtgtgaggtggaagatgtatcaataataggcggtggatttggtgggtagtgtggcggcgattgcaccaccttgacgatggtgtgagctaagagctagtagaggggtgaactgtcgagtagcggggaacctcattgaaatggttaggaggcagggagtagtgatggcatatccactggtgtgtaagtcgctagagacggaagaggagagatgccgcaccagagaagaagagaggagcgctacggccacaatagtatagtagggataaagcggtatgaggtaggtagctaggtgggtgcgtcctgcgagccttgttgatgccgagagcccgagacacgccaacgaggcaaagagcggcggtgtgtggataggcagatggaggttagggggtgagggtagggggaggcattgtggtggtgtataacgtgtgtacaaaacgaaccatgagaaaagaaggatagagtgggttagggttatacgtaggaaacaagactgaaatttagataaaaataaggtaattgagaagtaattaaacccttctaatatatacacgataaatatatatcaagcatcgacaattttaatttattttgatccactatcttcaatacagtatatgttatgttgtacttatcaatctttttcccctaacaatcaagatcaaatatatacagagatccactgtctaattttcaggcagacacttcaaataactgtcagagctgataagtgccaaccagtcaaccaattaatggcactatagcaagttaatgacagggccaaacatccattcctaccaacattaggtttaaacagtcagcttcacttccaatagcagcttgcttacccagctaagcgctgccactctcacactctctcttctctatatataccacatcaatggccacaaatccacttaactccccacaaacccagcaattaatcatcagctagctacaaggctgatcaagatgggct

SEQ ID NO: 1657 - DNA, 1501 bp, Oryza sativa
actcttctacagatagaacagactatgttgcaagccaaattcctgcatggaacaatatttgtattgcttgtgaaaagaaatatatgtgatgtttcctccatatgcttgagagattgtgttgcaggccggttgtgtgatgaatatcaaaacctaattacaactacattgctgaaaatttgtttcaaatttgtacagataatcagaggacaccatcacaccagtatgcactaggtgaagcatcctagtgttgctgcagataatcttctctgtgtactttgcaagtagcctaatggtatccaggaagagcttctgcagaaaccaccaccacaagatctttcagtgttataacttataatggttgcatttggtctctgaatcccattaaaccatgatccaaataaaactgaagaaacaaaagcaacttttctgtacattcatagtttttttttgggcatctaaaaggttttcccctttatttttccctcaagacacatgtttcaaccgaatgagattttcacaaatgcagagctaaggaaaactatatatatctcacaagttaacactcagcaaacaattaatatttgttccagaaccggtttgaggcataataaaacagaataaacttcattactattgtgtcatgtgctgaccaaagtataacaataactgatgaaaatgtagggtcatatttcaggcaacaaaccatctcaaggaggcacagcagatggatgagcttgttgatatggtacaccttagtcatgctctagattcttgtggtcatcagctaaactatcctcaacatgtacttatgcatacaggcatgctcaactgcaagatggagtggaagaacaccctcagtgacaatatctgatgctgcttgctggatggggaagaacccagagctgttcatgtagttggcacaacgcaggggcattgtgttgaacaatggaattgaagctttgagccattcggtccacatttcttcttatgaagagattgagcacagcgaaatatctgcaaattcggatccgttcatgtttcagaattcagagagggtaagattcagtcggttagtttttcgcagactgaagaaaaagaagatgttgctgaaattcatattatgatcaatggattgcggtgatcaattaattaatattccctccgtttctaaatatttgacgttaacttttcactacatgattgactgttcgtcttattcaaaaacttttatgaaatatgcaaaactatatatatatataacaataaatcaaatgataagaaaagaattaataattacttaaattttttgaataacacgaacggtcaaacatattttaaaaaaatcaacagcgtcaaatatttagaaacggagggagtatagtactaggcctaaatggctgtgacgtcaattttaaattttaaatttgaatttagaggattattttgaacggtcagtggtcaaaattttcaaaatttttgtgtggttggtgacccgaccccc

SEQ ID NO: 1658 - DNA, 1501 bp, Oryza sativa
tgaaaaatcaaatcaaatcaaacaaaacaagaatgaaggatgaactgcttacgccgatgccgtagcggaggaagacgccgagcggcggcagcaggatggccagcaagatctccaagaacgtctctgaacccatcacttacttcacttccttcagatatcgatcgattcttcttcagtgtagtattcaggtagctagctagctagctggtgctaagctgagaatgctatggtctcaagttgagtgtgtgtgtgaaatgtttagcaagtgcagaactcagctggaggacaactctagaacagatcgaggaagttgggccacgtggcacctcaaagcttccctggcatggcacgtagcctttggttcagggacacctgtcctgtcctgctgcctcgcttgcactagcaggctgctactcactccgttcccaagaaggtgaatctagaccttaatatgatacattctagtacaagtaatctgaataaaaatacgttcagattcgtagtactggaatgtgtcatattcagtggttggttttttatgagacggagggagtacgtgcgtcccaaaacattagttagagcatgtgctatataatccagctataaacatactctttatgtaaaaaaaagacaaaccctaggtttctgtacctaatgtttgaccgtccatcttatttgaaaaaattatgaaaaaaattaaaaagacaagtcacgtataaagtattaatcatgtttatcatctaacaacaataaaagtactaaatataaaaaaaattattataagacgggcagtcaaacgttagatacgaaaacccagagtttgtctttttttttatggagggagtatttcgagaagataaaagagaaagggaaagagaagataaaagaaagggaaagcagcggactacaaatttatagccagctgtagcatggacttcgaaatacaatgtgtgtatgatatctggcaccatgtatcgatagtgtaatatataggtagctattgtatgaattgactatattaaattaactataaataatttagagttagtagtaaactatactattagttttatatgggatttgacttatcataaaataacgaatctatatataggttagtctagattcaacgttttagaataggtcaaattttattctaagattgcagctgtaacggaggaagtaattctctagctagtgtaacccaaaaaatacgtttctttcaaagtagtgcagctgctcatacgtacaaactcatatacacatacgtcctatccgtaatgatatcttttaaagaatggctgaggccatatgtattctactgtgacagatatgttcttttaccactgaaaaataattaggcgtaaatatgaacattcgtgtcttcacaatagcgattactaccttcatacgcaaaatataatatttttaaaatatcttatattttaggatagagaaattttatctttgtatatttcttcaataaagtactcgaatacca

SEQ ID NO: 1659 - DNA, 1501 bp, Oryza sativa
cctgcttgtcaaatactcctactttttgatgctaagcttctctgcttcagattcctgcacacatttgcaacaaacacaacacttgtgtggctaattgcaccattagagaaatcagcaacttttgttgctttttgagtaggttccatgttccaatcccaacaaactcagaaatggcctcttctccttccagctcaaagtctttttcctttggcttcaagagagctgagagaggaatagaattatgtggttgtattaaaagagagcaaaagctgcagctcacctaatattcttcatcctggaagtctgaataattttctttctggtaaatgccaatccaatcaattagttaattgccaaaaaatcttttgtataaaactgatgaaatataccactgatgacaatttggtgaatgacagaggtagtgattttataattgcattggagaacttgtgattcagttaaaaaaatcggaggctctgaatttatgacagtttggccatgctagttgttcttggctgctagcttctgaatctgtgagagctatgcttcatcactgcggaatcctcaaaaccagccaaagatccagcagctggtggtagtcctgcagtccatttccaaccaagttgagaagttgtaatcagcagctctgaccataacactagtacttttcatcactggtcatacactaaaaccatcattaaacttacttgaaaacactatttgctctcctaatggaacacagtaccacaacaataataaaatgtgtaggtgcagccccaccccaatggccaccagatccatcactagagaattggagaaacaataaattattagtactattccatatactacattttcttcttactaccatttcaattcaaccatgaatgaaaaatgtgaaaatttttgtgtcggtgaggtgtgtgatttagcaggagagagagagagagagatttggttgatttgtttgcaagaaagaaaagcaaaaaaattgtggggtgttgtggccgttgatggacaggcaagtttcaccacactcctcccgccttctttaaaccctcctcaccaaccatctcatctctctcaccatttcattttatttttcatttttcaccacaaatttttcaccattccaagcaccacaaaaaccttgttcctcctcctcatctctctccatttctccccatatcttgattgagcttgttgagattccccatgcacattcctccctccatttccaccaccaccccaaatcttgttgggtgatctatctatctatcatcttcttgtaggagtactagtggagtttgttgatcttcacccccaccaccattaatggctgcaaagcttcactagaggaggaggactagtagtataccatcttcttcttcttctagcttgatctggtgctccattggtggtgttggtgcatcttgatctgggattctggggagaggttgagtgaatctttgggcctccatggggacggcggcggtggcgg

SEQ ID NO: 1660 - DNA, 1501 bp, Oryza sativa
ctaggaacagtgaatcctagagctttcttcttgactcttcccggaattcgagcaacttgtattgatgttctttcaattttgttcctgcataacgtttgaaaacaggtctagaatcgtagcatctccttgcatgattagccaagtcagataatgacgacccttttggacttgttgatcctaaagggatactgttatactcgaggaaaattagctactggcggtgggcccctggatagatgcagtcagtgctgtctcctggcaatcgttaagagccaggccaggtcaaagttttcctcttatcgacttataactcagagtcagagacgaggaaataaatggtgcacaggaatgcaacctcctaggtttttcaataataaaaaaagagagtaagcagtgtaatggtagtagtaccaccaacacacaacttgctctcaatagtagcaagtcaagtggaggaaccttggatccaggccgtttgcttttctatattgcccatgaggctataatttgataatatttttccttttaaaaaaggaaacttgatatttgtctcatgttgccaaccctatgattatattgtactccctcattccctaaatgtttgacactgttgacttttttaaacatgtttgaccgttcgttttattaaaaaacttttgtgatatgtgcaaaactatatgtatacataaaagtatatttaacaataaatcaaatgatagaaaaagaattaacaattacttaaatttttttaataagacgaatggtcaaacatttttaaaaaagtcaacggcgtcaaacattttgggatggaggtagtattgtgcaaatgtggctttggctagcaagctgggtatcttatacttaacaatatttttctgtgtgttggcaacttgtagtcttgtactaacatatatatatatatatatatatatatatatatatatatttgttgatgtccaacttgcaggcaaaaaattatcctcgatttcctagaagattggcgtgtattgcaatccttgtaccatcagagatgctaacccaccacctcacccctagttgtgcaaggaggcccaacagccaatttgaccacggtatttgccagtactgctgcagcaacgtaagacccattcttgctattttaaataccaatgctttgcaaaatatataccaactaaacaacagtattctgcaacctttatgtgcacatgtgatatgtttaatgtatatatagatcccttgcgttagttagatggtatttgttgctttataatactacaaactcaggcctcgcaaatagaaagtccggtatgtgggagagagaagttacatatatataatatactatatatactaatcaataatggatgcgacgaagactatttatctgcaagattcttggtgcctttgaggccactactactaggtgactgccaatagtaacatgttagttgagagggacttaagattccagcgtgagctacacctgtttatcttcaataga

SEQ ID NO: 1661 - DNA, 1501 bp, Oryza sativa
gatttttatacaggttcgggcccctaagttgtcaggtaataaccctacatcctattggccgaagccatcctgttggccgaagccggtattgctcttattcatgataatcacaccagtacaatatttgggtagccaatctaactgttgtcgacatggcagtctgacgatctgactcgtagtcgacaacagggtagccttcctcctcgaatccgtgcccggcgagatcagagatagcgctttcgtttctcctgacagtatccggagacaccgcaaggtattagccgtgcttatccttgaagtcgatatccggcggcgtgtcttggcgtatgtaggcttctatgttgattgtattgggtgttgatcctgtcgtgtgttgatcccgttgggtgttgattgtcttttcccatggtcgttccccctctcctctccaggggccctgtatttatactcataggtgtcctcttgtccaagtagaactagggaaaccaatatggatacaatctgagtagtccttgtcgttttcatgtagaactctggttgtctttccttatccagaactccctcgaggtcagtttccatataagacatggtatgtagtggatcctgccgagatttagtcaattactattaggtatgtggtatccataaccctgacattatcatattttggttttttataggacggagtgagagaagtaattatcaatttactactataaaaaacaaagtaaaaaaagttaaaaaccaccctttcagaaaccataaaagggacattttcacaagaaaatcaattcataaaaaaatcagtgtctctagaaaaaaaccaactagaagataaaataaataaagttgaacgtataaaatcatgtatatgctactggcacatgtatatgctaatatcactaaaatacagtacaccaacccatagaaattgtcccttctcaaaaaaaaccatagaaattgtgattagcaaaataatatagctagttgtacaccctaaactcataaagaaacgatagtccaataatctacgtttccaaagcccgacaggttgcatactttgcataacattgacatgtttgtccacatctcgtgtcacgctccagaccaaacaataaaatacttaaaaataatataaaaaaatagttctcactttatctcaaaataagcttagccattagtttccgtgtacaactttaattgtctgtcttatttttttaaaagaaaatatgagtcattattttatatcattaataactattaatgttttgtcattaataatagtaaaattactaatcataaagaatatgatttatgatgaacaatgtgaaactgcaggagtgagggagtaagaaagaaaaaacagtgaggatcacatcacagagcttcataattagcctcctaatccaccccaatcccccgccacgtgtccttcctccctctctcactctctctctctctctctccattaacgaggcagagccagtccgaatcggagctc

SEQ ID NO: 1662 - DNA, 1501 bp, Oryza sativa
aaaagtacttggacaaaagtaacctatgtaacataattgttcaaacattaatccacagaaaaaaaaagtccgtatatagaataatgttttcagttactgaaaaagatgaaactatgttattaagtgcattgctggaggatagcaccaaatgcattacatgaaccttatatagctggataaactgtcacactcacacagcccccccccccccaaaaaaaaacactgtaaggactcaacaaacacgggaaatgaaataggtatagtactattggatcaaatattacaaataaaacctaaatagaatagaggaaatacagttagaacagattgaagtaatgaaaaaacttaaattaacttcaaaataaaactactacagattaaatcatttcatttaattatcatttgtctgtcatttcctgaatcatggtacatgcatgaatgtgagcttatagtttatagttaactaataaaaagaggtgcaaccacatatcaacccatcatttcattaagcatgttcagcagagatataatgccagctccacttgagatgacaaaaggttccaatccaaaacagacacacattaaatcatcaatttaagtgacaactgatgtcacggaggaaactgaggatgaactttcatcagtgcacacacagacacttcatccaaggtgaattaaaaattcggtacagctatgtcttatggtgcttccaatgaacacaaatcatataaccacactcacttaggatcacacaaatcattcttagattcaaactacatatctgcaaaactacagatctgagcatccaaacaaaaaaccaaaacaaaagtaaatcagtctagggcattggtaaacagatctacatgagaaatcaaactctattaaatccagttaaaaacaacttcagatcacacatagtgttctacataatttagtacattcattttcagatctacaccacatcaagttcagacaaataactaaccttaactgaatccaccagatcgaagcttcaaatacctaagagaaaattaaacaacatgatctaatcgcacatgaacaacatcacatcgttgatgaaagccaaataacacaatgtccaaagcaaaaaacataagcacacacaaaatactactactcatccaaaaaaacgagatcccaaaaatcccctcctcataaacatgaacaaatcccctcctcatcaaaagcaaaaacaatccactcctcctcaacagcaacaaccacccacctctccccccaatcaacagcaaaaatgccccactcatcaacagaaaaaaatccactcaaaacctcaacagcagcaacaacccttcccaccactccacccacctcccccccccccccaatcaacagcaaaaatcccccacacatcaaacagtaacaatgccccactcatcaacagaaaaaaatccactcaaaacctcaacagcagcaacaacccttcccaccacccacccacctttgtgctcgaattaacagc

SEQ ID NO: 1663 - DNA, 636 bp, Oryza sativa
aaaaagaaaaactaattacccagtttgcatgtaaatcgcgagacgaatcttttgagtcttattagaccataattagccataagtgctacagtaaaccacatgtgctaatgatgaattaattaggctcaaaagattcatctcacggtttacaggcgagttgtgaaattagtttttttattcgtgtccaaaaaccccttctgacatccggtcaaacgtccgatgtgaaatccaaaattttttatttcaacaactaaacatgccctctattgaagataaacaggtgtagctcacgctggaatcttaagtccctctcaactaacatgttactattggcagtcacctagtagtagtggcctcaaaggcaccaagaatcttgcagataaatagtcttcgtcgcatccattattgattagtatatatagtatattatatatatgtaacttctctctcccacataccggactttctatttgcgaggcctgagtttgtagtattataaagcaacaaataccatctaactaacgcaagggatctatatatacattaaacatatcacatgtgcacataaaggttgcagaatactgttgtttagttggtatatattttgcaaagcattggtatttaaaatagcaagaa

SEQ ID NO: 1664 - DNA, 1501 bp, Oryza sativa
gttttggtcagtaataagccattacggcttataataaacttttggtcaaccgacaagtccgtttttccacgatgtatcgcaccaatgaaattcatgtgtataagtaaaggatgtgaaattcatgtgtttaagtaaaaggatgcttttaattaaattcatgttatcaacctttgaacataaatatcctaaggaaaaaaaatcatgtgtagtaagtctaaaggaggagtaattgatcgaaagaatcaacgcccacgtttcgtttatttggggaataagccaaagccaaacgatatatttgcaagcaaaaattaatttgtaaataaaatttgtatatacatgttcttaacgatctaaaagcaaatagctaaaaaataaacttcaatgtaaaaaccctaaaatcatctccaaatttaaaatttaaaatttatattttaactgataagtacaagcataattgaaaagatgagaccgcaagagtaccataccttaccttacatacgatggaggcagccacgtagcttcatatttccaagctactcctacccttggccttgggccctctgtcaggaaagatattttgagcccagagcaagcaaccaatggcaggcgcacgcacacaccaaatgaggctaccatcaaatggcctaatcaatcaaagaaaaagtcaaattttaaattttccagcttaattttaagatatttttaatgtagtttctttttcaatattaacttttaagtcaccaaaagcatatttataaaagtttcacctataaatatatttttatttcctaataagcccttttggccaaacgaggacctgagcaaatgagagaagagaagggaaaaaaaaagaaaaaagaaaagaagaaaaacggggcgcccaaatcgggaaggattttaaggataaccggctgcccaccggctacttcccgccttctatctatatatccccccctccctcctttttctcctcctcgccaccgctcgccggcgccggagaccaccaccaccacctcacctcacccacctctgcttcttcttcttcttcttccccgtggtgtggtgtggtggtgaattgttgttctgttcccttcatttttcgttgattcgtgagcgcggcgacgtacgtacggtggtaagcatcgtcgtggattcgtctccggcgacgggggggagtgggtagggtagggatgttcgtcaaggactgggactgaggtgatcggctaaatgtaccgccagaacgagtcggccctctcctgcttctacctcttcctcctctggttcttcttcttgaaatagactccacgccgcgccaattcccagcccgagcgggagccagctgctcaatccgtcgttgagattggttgcggtttgctctagcttgtgaactcggcggagatttttggttttttgttttggttttgggtttggttgggtgagtggtcgatcgatcggaaggtgttcgatcgattgcttgcctgctttgtgatggagttggatc

SEQ ID NO: 1665 - DNA, 1501 bp, Oryza sativa
aaactattacctctaaaatgactagttttagataagctgaactttagaagtttatataaaattcatcttagatcctttttgagtaaactcaagttctgtagaatcaccaaaatatttatttacaagttataaaataaaaatatatacttgctgtataataaaagcttctaaatatttatataaggaataaacaacattagagcatacgttaatttgtaaaatgtgtagaaaattcatctttagtccaaatggagtgaaccaaatttctatagaaccagcaaatagtaagcttcaacatagtaaaataaaatatagcaccttttgtacaggttatagctctaatatttaaatagataacctagaagttaatcacctagtaatggttaagcaaaaaaaatgtgtagaggtatttaaaatgtactctagctatgaataaaccaaaacagaacttgttagaccagagaggtcatatttccagccttagttcccaaaaacttagcatacttaactcatataacaatttctaggttggtatgttaagtaactaacatagaacatccctaattataaaatgtgtcgtaaaataatataaactctaaaattatgaactaagattagattagtcaactaaaataatcattttaaacatcactagcaggatggagcaagttatggacctaaatctccaaagccatgtacacatagcggactatatgcctagaacacgttataacttgcaaaatacataaagaattttggaaatacagatgagtcgtataagaaatctctgtaaaaaagacttgcatgataacttgacatgattttctagaaaaatatatattcaagtgaattctcatagtgaactaataataagattaaaatagccttcactcgttgttttttttgcatgctaacttgacatgattttgtaaaaaaatatacattcaagcgaattctcatagtgaaataataataagattaaaatgcggaggggggagacgggtatgtttttttagttactagcaataaaataaaaagcgggtatgtttttttttttaaaaaaaaagcaaagtggggggggggggggtttgggtttaataaaatgcagtgtgagagatcgatccctagtcggctggatgtaatggcaactcacccaccagcatgctaatctggttgttgtgaaatataatgaacagttaataaataatacatagaatggtggaccgggaacgtccggcccgagtccgagtaactcggggaaccgaacccaccaccggttcaactatgtattggagttgtattagctttggtaacatccacaacgtactatttgaagtgtcaagccaaaccaaaactagccctaaaactcaagggtaccccaaattccccatcgccgccgcccccgatccggcgatgccgctgcgcccgccgcccccgcctcagggattcctcaccgcgtatccatccgcagctttccctccggtgaagcggccgcatgagg

SEQ ID NO: 1666 - DNA, 1501 bp, Oryza sativa
actgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcattgatgtggtcacctaccctcttcatgccagtcttaacaatcaaattaattatatgacatgcacaacgctgatggagtagaaaagattgagcatacacacaaaataaaggttgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctgttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccactgccacgtgtcgccttcccgttggaccgccgcccgccctgtcacgcgccgccggcgctttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctactggctacttgggcattcaggggcgacgtggatagcgcggcgatcgaacacgcgactccaaatcgctgtgggagcttcaatcggggg

SEQ ID NO: 1667 - DNA, 1501 bp, Oryza sativa
aggctcacacaaagcattcagcaggcagaacaatttactgaagtgaaactgatctactaggttccatggccaaatctacaagttcaacatctgtgaagtcaactagaatctgaaggtgaaaccgtaaagtcactagaatctgtaactgaaacatatctactttctccgtttcacaatgtaaaaagtcattctagcattttccacattcatattgatgttaatgaacctagatatatatatatataacatcaatatgaatgtgggaaatgctacagtgacttacattgtaaaacggagggagtactaagtttcatggccaacaaacaaatctacaaagttcagaataaattgacaaaccagtaaatacaaatactgcaagagcaagttcagggtttagcatcatgcagaaactgtaagttgtgacaattccctggagtactaagttgagcatcatgcagtgtgcggagagttcagcgtcaacatgcactaagttcagaaaccagtaagattcagaaactgaaagtacatgttcatctccggcgacttgtgcctccagaccggcctgaatgcctgatcatcttgttcatcacctccagccacctcttctcctccatctcccttctcctcgtcttcgttacctctacctaggaaaaaaaaaagacttgagtatgaaacgagatgcagggcaatcggttatattaatacctccccccgattgaagctcccacagcgatttggagtcgcgtgttcgatcgccgcgctatccacgtcgcccctgaatgcccaagtagccagtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcgcacggcacggcccggcacggcccgtcaggccgaaagcgccggcggcgcgtgacagggcgggcggcggtccaacgggaaggcgacacgtggcagtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaacagctcgcggttggaaagatgtaagtaatattcaaatttgtgtattatttgtattgtgtttgtgaattcaataaatattcgaaaatttgtttatgtcggtttaaattttcagaa

SEQ ID NO: 1668 - DNA, 1501 bp, Oryza sativa
cttctattatgaaaatgtcaccgggaacatctattgtctaataataattgggatcgagcaattcatatactcccagatatgtctccttttttcaagacaggattcaataatcaacgtattaagctatggaactttattttagatcttgttcggttaatacatctcttaaagtattgaagctgtggaattaatttggagaattcctttatcacagattaactacacaaatcatgagaagagagttgacttaaaaataagaggtgatgcaagaaataaaaaaacactaggtacgataaatcaaaaaaagcaaaggtggggcattgaaaatgctactacaatgacgtggagaagtggtggccagaacccaaaacgcataaaaaatggctcgttaacaaacatggtactagtctcgtattaatcgagggtttaccttatcgtttccagatgaactcatctactctccctcgattcaccgatcaaaaaccgagcaaattaaaatcggtctgtgcaccaatacattaaattttaggtgtacaaataccctgcaaatatttatgattggtaaaaaaacatattaaattgttctagaagaagaaaagtcacaaaaccattgcttgcaatttgcaaatactccagtgtaaaggggagtactccaagaaaacaattctgccagtgggcccaggtggcgtggccggacacgtaaaccagcgaatgagaggatagcatagccaagggttggttttccggggaacacacggccggcagccgttgttgttgtgacttgtgagggaaggcaaatccaagcctgccttgctgttgccatcgtatgggaagaggacttgttgcttgtcttgtctcttgcatgctcagtgctgcatgcctagctagccggcatgttctaattggacaaactcactactgtttgttcatccattccgatggattatgacatggacatgtggtcttctatgcagggtctcccaaaccactgtggccggggttaccgcgtcccggcggtaagcacggttaccactgtataaaaccgtgtaaaatttatcaaaaatttaaattgttttttaaacttatttgaatttaaggaggttaccgcggtatttatattaccgtaccccgtgataagcccggtaaccgcagtaaccgcgcagttatcggcggtaaggtaacccctgcttccatggctatgtttcgagtagattttaactttttttcttcaaacttctaactttttcgtcacatcaaatgtttgaacacatgtatggagcatcaaatgtggacgaaaaaaaaaccaattgcacagtccgattgtaaattgcgagacgaatcttttgagcctaattacaccattatttgataatgtgatgctatagtaaacatttgctaatgacggattaattaggcttaataaattcatctcgcagtttacaagaggaatctgtaatttgttttgttattaatctacgtttaatacttcaaatgtgtgttt

SEQ ID NO: 1669 - DNA, 1501 bp, Oryza sativa
gtaaaataaggcacaaaggaagaatatagagacacatttttaattttaaattgtgttcttgtaaagaataaatttttgtttgcattataaaactaagttatattagtacattttaagtggtttacttgtatagcaaataagttacatgctctaccatgtcgagatattataggtgatgaaccggttataatcaccttgaggtatgcactagcacccttgacgagcactctactacctgcctacgctcgtgaaaatggtcattgaccaaatatgtggataaagatgacgtcttcttcatcatgcttgtatgaaaattttcataggtgctcctatttcaatccatgctggactgtgaaaagaaatactaccatctagtttgtttttcagctcgacataaccgaagttgatgagagatcgtgttaggagaactcgtaggctcctccttttttttttcttttttttgccaaatgccgtacaacgtattagagaaaaaataatttataggtaaattttttatgtatgtattcttagcgatttaaaattgaatgtaaaagataaacttagatgaaaaagaacctgaaagcaaaccttaaactttaaattttggaagcgggattcagtatagacaaacccatagagccatagagggtcctatttttgttttgggacagacaggcgccaacttctcagttctcagattcagagcgtaaccgtacccaagaagtgaaaaaagaaaaatcagagcgcgcttaattgtgtccaaaaaatgattgtgtggccctagtcgaggaacccccctctcttctcttatctacccctccccctccccccctcgactccgcgtcgactccactctcgcctcctcgcgactcggagttcaccgccgccaccgcctccgccgccgatctccccgtcccgccgcgccgccgccaccgtcctccctcctccggccgcatccccggtgagcatccatctgcgtgtcctcttcctcatctctccctccccacgcacgcacgcacgtactcgtagcttctgttcactgttctagatctggatacttttcgcttcattcgccttattaaaccttgatgctggtagcagtttgtttgtttgtgtttttttccccgcgcgcaaaaaatgtttgtggggggtggaactgaatcacatgctccacgtctagatccgccacctgagtttgccttgcatcacggtttagtgcttgattctttgtgcgcggttgattatcgcgtactctttttgctctacaagttctagatctcggtgtgtcggactatcgatatgtagttttgcatattctgttttgttttctgttcgctgcaagttttgatgtgccaaatattagcagttgatcttttgagattttgatttcctggagggtttgcgtctagtttctgttggaaaatggccatttcgtgacgtgttgcggcgcatgcctgttgttctgtttttgcgtcaggaattcagaaccagtaggaggaaa

SEQ ID NO: 1670 - DNA, 1501 bp, Oryza sativa
gggcattgctcggtaccacgacggagacgatactccgcgacggcgtacccgagcatcccagcaacgtagaacgtgtcgagatacacgatcgagatcccattggcggtaccaatcaggtgcgtggacgcgaaggccaccaaggcaacataggagacgcggaagatgatagccaagaaggcacctgctagccgttcggacaaggctatagtccacagtgcgccgtaggaacacgcgaggatcgacgatgtccacatgagggacacatgatcggtagcaacgcgccacagcatccatggagcaatcacggcgtagatgatggtgacgaaggacatggagaggaagaccccgttcggaaggccgcaggtgtagcgtagggggtggtccgggggcagctgcgacacccactcgcggtcgcggaggggttgagcacggggatcatcgtcacatacctttgccggcgcggtatccactccggcgatctccgtggcggccgggatttctataacaaccgatccgccgccgccgccgccgctgatctgattggggatttccatgtgcacagcacgggtggagtgagagaggggggttagggttttgggtggcgagaggcggggaagaacaccaagggattggggattgcgcggcggcgacggcgactactgcgggggaggaggaagcaggacgacgacggctttggctgtgtcgatttgtcgattcctcttaggtagcgaagtagtaagatttattggctcggataaatgatgatggtttcttttcgcagtcggacaagcccacatccttctggcccaactcgggttcggcgacgaatttttttcgtttttagattttttttaatatttacagaaataatctatcggcgaacaaaattgcaaaaatagaccctgccgccccaatggtgggcggcaagctgacgtggcaaacgggggaggaacgggcggtcacggagggtggttttttttttgcatgaaagcccttgccgccctctggtggggcggcaagggtgcagaatgcaaaagagccgcagggggccgtccattttgcaggaggccccttgccgccctctggccgggcggcaggcctcgctgcctataaaaggcctgccgcccagcccccagccctcattcctcacccctctcaaatccagtgaaaaaaaaaagaagagaggggaggagaagagaagaaggggtgaagccctgccggattcagatgccgatttcaggtaatattcatagttcctatatgtgactattgagttaaatagtgtgtattttttaaaaatttgtttgaataaatgcattatatttttagggttttagttgtactaatttagaagtgcgtattgtagatatcggtaactacgtagatctgctagtttggaatcaatactttaccattgcattggcttacacaagaagatattacgttgtagatgtttattgcatgaaagagtaatatgatctagttaattcgttgacagata

SEQ ID NO: 1671 - DNA, 1501 bp, Oryza sativa
tgtcatttgtcatcattgtgtttctagatggattgtgtttttctgaaaaattaatattttttattccgatattatgttatttataaattgtatccctacttgttgtactcataatgacgttgataagtctcagacatgcttttctggaatctacagtaatatttaagtttgcgctacatatatggttttgcattattttttttcatttgtaaagaatatagttacaacgtactcccttgttccgtaaaaacccaatcctgcgtttaaatatagacatatacatgattggatttttatagggcaaagggagtactttgtaacactacaaatgagtgttttttaacctatgacttaatgagttacggagtacaaattcgtgtgttctgacgctttaaaacagctctatacactagtccacaaacgatttttgtgtacgagatctcacgatatttgcaaacggaccataacttaccgtgtctggaaaaatcgagcggcattttcgcatatggctccttaagacgcccatatggaaaaatcgattttcctgaaggggccatatacgaaaataaaatttgaaaatatgcgaaaataaaatttgaaattttgaaactagtttatcttactcatatgaactccaaattggatggttttttcctaaatatttttaaaatcatgctctatcatgttattgtgttcttaatgctattattttggccattttttcttgtgactttgttttatcaattaaaattttgaatttaaaaagatgacaacttcaaataatattttgaagtagtagataatttcagctgaaaaagtcatgaacataaaagttgtagaactcatcaagatataaaattttaattttagccatttcttcatccgacaaagtgatagtaacattgttcaaaaaatttacatatctctcttataatttataaaaccatatgagatatatgttaaattggtgaacaatattattataactttgtcggatgaagaaatgactaaaataaaagttataggtcttgatgacttatacaactttgttgtttttgttgttgatgactttttcagttgaaattatttagtatttgaaatattatttgaagttgtcataatttaaaattcaaattcaaattattgaaacaaagtcatatagaaaaatgaccaaaacaaaagttgtagatcttgatgctttatacaactttattgttgacaatttttccgtttgaaatcatttactagctgaaaaattatttgaatttcttatattttaaaattcaaattttatatagtgcaatcaaattcggatggagaaatgaccaaaagcaaattggcagatctcaatgagttttgcagctttatttttgacaattttttcacatgagttcatttagtattataaaattcgattcgaagtttagaaagccgcatgatttttgcatgcgaacgcttaagttgtccgcatgtaaaattgcggaccacttaagatacccgt

SEQ ID NO: 1672 - DNA, 1501 bp, Oryza sativa
gccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatccccttcgacaacaagaacactcaatcccagattgatcaaccggaagattaactataaatcaatcacaagcaagaacatgaagagggtctggacattcctcaaacaagagtgaaaa

SEQ ID NO: 1673 - DNA, 1501 bp, Oryza sativa; identical to SEQ ID NO: 1668

SEQ ID NO: 1674 - DNA, 1501 bp, Oryza sativa
gtggtgatgaatggtttatgtccggcatgtctgctttgttatctgtttcgttttgtgttctttgtattcgtgagtggaagtcgatgttgattggttgtttgcttcctcttttttttaaaaaaaatgatattttggggagaagatgatgttcttggttgaaaatcatcggcatgggtctctcttttttgttggttttgagttcttggatccatgtcagtttatgaatctcttgttctattgagaaatatttttgtttagtttgttgcttaaaggaggaaaggaaagattcagtagacgcatcattttcttgttggaatcatcaaaaaaaaattctcttttaatgcgcctttttcttagataagacgtcactgaaagaaatggatagttgtttatatgattatatctagctaaagagtacagttctctacttccattatttttcactctttgcattcttggacaaattcagtgcccaaattgcagataatacctagttagatatctgtatccaagaaaaaaaaaagccttgatatgtaattcattagacataatggtgtcaattgccatatgttcataaacttgtggagtctgcaataagtgatatttcagctaaaaatcatttcatttcaaggttattgattggtggaggagagtatccctagatgtcactatcaccccattccattattttcagcaaatgacgagtgtatagttgtctttttctccacctcttttctctccatttctccctcctcctcctccataaagctccaattccattgggtgatctgcgcatgagaagacgccgcgaattcgcaaattgctgcatgagtcaaacttgtgcagatcaagttggactttttgcgtttgaaagataccattagcttttgttttggtaaccagtgcttggcactataagtagtatccatggaccatgtccttggttgtgccacttctttggtttcatgccaaaaggtactctgctctacttgcttgatgttcttcttccccttccttgtgtgtttatgtgtttaattgggagtttggatctcttctcatcctcagcagaatctgatctttgaagaattggggatttagggttccaagaactgggagtctttcatgctgataagtgataaggatagcttatccacaatttgggatcttccctatggctgttggaatgaatttgatttcctgatttcttttccttccttttttttcttgtgtttcttgtaatgatattattgcttgctgtaacaagcaagaatgaagagatggagatttgaggacagtattaaatgcaaaacactttctgattttacaagattttgtggataacaactgcaagatcttgaaacttcttgatgattcaatccaaatgagtagcagctcaaccctcttacatgatgaaaaaatgtgttttattttattttttgtcaggtttttgaaggcccccttgtgaattccctgttgtccatcagacaaggaggcctcaaga

SEQ ID NO: 1675 - DNA, 1501 bp, Oryza sativa
cattcataacttctggtatgcttagctttttatttagaaaaaagaatggtacgcatggaattgcttaggcaaaatactatcataatatagcataaatttattatattttataattttgttataatataaaattgatgatcaaattttcaaaagttgaccgaatcttcttctaaacatcaaacgtttataaatagagggagaataaaaaaattttaaaagtgaaaactgaaaaagaaatgtttgcatttaactcagctgcaacttctctaacaacggggattgcctgctactgctagtgctaatgtttgctgccggcctgcaccagcagtactgcagaggatctgcactcctctaatgctatccctaatgtaaatgctgagagagagagagggagagagaatataggaggatattatttgtttttctttcatgttaacatggtgttgagtgatgttggagtgtaggtgtggttgcataaattaatttgttaaggttcaaattcaggtaaccaaactaggtagtttttttttcttttgaggtttatggatttttccctaatgtctctttgttgtgttaaaagtggcgtattcgtagatatatatagcgcgctgtgcatcctacatttgtattaaaaaaatgatattatttagtcctaatatggattttggtgtaggtccattatttagcaaatgctttaagcattttaattgcatgcaactaattgagacttcctttgaaatggggtgtttcaaagaaattgagctgattcgttttaaaattcctataaaattcttgcgtttaagcaccaatcctttgagggatatgatctttttcgtcaagaaccaattctttgctaagaggaaatattttgaagaatattttcaagaaaaagataatctctctaatattttttgaataagccttttgtcagagtgctagctttactgccaatcaacaacgtgatggctggcgtatcagtagccatgtcatatgtgtaaagtgtttggatttaaagattttatggaatgccaaattttgtttaaaaggtaaaaatttctccttcgccaatatacgaagggcctcattgtttggctgatgcttatgcttataagctaaaatttaaattttagaacttgattttgaatttatttttttttcgtttttcatcgtagtttattttacaacatctgtttttatttagtcgctaaagagaagtgcataaaacatttaccgacaaatattttttattggttaataaccgatccgaataagcatacgaataagggaaacaatattcgaaattagtacgaaagagaaaacaaattacaaacggattttattacaaacccgtttctacctctttttttttccctcttattacagagaggttagattagagttaggctcgccattaaacaacactcatctccccctcccccttgaaaccctagctccgcttcgccgtcgtcctcctcctcctccccggcggcggcggcggcgg

SEQ ID NO: 1676 - DNA, 1501 bp, Oryza sativa
aaaaaacatattatgataatatatttagatatatttaatactcccatttaataaaatagatactactaattttttcaataaattttattaaacataaaaatgattagaaaaagttaaacgatttacagtatgaaacgaaggaagatcattaattaagccatagctacaatgctcaccgttcttgccgccgccgtcgccgccgctcttgacgacgtcgaggaggacgacggtgtcgcaggggcggacggagtgcgagagcgcccactgcagcgccgtccgcgcctcgtcgctgccgccgtcggccaccaccatcaccttcctccccacctcgctcttctcctcctcctccttgccgtcgacgtcgtcgttgcggccaccatcattggcagcgccggtggaggaggcgcgtatcgacggcggcgcgccgcggcggctgtctgacctgatctggtggaggcagaaggatggcagcgacgatcttgctgccatcgtcgttcgtgtgggtttcttggagaagtggagtgagtgaagtgtggttaatggctaagctggcatgtggctccactgaagctagcaaagaaaaggatgtggactttcatccctcgaggggatatcccctcgttgtttgcatgtcatctaaatagttattaaaaaatttaaaaaaaattgacaacatagattaatacgaaatatatcactccacaaacatacaagaccaaattcaacttctataaattgcagcaaaaataacaaattaaactgaaaatagttatcgcatattcgtaactatatttgttatttttgttacaacttggagaaattgaatttaaacttgcatgtttgtagagtgatatgtttcatattaatctatgttgccaattttttttatatttttttatgattatttaggtgacatgtacgaaacgaggggatttcctcgagggatgatttcactttccccaaagaaaagggaaggagatcagtgtcccatgctgaccagtgaccatcttcgcggccaggcacgcgccccttttctttttcttttttttttaaggtagaaagtaaaaataatgtctctactttttttgaaaaaaaatattattagggacttttgtgtacttgatcttttatcactaatgtattcatgttgatatttctggtttgtttaggaactttttgatgttcttattctatgttcagaatttctgtctttttttttgtttagtatttttttcaacacctttcttgtgcagggcaccatacggtccatacggaagtttggaacggtacaataacttacttacggaagctttcttttcacttcatcggacaattaaaagggattatttgtttcatgctttgaagaatatattttttgcaaaaaagaattacttttattgtattgtttgtatcaatttttaatcttttattgttaagtttacttctgaaatatttaatttatccctataactaagtagatgatccatgattataatctgcc

SEQ ID NO: 1677 - DNA, 1501 bp, Oryza sativa
caagcccgcttgaatgtatctcttttagaaatgttacaaaaattatgttactttttaaaaaatatatcttataaaataaatatcttttaaagagcgtacatgtttaaagcagtagatgtaccaactgtcacgtctattttctagttatgcaaaaagggctaagggcaaccacaatatgcatgaaaacccaccttaagaaataaagtagtatttttttacctttatacatagggagatgatttatgaagagaatagtgttatgggtaaccttaagcttaagggtagaccataagaattttaaaaaatatatcatagctttgcaacatgcatgtacacttttaatcttgagtaaatatgtgtttttttccttagtgagtcccaccttaagatcaaaaagagaccatatacttcctccgtctcataaaaaaaacagtacatgatgacatttcatctgtcatcccgggtactaggttggttttttatgggacgaaggtattacattgtattatgtagtatggacaaacacaaggacgtcccgtcttatgactacattgattttaaacattgaggatgctctaatgcctttgtttgatttatattatttggcagattataatcatggatcatctacttagttatagggataaattaaatatttcagaagtaaacttaacaataaaagattaaaaattgatacaaacaatacaataaaagtaattcttttttgcaaaaaatatattcttcaaagcatgaaacaaataatcccttttaattgtccgatgaagtgaaaagaaagcttccgtaagtaagttattgtaccgttccaaacttccgtatggaccgtatggtgccctgcacaagaaaggtgttgaaaaaaatactaaacaaaaaaaaagacagaaattctgaacatagaataagaacatcaaaaagttcctaaacaaaccagaaatatcaacatgaatacattagtgataaaagatcaagtacacaaaagtccctaataatattttttttcaaaaaaagtagagacattatttttactttctaccttaaaaaaaaaagaaaaagaaaaggggcgcgtgcctggccgcgaagatggtcactggtcagcatgggacactgatctccttcccttttctttggggaaagtgaaatcatccctcgaggaaatcccctcgtttcgtacatgtcacctaaataatcataaaaaaatataaaaaaaattggcaacatagattaatatgaaacatatcactctacaaacatgcaagtttaaattcaatttctccaagttgtaacaaaaataacaaatatagttacgaatatgcgataactattttcagtttaatttgttatttttgctgcaatttatagaagttgaatttggtcttgtatgtttgtggagtgatatatttcgtattaatctatgttgtcaattttttttaaattttttaataactatttagatgacatgcaaacaacgaggggatatcccctc

SEQ ID NO: 1678 - DNA, 1501 bp, Oryza sativa
gcgcgagtcaaggcccccttgagccgttgggctcaagggagggagatatatctaacatgggggcgtcatccctatgtatgtatgaattgcaatgctgtccatcattattttattttatatactcatatagctagagattttataagcaaatttcttatgtctttgatacttgacataatttgtaacttgaaacttccatcgtcacaaactactatgtgcactgttgtttttctatggtaaaacactaaaacttgaattgtctcagctcatcaccagacaattggatggaaggaataaacggaagccagtctcttgctcttcagacttacattggtggaaatattgaagggcttcatcttacatgatctcactggtacgtaaacttgagttcagcaactgcatagacatcaccatttggtctcatgaagctcactagtgaagtcatatagtatggattggtatctgtttatccaagaacaattcaagttattatggctttacctatgtattgtctacaaaatttttgtttagtctgtgattaaaataaactgtacaattttctctttttacttcctgccatgccgtttattctctgaaaatatagatgccctgtctacttagagcaagtttaataagagagccggttgttgtctataaaattatctacatcaaagataggtgtataacaacagactattaggtagattgctatacacaaattacaaaaatataccattcaatttttttaatttgggtccccaccacattaacttgccttttctctcacccgtcaacctttttttctcccaaccaatcagaaggacatgcaatcccacatataaaggcttccacaatgtgccataagaatgagccataggccttttaactaaccatatatattatgggcactagccataagacattaaatactaaaaatagccataagttttttatggctcaaccttaaaaaataaaatgatgagataaagcatacatgcacactaaagaggatgaggatgagaatagattatggtatggtgggacctactttaaagtagaatttgtttacatagatgtgtgaaccatcttaacatatattcttgccttcaacattgtggctatggacatagggtatggtgggacctatcttattttcaccatgacctttaagcattgctgttgcatcggctgcatgtaggtgccactgccttttttctcgtgctatcacctggcggctgcatgagcgtccgctttgctctctctctcctctcttctctttcttccacctagattttgctgaagtggacaattctacccactgctaattcagcttttattgtacctgctctcataggtgactctgttagattgcttatgtggcatattacatccccatcaacatgtacatttcagttcattggcttctttttttaaaaaaaaaattataatcctatgctattccataatgttccgcagtaacgtctgaggtaccatccagtac

SEQ ID NO: 1679 - DNA, 547 bp, Oryza sativa
tttgtactgtgcggggggccgcctgcaaatgggcggcgaggggacatggaattttgcaggcggcccccttgccgccctgggggagggcgatttttccccccccccctataaagcccagcccctcctctgtgaaatttcattatattcactaaaaatccaaaaaaaaacgaaagagagaggggagggcagcagaagggaagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggcacaa

SEQ ID NO: 1680 - DNA, 584 bp, Oryza sativa
cacatggtctacacactataaatgcactttaggtctctttggaatggggaagtttcgcagttaaacagattgtttctacgttccgaaaaagccctaccccctttttttatctcttcgcacatagattgtgttttcagcgaatgactcccttggaatggagtaattgaactaaatcctacaaaaagtttaataaaaaaattcccgcgttcctaaagaagccctaaaacttttgcaaggttgcgaataatgctatcctctaagttttttcgctagccaagtccactactacctactacctcttttgatttttgggtatacgtttgaccattcgtcttattcaaaaaatttatgcaattatcatttattttgttgtgagttgttttatcactaaaaatatttaaagcattatttatatctcatgtatttgcataaacattgtgaataagacgaatggtcaaatatgtgtagtcaacaacgtcatctattgaaaaaaaagagagtaaaatggaccgggctcaaacatgttacatgggccgtacgtactcaactaaaaaagccaccttcctttctagggccacaaaagt

SEQ ID NO: 1681 - DNA, 367 bp, Oryza sativa
ggtggcggagcaagtttccacgccgccggcggcaggcgacggcgcggcggcggcgaccggaacgaaggtgggggtggaggcggggggtggcgaatggtggtggtctcctcccctttttgaagtttgaaggcgtaggcgggatgggggaggaggattgaggaagaagccgagagcgagatggggagggggcttggtgggcccggcccgtcagggacccggaaaagggaaagtggggttttgggcctatatatacggataaggcaacttttgtggccctagaaaggaaggtggcttttttagttgagtacgtacggcccatgtaacatgtttgagcccggtccattttactctcttttttttcaataga

SEQ ID NO: 1682 - DNA, 1501 bp, Oryza sativa
cattgcttaacgtttatccacaaaacaagagcatatggcatatcaattgcagcttcttcttttttttttttttttgcgaggatttccccaccaaaaccccactaacaacagcagcagagcagagcaagcaggctcgccgcagttgaggaaatatacacggcgaccagttgaagaggtgcgcttgccttggcgaggcgggagcaggtggcgtagttggcgtcgaggtcccccacggaggtcatctgcaccacgcccaccctcgccgccgccgatgcccccgcggccgcagatggtgacgacgaggaggccatcccgcggcagcgggcgagcgacacgcgtgacctcgccgcggcggcggggaggagcgatgcggcggcggcgagggaggccaaggccatatgcgaggagaggattgagatcccctcactaccttaattcacatggctttgagtcactgacatgtgggcccactctgctatggacccagatgtcagtgactctgaagcgcgacgagtggggtagacagtagacttgcccgggtgcgcgtagcgcgggcgggaggacacgtggacggatcctggccgtcggaccggcacggccgttgcctctatccaccgttcgattccgcgagcccacgcatccatccggtcactcgccaactagtatccccattcgccgccgccgccgccgccttcgccgccggcgatacggtggtcagcgccgccgcggccgctcgtatctaaaggtgagaccacttgctgttcctttcctcgcagattcgctgcaagactaggatcggggttgggcggatgatttgggtggtagtggtgcctcaagaatgtcgcagaagttttatctgtctgattagagctctgagattacggatgcatctggatccggtttagggaggaactctagattattggttgatctgatagttgggaacaacttcgttggtgaggtgatgatggatgaacatgttgtgcgctgcttttcttatctagccgttttctctgaattttgtgtatcccttaaaaagggtgtagagcagctgaatgcatgtacaatctcatgcattttgttccttgacacaacattattttgttctcggtaatttagtaatgcgtgcttccgtcgcagtaatttgctcattgcatatttgcacttgatttgctgcttgcaggtatatggccaaaatggttagtcagtgtatctctccgcggcagtcctttcgcgttcctcgtttttcatcagctcggcctacgctaagttcacgtttagcaattggctacgccaacccgtcgttttgcggtgttaaacgctcaaatcgtccgagttttatagcagcagcactggatgtaccaaaaagtatgtcctcccctaattcagagagctccctgcctttgaaaggtatcgctggaaacctttagttttgtgtggtcatgctatggtgcctatgcaggcctgagtctcctaacaccgtgcatgcttcttctctttt

SEQ ID NO: 1683 - DNA, 1501 bp, Oryza sativa; identical to SEQ ID NO: 1674

SEQ ID NO: 1684 - DNA, 393 bp, Oryza sativa
tgctctttgtatacacaatgctaggcttcatgaaacccatttggtgcgtcgatgcttctaaatttttttataaacttggtcaaacttaaaagaagtttgactaggaaaaaaagtcgaagcgacttataatatgaaatggagggagtattatttatagatgatcgatcttttcagaatggaaatgtgtgatgtgtgttgtgcccaatgttgattgatgttcataaccctgtactccagagcatcttgaaagctcatcctcaccgagtcgctgtataattcatgtctaaatcactatttttttctgtctgtaggtagttctgaaatctgaattgtacttccattttttttttgttcttctgttttgttgggtaatgccaaggggactaacataga

SEQ ID NO: 1685 - DNA, 1501 bp, Oryza sativa
taaacaactatccatttctttcagtgacgtcttatctaagaaaaaggcgcattaaaagagaatttttttttgatgattccaacaagaaaatgatgcgtctactgaatctttcctttcctcctttaagcaacaaactaaacaaaaatatttctcaatagaacaagagattcataaactgacatggatccaagaactcaaaaccaacaaaaaagagagacccatgccgatgattttcaaccaagaacatcatcttctccccaaaatatcattttttttaaaaaaaagaggaagcaaacaaccaatcaacatcgacttccactcacgaatacaaagaacacaaaacgaaacagataacaaagcagacatgccggacataaaccattcatcaccacaagctaattaatgacaaatcaaagatcaaaagacaggaacacattacctaaagtcagaaggagagaaagggatgaactgctcctcctccagagaactcaagaactgaactctcaagtctcaacagcctttgtcactgcatagaattcttcaggttaaatagataggcagctggggtttgttggactctctctactactactcactcctccagctgacacgcaagaagggaaggaattaaccatcaagagattcttgttcttctctcaagagggccaacaaaaaaaagggaagaagattcttgtggcacctaaaaatgaatattttttttgggaaaaaaagaaatgtaaaaatagaaataaaaattcaatccattgactccggatctggagagatcctcaagattccccaggcaattcggcagtatttgttgctatcttccctcgctttgaccgccttgtgtggttgtcgttgtttcgcgtgccaggagcgatttgtttggagaagagtaggtgatttaatctctttttaatttaataaaaaattggaaataggtgaattatatatgcagctgtttgacaatttgacatattattatttctgctgtaacgtacagatcagtccagcctaggcgggaacacgtctggatgaataattcataattgttttattacacggtgggaaggtttctcctaacacacgccaaaagaaaaaaaaagtactagactaatagtaataactaggcattaaaaaaaaactcatgttaaaacacattcaaattttagataatgaaataaaatcacggcctttgtttacagagctatatccaattattaaaaaatgttccaaacataatcacacctcaaaagaagacattaagacataagggacaatccaaactgatagaggcgcacactgacacaaacactaataaaaagataaagcacaaacttattgaattttatttgtgaacctcccttcaagattggtgaaaagttacataactccagtttgtaacatgcaacttttataaacttaatgtcttcgtcacatttttgtagaagagcccataatcggagccaatatgttgtcttgaaaatcatatgcaaaa

SEQ ID NO: 1686 - DNA, 1501 bp, Oryza sativa
tttattataggagagaattacatattacacatgtattatatacctaaagattagaaacacatgaatagaagtagataaagaattggaatattatggtttctcaaatcctagagaaaatatggagagaaaaagcacaacataagtttatcatgaggttggacttatgttaaaaatttcttattaaaaaaactacgaattgaggcaatccataagaagttaataagattttagaagggaggcattcttatgttccaaagggacacataggattactaactactccctccgtttcatattataagtcgtttgacttttttttatagtcaaagttccctaggtttaactaaatttatggaaaaaaatagcaacattcacgacaccaaattagtttcattagatttaaaattgaatatattttgatacaatgtttgttttgtattgaaaatattattatattttgctataaacttgatcaaactttattaagtttgactataaaaaaaagtcaaacgacttataatatgaaatggagagagtaaccttttgcgaactagactgccccgtttgcattcactctacagttttgaacgatcttttgcacagcactgtcctgtttttcttaactagttgcatgcccgtgcattgtaatggggatcaagatataaaaatatgctttaattttttatattcgaccttttgtgatgggtttttttgggctttatgtttggagcagttcatttgaaggggggagcagttttttataaggcggaaggttttaaaggataagaaggagaacgaccgtgcttttaaaatgagttaagaaatactccaactactactatggtttgcaatttcggtaatttcgaacgctaccggcaagcagcacaaagcttcccccgaattttttttgtcttttaaaatatttgtgaacttggtaaaaatttgtttagattcaataaaaatatgttaaattttcaaataatttcagccaaaacaccgaaattcaattttttaaaaaaaatttgggtggtcaccaaaattgcaaatcctggctactacggcacatcaaacacaattttgtttctaacaccagctatgcatgcatgcatacctcctaacggcacacaggaaaaactaacaatagcttttgctttatcagcatacttatcgaccaagctagttttactttggaccggggccaaccggataggatcgaccatcactagacaccgttatcatatggagtataacaggtcaatggtcgtatctcatcaactaaagattccacttgacacacctagcagtggcacacaacaaagatattcgagagtttagaatagttttccaagaggccctactgttttaggctttagccatgcatcagctgctgctgctgcattcttgtctgcctatatatacatcacaataacttacttgcttcagatcatgcaaatcacatacacataacgtgtgcgttgctgcaacatgaagatgaaggctc

SEQ ID NO: 1687 - DNA, 1501 bp, Oryza sativa
aatttctgcaattattggggtacggtccacctaaggtgtgggcccaacagatcacatcctagtcacccggttggtgaactggctcgtgtgggccccacctgctcccaatctccattctcctcatcacatatccataagtctgctactactacttaattagctaaggtttagctatagctaagctcactgactatgcatgaagcttccagaggcagtgaggcaccacaaattttcagacacatgctggctggagtagtgtaaatatacacacacacacactctctctctcatagtaacagggctcaagggccaacaagattagcactcactggttcttcttccttgtttatttggtatgttcattagttctttgctttgcatgaaaaaaagctagctgttatgttgctatttctgcacttaccttgagcaaaactgttgaggtgttttgctgtgaatgtgtgttctgggtgttttggtttgttccaagataatttaacaaggctgctagatctgtttcaagttcagttcttgagctcagagatggtttcgttgtgcttcttgaatctttagcaatcctagagctgtggtctgtggtatgcaggaacatgaagcttctcttctccatttcttccagagtttatgggaatcgttgtggttcacatgttcttggtgttagaacatgcaagtgcatgtgcattgacttcttaatttgttgttcctgcaagtgcatgtgttttctgttatttgctcacacagtgtgttggatcatgttgacttgaattatttatagaagagattgttttggagagcatagatctttggaaagtaatgtccatggattatgctctgcatctttctgcgtcttctttctgatgatgctgaaaatgcttcttgtaatgtttccactccaatccaaagctgttcttagcttcactcttcagtgttccttccttctgtgagttcacttatatggtacagctgaacagagactgatagaagcttggttcctggattgaattttaagttattttagccttttgttgtagaggaatctgatctgtatatgttgtcggaaagttcaggtgaacaattcttctttgttactacctctgctgtttcctgaacagttcttgagctgcaaccatgtagctgaagctgtatacttgtatttcgctttcagagatcacatatttccatcgcacacctctcttacatcttccagagttcagtctatgttttttttttgttctcatgttcttggtttcaatgcaatacacaaaatcctaatgaatctttcccactgagagtttggattgaatcttgttctttccagttcatagctttacacagtgatctgttgctcactgactttgcagagtaacaccgtttaccaagtctgacagagtttcatggagcaggtaattactctgtccctgattcttctccggctccggcgagatcatgtatcttgtgaaggatatcggcggcgccattgcgctga

SEQ ID NO: 1688 - DNA, 1501 bp, Oryza sativa
cataggttattcttcagaagcctggttctctctctccctttctccacttctccacttctctctcgctctccctctcttgctgtgtgcagcggcagcagcggcgttgggaggcgaggcccggcggagctccgccggcgacggcggcactgggaggcgaggcccgggggcgctggttggtggcacagagagcaaaaactggagaatgggagaggagagagagatgggttgggattgtgatggtgtggggagaaggagctcgggctgcttccccttttataggcggcgacgcggtggcgagcgagagagagacgtggcttagcggctaagctcctttgtcacaaagcaagggcgaatggataagtgtaaaccgaggatgactcgacctagggttagaggtgacgaagggtgaggtggtggccgttatccgttagtgtcgacgcgacaggcgacgggatggcgatttgatggatggacggcgacgggacttctccatgtttcccagagggaaaccggggcgagggcggcttggcgcgacgcggttttggcgcagcgcggcctcggctcgatgcaatgtggctcggacacgatgcgggatggtgcggcgtccgggcgagacatttcgccgaacaccttgtgtgcacgtggctggctggcctgaagaggaagatgatgaataggagttgggctgggctgggccggcctgctcagggaggagaacagaggaggggttgagagaaggaattttttttcctttttagattttttttaaaaaatatttacagaaataatctatcggcctaaaaaattacaaaaatagaccctgccgcccacctctggggcggcaagctgacgtggcaaacgggggaggaacgggcggtgacagagggagggttttttgcaggaaaacccttgccgccctctggtggggcggcaaggggcccgaatgcaaaaaagccagtcggggccggccattttacaggcggccccttgccgccctctggccgagcggcaggcctcgctgcctataaaaggcctgccgcccagcccccagccctcattcctccccccctcaaatccagtgaaaaaaaaagaagagaggggaggagaagagaagaaggggcgaagccctgccggattcagacaccgatttcaggtaatattcatagatcctatatgtgactattgagttaaatagtgtgtattttttaaaaatttgtttgaataaatgcattatatttttagggttttagttgtactaatctagaagtgtgtattgtatatatcggtaactacgtagatctgctagtttggaatcaatacattaccgttgcattggcttacacaagaagatattacattatagatgtttattgcatgaaagagtaatatgatctagttaattcattgacagatatgtcgaacaaacaaatattccaagtttaccatggaccaggaaacgtccgttacgggccaactggggtagatctgtcagaatttattg

SEQ ID NO: 1689 - DNA, 1501 bp, Oryza sativa
gacattgccgcccatttaaacccaagcccctccccctccaatctccctcgttttcgtctctcgccgccactgtcgcccctgttcgccgtcgccgttcgtcgtcgcgtgtgtgccggaggagccggtgcacactaggacgcggaaggggactccgggcgcgccctcttcttcctcttcctcggcccgagaccggagagattactcccgcgccgtcggcctctcgtcccagcgcccctcctcatctcggtagtgcctccctccgttcttcctcctcgctccatctctcccccttagttttcggtagtagcacgagtagcctccccgtagctagccggcgccgccccgaccgttgtcgtcactcgccgtgtgctcgccgccgtcgccgctcgagctccgtagcacccgctcgtccccggcctcgctcggcgtagttccgcccaatccgacgctagcatcggattcccgtagccgcgtagatgctctcgccgccgggaattggcccctcgtgacctcgtcgccgttttccccttctcccgctgccggttgccgccgccgcgatttgccgccgtcaagcttcctccggcgaatccgagccgttggctcgtctcccctcgtcacgtgcaaccacccggtgtgctcgcttttgcctgtatcgccgtggttcgctccgccgctcgccgccgtcgtccaccgtccgttccggccggcgtcgtcgtctacctcccgccggcccgcgtggcagccacgtaggcgccacgtcggcaccagctcagccaagaccgggtcgagccgaccccagttagcccctccccgtgcgcgcgttccaccgcgagccgtgaggctgcgcgtgggcccgctgcatccgcgtccaccgcgaaccgcgcacgtgcaccgcgtccttcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagcccggccgagccgccctttctctcgggccgctccctagccacccgagaaaagtctatattccctccctcttttcttttcttttctttttttttccaaaaaggatttaattaaatccttttcctttagaccaaaaatccaataatcttagaaattcaatatcttcccaaccataagtccgtttgactccgttcaacttccaaaattcctcaaatctcgagatctatctaatggcacgcttagaggtcattaatagggctttattttcgccgtttgttgagttgtcctgtttcgcgtgtagtttcggagcccgaagacccgcagtgcgaggatttcgaggatcaagctccagatctcgagcaaggcaagccacctttgaacatctcgagcctatatttgaaatttaattatgttgcttgaa

SEQ ID NO: 1690 - DNA, 1209 bp, Oryza sativa
atcttatttgaattttttatgattagtatttttattgttattggatgataaaacatgaatagtactttatgtgtgactattttttttaattttatataaattttttaaataagacggacggtcaaatattggacatggatatccatgactgcacttattttaggccctctttgtttaggcttataagccaactttaagtcgaaaagtataagcctaaacaaacaaacagcttttccgtttggcttttttgaagccataagccactctaacactattaaggccctctttgtttaggcttataagcctacttataagtcgaaaagtctaagtcaaaacaaacaagcagctttttcatttggctttttttgaagccataagccactctaacactattaagccaaaagctaggttggagaagcttttttggcttatatgagatatatgtatgactccaccactaaacttaggacattaaatccactggcttataaatcatataagccaataagctgacttaaaagtctaggccaataagcctaagcctaaacaaagagggcctaagccaaaagctaggttggagaagcttttttggcttatgtgaggtagatgtatgactcaaccactaaacttaggatattaaatccaccggcttataaatcatataagccaataagctaatttaaaagtttaggccaataagcctaaaaaaagagggccttagaacggaggtactctgtagttgatcttagaggtgagctataattttggttccttccatggcataaagatattttacccttcacaacttttctggtcaagctacatatgttctacttactttattcgagatttccaaacatataacacttcacaatagtacctgacgtcaatagttcactccctagttggtacataccatgtttaggtggacaaaacttcaaaaatatttgatgttttttttctaaacatggatgctttgtgagatccatcatctcccagtcccaggctctataattctctatcattaattttttttaaaaaaagagattatcaacataatcaaaatttgcactgtagctgcaatacactccaagggtcaaatcgtcaaatcactttgtgggccccacctttaaaaaaaaaactcccacccgctcgcatttatcgatgccactctccccctctcactccggtcaccaccaccccgccaga

SEQ ID NO: 1691 - DNA, 466 bp, Oryza sativa
atcttatttgaattttttatgattagtatttttattgttattggatgataaaacatgaatagtactttatgtgtgactattttttttaattttatataaattttttaaataagacggacggtcaaatattggacatggatatccatgactgcacttattttaggccctctttgtttaggcttataagccaactttaagtcgaaaagtataagcctaaacaaacaaacagcttttccgtttggcttttttgaagccataagccactctaacactattaaggccctctttgtttaggcttataagcctacttataagtcgaaaagtctaagtcaaaacaaacaagcagctttttcatttggctttttttgaagccataagccactctaacactattaagccaaaagctaggttggagaagcttttttggcttatatgagatatatgtatgactccaccactaaactta

SEQ ID NO: 1692 - DNA, 1501 bp, Oryza sativa
tctaatctcaccgtcgattttcacttaaattgatggacccgttaatttagaacattagattagatctattattaaaaaggtgatagtttttcctaaaaaatatgcaactggtggctgggaaaaggaaataaaactaaatgtccgtacgtaagtataattgaaaaaaaaacaaataaagcttcccactgttaggcggaagaaaaaaaaacatctactaacgataaaagatgataaagcaaaaaaaaagatgactcatccatcctctcctcaccaattcaattatctcctcttcttttttttaactaacataatataactattgttttatttataattaaataaataaatcaagataacattagctatattttactataaaaagttaaaatacattatttgatggtagaccctatcgtttgaatggcaactaaataacaacgaaaaattaatcgaacataatatgtattatgcgatactaaatcactatacctaacaaaaatcaattaaaacgctctagagcgctcataaatcaccatataatatgtcctaaaattataagaaaaaaaagcaaaatttgatacaggacacccaaaaatgtgtaattggctgggagacaccgtaaaaacgtgacatggctaatggaaactataaaaattatgtaattggctataggacaccggaggcaatattttatatttcgagtcaaaacaggtgagaaattttttgaaatggtgagattgcccctaacacagagcgtcgccgccgcctcgcccaccgtgagcggcggcggttgtggcctaccccaccgcaatccgccgcagcggcgccatccgctacttccgatgggtggatccggctgcagaaatgtcctgcgggttgacggagcgccctcggcgacggcgtgtcttgagccgctggagcttgtctctcctctccatcttcgtccgtcacctgccatctctcttcggacgatgagcttgtcgccggtcagatattacgtattgctttgtgatttgctcgattccgttggtttccagctttcactcctgtggatcatcccagctgattttattaagttcgattcagagtctgttggtttaatttttagctgattttgaatcaaactctttttttttctttggatatcgtatgggatgtaattgcgtgtgtgtggatagagggtaccgcttggtcggattgacggacaaaaaaatattgtgacgattggaaagttactattttttataagtagttaagatatggataaatgtgaatttgtccatatttatatctaaattttttgacacagggagtaaccaacagcctttttcccacgaatagaaaaaaaaagaacataacgaacactgactacaaatcaccgagcgacacgtggctggacatacgaggtgctagattaaatttgatcaattaaattgacgtatccaatattttatctattagatctattttttaaaaataaaatcttaagttatcatgtctc

SEQ ID NO: 1693 - DNA, 1501 bp, Oryza sativa
ttaatacatttccgggtttaggctgtgttctccccccaccccccccccccaaaaaaaaaaaatcccaatccacctctctcgttttctacacgcatgctttttcaaactgttaaacggtgtgatttatgcaaaaaatgaaagttgttttaaaaaatcatattaatctattttttaaaaaaaaataagttaatacttaattaatcatacaataatacgagcttcgttttacgtgccggggaggaggggttcccaatccatcctctcgaacacagcctaaggctatgaaaaaactttctatatgaaagttgtttaggaggcatcacgattaatacatcataagcataaattcaatgcggttagaaaattgaaggctatggactggattcggtggacaaggatgatctcttggttgtagtgggctgtcttttgtatctagtcgtggtgtactgtgtcccagagcatatcatgcctcagattgcactgtgagaacaagaagaatagattcctctggcctatgagggtgcagccgactacggatccggcggggcgacgacagcgggtgcctcggggggggggcggcgacggcgtgcggcgtggatgcgggcggcagtggcgggctagggtttgggattttttggattttatttttcttcgtttgctgaatttattttcgcatgcggccggtataagcgaccgcttgtgaaaatcccatcttcacatgcggatgcgtcggccgcatgcaaaaagggtgtttttacagacgatttcgtccatgcggttggggcaatcgtatgaaaaatgcatcccaaatacatggaaagacccttttttagtagtgcgttgcacccgtcgtcatcgtggtgcccggcaactccgccagaaacgagaggcaccagatcagatcattaattagtgagtaatgcaaatgtgctagtatcaattactactagagttttctgcagtgaggcattactgtgcaattgaggtatatatatgctcccacatctacaaatgatcagttccacgaactagaaaagttagagaatttagatccaagagcttggattagcactagcaaatcctagcgacgaatgattcgtgctgcagggtggtggcgatgcagagggtatagacaccctccctcgacacgattgaggtcgaggggttgccaacatccgcactaacagttgagaattgagattggtttttgagttttggggcactggtgtgaacaagctgagcgaatacagtactacggtagaacctggctgaggtggtgtttggatccagagacttaactttagtgtctatatttagacattaatttagagtattaaatatagactatttataaaactaattacataaataaaagctaattcgcaagacaaattttttaagcctaattaatccataattagagaatgtttactgtagcatcacataagctaatcatggattaattaggctcaatagattcgtctcacgtattattccaaaa

SEQ ID NO: 1694 - DNA, 303 bp, Oryza sativa
tgatgtctggtgtggcctcatctatttagtttcttgaatttttgatctccctaaagttaagtcgtaatatgttgtatatatagaattccttttccttttttgaacaatgtgataagttcttgctcgtttgtatgcctaaatgatattatgtttgaggttggtaagcttgttactggttacagattggtatcatgcatgcatatttagtatagaattattgatatgctggtcatgagtccgatgtcagtttgttgtacgtgtgtaatagactaatagtaacatttcacattgtgtgttgacagg

SEQ ID NO: 1695 - DNA, 1501 bp, Oryza sativa
ccgccgcggcggccgcggcggcggcggggaggccgtcgcggcgcttcttcaggaggctctcctcgcgccggctcttgcggatctccaccatgttgtcctccctccgcctccgcccctcgtccgcgtccaccgccaccttgtacctgctccgccgcacctccgcccgctcgctcggccgcagcgacatcgtcgtcgcctcgaaaccctagcgagtgagagagagagaggtcggtggaggcgaagtgtgtgagagcgagtcgcgcacgcacgcacgcacggacgaatcgattcgatttcgatttcgatttggaattcgatttcgaaacgaattggggaacggggcgggggtgggggagaggaggcagggtgggggtttatataggaggattggggtgtgggggaggggggtggcttgcacacggtatcgaacgggtgggaaatggtaacttcggtgttttgggatgcttttttggttgtgtttaagggtgtttaaggctttattaagcttgtcttggagattaatactatgactttttttttctaaattcaaatcgattagtaggtgattttgagttttatgtgggatggttattctttgggatgttttatatggtatctcttaattttatattgctatattgatgactaagcgtggacgagatgtgtcgatctataaggttagttcacacggacaaaaacaaaaataggaaatgtgtgtttcttatcgttgatgtatgctagctgtcttgagattaatgagactctaaattcgaatgttttagatctttttggtatttttgattggttataaaccatgtagttctattttgtttgtatatgttaattcttctaattaattaatgtacaactattaggtaagatctggtagtaattcattttaaaaaacttaatatttttatcaaatttctaaatttactctttagactcatatttttacaagaaaagttaggattgccttttctttttcttcacgatgaactatcctttatacttttcctcaagcttagacttgatgtgtcatcacgatcttctccctatccacaatcctcttgccgcgtcaaggacaatagacgcatttggatcttcctcaaaagttagcatagtttgacaatgtgaagtgttagatagcttctttagcttgtgcggctaatttccacctacacaagaaaatacgtgttgataagggagagccaaaacacatatgtgtctagattcgttgttaggattagtctttttttggacatagtagtatgctctaaaggcaagatttgcttctttttcatttgctacatgatagatgtaactgttaattcttgatcgaccgaaccaaccgcatggccttatcatgagcttggtttaaatgggctagttaagctttgtcgagataacaagccaagttaagacaccctaatgcacccatgatgttttcggcctatttgaagatttgggtatggcagcaatgtaaaataatccaaaataa

SEQ ID NO: 1696 - DNA, 1501 bp, Oryza sativa
tacaactaaatttttaaacctgcgctccatttaattttattagggctaaaattttaattccggctattttaatttgtttcaaaatttggaggctgtaatatgagaacatgaacttcgcttggatcatcttacatttatttcagctaatgtattttactttagaaccttttattacatttttattttttattttggattattttacattgctgccatacccaaatcttcaaataggccgaaaacatcatgggtgcattagggtgtcttaacttggcttgttatctcgacaaagcttaactagcccatttaaaccaagctcatgataaggccatgcggttggttcggtcgatcaagaattaacagttacatctatcatgtagcaaatgaaaaagaagcaaatcttgcctttagagcatactactatgtccaaaaaaagactaatcctaacaacgaatctagacacatatgtgttttggctctcccttatcaacacgtattttcttgtgtaggtggaaattagccgcacaagctaaagaagctatctaacacttcacattgtcaaactatgctaacttttgaggaagatccaaatgcgtctattgtccttgacgcggcaagaggattgtggatagggagaagatcgtgatgacacatcaagtctaagcttgaggaaaagtataaaggatagttcatcgtgaagaaaaagaaaaggcaatcctaacttttcttgtaaaaatatgagtctaaagagtaaatttagaaatttgataaaaatattaagttttttaaaatgaattactaccagatcttacctaatagttgtacattaattaattagaagaattaacatatacaaacaaaatagaactacatggtttataaccaatcaaaaataccaaaaagatctaaaacattcgaatttagagtctcattaatctcaagacagctagcatacatcaacgataagaaacacacatttcctatttttgtttttgtccgtgtgaactaaccttatagatcgacacatctcgtccacgcttagtcatcaatatagcaatataaaattaagagataccatataaaacatcccaaagaataaccatcccacataaaactcaaaatcacctactaatcgatttgaatttagaaaaaaaaagtcatagtattaatctccaagacaagcttaataaagccttaaacacccttaaacacaaccaaaaaagcatcccaaaacaccgaagttaccatttcccacccgttcgataccgtgtgcaagccacccccctcccccacaccccaatcctcctatataaacccccaccctgcctcctctcccccacccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacga

SEQ ID NO: 1697 - DNA, 1501 bp, Oryza sativa
agaaactggggctaaggtgatcctccttcttgatattgaatctgaggtgagcgaggtggatgctgcaagttcagattacctccaaggtagttctgaggaggatgttgtatgttatatatctgctgtacagtaacaaactgggctccaacctaactgggctccaaccggctgatgttgttgattaactggtgttctctacccagtcagtatcggctgaactatttgctgcccaatcggctggaccacatgctgcctgattggtgtatgctgaattggttcaacaatctgctgagttggcccaaacattgccgcaatctgctcttgagtcagcctattaatattctgcccagcatgctgaggctgctctctagtcaagacatgaggattaaccacctgtctttgtgccgatgatgaagcaccaggtgctggagccgaaactgatgccatcggctagaccagtggtgcattggatacgggttgctggttaccagtcaccaaactcctatactgtggaaatacgccatttggtagaaagactggtaccgtgttttgatgctcaactatcgtgccatcaaccacagacttaaccatattcgttaaagtattgacaaggacccctgattggttgatcaaagcatgttgaaagcatagtcaacatgatcttggaaattattgaatttcaagggctcttgctcctcatcaccatcttcatccacatcctcaacctcaccatctcgaggttcctcaccttttcacctgagccatctgcagcacctttagtccctttagctttaccacctttggatgagcttgttccaggttcatcggcagcaaccaccttcaccttgtacttttgaataacttttccctggcgggtttccccgaatgaattcatgaattgctcctaagcactcttcatcatttgttcaaactccttcctttgttctagtgataatttgtctatagtgaccgggacgatgttcccttcattaacctcagacggttgctcgggcggtggcttagtgaacggaggtttagttttgcctcccgttgctggtgactgtggtggattctctgccatgaggaaacgttgtcgcaacttgagtcccaccggacgtgccaaaagcgtgttgatgcgaaaaacgcacactggcctggaagatctgcttaacttctgtgcaggtccaaaatcttgcttttaggttcgtgagcgtgccagttgatttgatcctacaatcaacaagaaagaaaaacaagaaaaaccgtggttaaattcataaatgatagctgatcggctagttgccgatgacatatcatttatctttgagccgatgtcatattggaatcgatcggtagtcatgaataaataaaataaaactaaatctactcaatcggctgtagatattaatgacatataatccttccttcgatatatatttaaactaagtgattgggatagatcggtcgctatgccgagacagtataaatcacttaagtcgaa

SEQ ID NO: 1698 - DNA, 1501 bp, Oryza sativa
atgtcaaaatatgcaaaagtccaaccatcgagtcactcctctattggcccgtcttccattttttattttagcacaacaaatttgatcttttttccttttatgcatttatataattggaaatttggaattacatttttaattttttttgttcctgttacatttttaatttttaattaaatgtaatatcaacacggtgcaatacaataacttttaagttaaatagaagttcattttctccactaggatacttaaagaattttgagtatattttttttataactatcgtataataatatctgtaactttgtgttcattcatcaaaatatggttttatattaagactatgctattcactagaaaaatttgagagtgtacatcctgaaagtatgataacaagagagattttctatcattttgtttacgtttgggccaattattttcctcttagagattataagagattcaagtgcgatttttgcagaagtccctagaaaataaatgtcatatactaaaatttatatagaataaaatgctttacctataaaatactgttttagtagagagagagagagagagagagagagagagagagagagagagagtaactgagtcatctataaataactcgtatggaattacctagctatgcacaattttgtccaatgtcaaaaacatctcctatggaattacctacgcacattgttgtctaatgtcaaaataactcctacgctatcatatcgttttcgttttccatcgttgtcacgctgtcaattttgcaggcctgcaaaaactactagagtacaaaagttaaaactattttttcaccatggatggatggatagatttatatatgcaagtcctccaagatgtataccagtccaaaccaaaaactccaactcgcaatattaattcacactgaaaaatttggggaagattcaatatataatttccactcttttaatttaatttcctatctaatcttgactgattcccgtttcaactggagaggagatgggagtagatgcacggtgccacaatcgcgaaacgtgaataatgaaacgagcgaagaagttaggcagactgaaggccatatgagtatatgacatacacacgtgacgtcgggtacaatatactccctccgtcccaaaaaaaaaacaaaccctgggtttgcgtgtccaactttgactgtccgtcttatatgaaatttttttataattcgtatttttattgttgttagatgataaaacatgattaatactttatgtgtgacttgtctttttaattttttttcataattttttaaataagacggacggtcaaaaattgggcacggaaaccagggtttgtctttttttttgggacggagggagtacaaagtaaaatttgacgagaggcaaggaccccacttgtcatacactaaatccaccctggtatacatgacactaaaagtaggcaaggaccccacttgtcatacagtaagggctcatttgaatcgcaggaa

SEQ ID NO: 1699 - DNA, 1501 bp, Oryza sativa
acgcaggactgtttgtatttgttacggtcacacataaatccgcaagcgcaccgataccactgtagcacttcaccttagagtattcaaaagagtatcgaactatgtggaacgtgtatgtataatctaaaaacatgattcaaccaaggacaacaactaatggtaagattaggctagagaggatttctatggattaattaatatacttgagttaaaggtaaaactttattgattgtttcgggcaccggctctccacttatctgtcaagctaagtctggtctgtagctctatgacgtagccgaatatggagggatacgaaggacggatagggctatcaccacttgccatatatctcccgagtggggtcttcaatacctgcataatcaacggttcgatgcactcggtcttttataggttgcggaaatgtcttgagtaacatctacctgtcagtgttataggtaaggcatacccaatagtcttggattgagctcgacgggacccaccatatactaagtcttatagggaattatgtctcatatacgaaagtgttccagataagaaagaagtagagttcaagttggaagctacaagggctactcgaatcatatacatatttgtctccctaattctacttggacaagggagcatctatatgtataaatacaagaccccctaggaggagaggggagacgtcaacacagaccaacacctgccaacatgagggacaagtctaggtagacccaatctggagccatagaggctgacatgagggacctaacacaacctctaatctcgagttcatattcgacgaagaagactaccatgtcgtcaactacgtgttggacatccatgccgccaagttgatgatgactagaataggttatcccaaatattgtactcatttgatactgatatataagagcaacaccggcttctatgatcgaacaggagtaggggtgaaaacgggacgggtacggtcggatcacaacattcccatatcctaacctacatcttactttaaattcggaatcgggtacaggtagtgtcgcataacacatcactcatcccgtatcctgtcccatattactttcttcgaatcggattcgggtacggatattttttgtatgtcgaattcatggatatttaatgtaagaagacaattaaagtgctaaaaaagatacatcaaggaacaaattatataatattacatgtgagctcataaaaatagtgattaactaatcttttatcatgtttatatgtgagtttataatagattttcacatatgttttataatataggacatacgggcggatataactcttctcgtatcctaacccatatttttttccggattcgggtttgaactcggataatatagggtatcccattttctctcccatattcctcccgcaagcctcaggtcggtcggtccggcaggaaatatccgccccattttcacccctaaacaggagtatggctattacctatcagttcaggggcctg

SEQ ID NO: 1700 - DNA, 1501 bp, Oryza sativa
aatactacttgtgaaaatacttagctatcatagttcccagacgtaggataggattagcaagttgctaaggattttggcacaatatttgtaacgtagtgcgataatgttttctattttcagtgcacatatataaaaaaaaggagatcccattctggattcttgatgtgctggatgtgatgttttattgttgtctcagtcaggtcagctaaaacagacaagttggcaacgtagcatcaagcctattgttgtctcggtacctctcaaggatagtaaattttctcatgatgaatgttacaaggaaggtttcttgtgtaccagtctgggtagttgtcatttttcaggcagttcttactgtcatctatcctctctgcttgaaacagggcatatgccttagagtggaaataacataggatgatggaaaaggttgttcgtaagtgtcatgaatgcagcagtttagcatatttataaataacatttttttaaaaaaacgtatttatgaacaatcaaggttgaattgatcgactatcatccatgcaaatttcatgtattttccactcttattgaccttatcaatgggccatacctttctgaagtaaaccctcacgcagaaaatacttggctgtagtcgtacagccttgaaggttacagaggaaaccaagataacataaagaatgtacttgaataaaatagaaatactcagatgttatttttaattgttccatcagtacatactgcactatccttaaaaaatgccaaggcatattgaacaaaatgcttctttatctaaaacttaattgttttgatgcaacagaaacggtgagaaggtacatagaaggcccatttcttgccgctaggcagttgcagaagtcattggtagatataaaatgacgtataattgcattttcatattagatattctaacttaaataacgttgctggtgtaatgagaagaagggaagagaagtcaactacgcattgttgcttttgcagaaagcaatcacattttgacacagacgtgaagaagaactctgttcagaaaaattattcaagcaagtaatttcggtgtgtaatctatttccattaggcctcaattcacattagaaaatttacttgtaagaaactgccaccaagtagtagaagttgtagccatagtaaatccaataacactcgccatcaatatggagactaaaatttgtgagaaaccaaaatcaaaatcaaaatcaaatgctctacaaaaagcttcactgtcaaataatggccattggacgagagataacttgtattgactaattccagacagcctaatagcctatatcattgggacacgtagcaacgccgtggtaatatacgcttctttgccggccggcctcgatccagtcctataagaagcgaggaggacccgaaggctatgcattgcgctcatcatctcaaaagctcttcttcttctccttagttgatttcatcttcagttgcttgagcttaattacagactgagagaaga

SEQ ID NO: 1701 - DNA, 1501 bp, Oryza sativa
gttctgttgcactgactcactaacccgctgactctttactttcagttgtcctaacctctgactcactgactcactgacctttccatttttgtttcgctaacccgctgatcctttcagttgtgtgatcctttgttgttggcaatcgaaagcgtagtgtgcgaggacgatccgcgagccaatcaccgacgctcggcgaccatgcacggtgtgccgctacccggctgccgcaaggtgtgcagcttctcctccggctcactctccccatcgcctccttccctttccaaccgccggcctcctcctctccacccctgtcgaactccatcccctcattgtcattggcctccgccactgaagccgccatcatcgtcgtcctcatcccagccaacccccaactccgcacttcacgtcgccatggcgccaggctaccgccatacgccaccctgccccgccgtgcgcgcggctgcgccaagccgccgccgcaccgcggtgcctccctcgcctgcgcacagcccaaccgctgccgcccgcgacgacaccccgacctcctcctcccaatcctcctctccctcgcgccgtcgcgctgagccgcacgcggcctagccgccttgtcgactctctccaccgttccccacatcaccgagccccctcccctctgtctgctgcgcgccagccccgccgccgtcgcgcctgaccgccgccccgatctctccagggccgcgccaggaccaccgccgcctccctatttgatactggcatccatcctcaccatcaagctccacccctccgcggaccctctccccactgcgacaatcctcccctccccatcccccaccgcctcctcccccctgcgcagccgcgtgccgccctgaagcgtcgtcgagcccggccgccggtctgccgcatccacccccgcgccaggccgctgtgccagctgcgccgccgcactctgccccgccctcaccgtgcgccgccccggcgccgtcgcccaggccgccgccccgcgcaccccaggcgccgcctcctgctgcgccgtcaccgcgccgacggcctcccctccattccaccccacgccgccagcaccagccctctccccaccgccgtcgaccctgttacatccggcacaactgatgacgaacaggaacaagtgtccaaggtcgttggctccgttctgagtacggcccagcaacggcctgttcgtgtaactaggcccaacccgaagtataagggtggaaactgggttaactagctgtatataaaggagagagagagaaccgggagtcatgacatgtaaagacagaattcccaactcaatacaaactcaatctctctctctctacaactctgtctttctctctgcttctcttcctctattcctctcaaactgtctctgattctctgaaaatatcttaccactcttccaagttggtaacatttggtatcagagccgcaatcctggagaaacctcggttcaaaactcgtcttcagatccaagtcgacgaca

SEQ ID NO: 1702 - DNA, 1501 bp, Oryza sativa
aactcacatataaacatgataaaagattagttaatcactatttttatgagctcacatgtaatattatataatttgttccttgatgtatcttttttagcactttaattgtcttcttacattaaatatccatgaattcgacatacaaaaaatatccgtacccgaatccgattcgaagaaagtaatatgggacaggatacgggatgagtgatgtgttatgcgacactacctgtacccgattccgaatttaaagtaagatgtaggttaggatatgggaatgttgtgatccgaccgtacccgtcccgttttcacccctactcctgttcgatcatagaagccggtgttgctcttatatatcagtatcaaatgagtacaatatttgggataacctattctagtcatcatcaacttggcggcatggatgtccaacacgtagttgacgacatggtagtcttcttcgtcgaatatgaactcgagattagaggttgtgttaggtccctcatgtcagcctctatggctccagattgggtctacctagacttgtccctcatgttggcaggtgttggtctgtgttgacgtctcccctctcctcctagggggtcttgtatttatacatatagatgctcccttgtccaagtagaattagggagacaaatatgtatatgattcgagtagcccttgtagcttccaacttgaactctacttctttcttatctggaacactttcgtatatgagacataattccctataagacttagtatatggtgggtcccgtcgagctcaatccaagactattgggtatgccttacctataacactgacaggtagatgttactcaagacatttccgcaacctataaaagaccgagtgcatcgaaccgttgattatgcaggtattgaagaccccactcgggagatatatggcaagtggtgatagccctatccgtccttcgtatccctccatattcggctacgtcatagagctacagaccagacttagcttgacagataagtggagagccggtgcccgaaacaatcaataaagttttacctttaactcaagtatattaattaatccatagaaatcctctctagcctaatcttaccattagttgttgtccttggttgaatcatgtttttagattatacatacacgttccacatagttcgatactcttttgaatactctaaggtgaagtgctacagtggtatcggtgcgcttgcggatttatgtgtgaccgtaacaaatacaaacagtcctgcgtgttgacttggctagttggaccaggtcaataagccacatcagcaaaaacagctaagggagtacaagtcaaacacagttaagggagtcaaattacactgactttaatagttggatcaagataatccggttaaaggatacgagtatacgagaggactgaaagtggacttattctcaggagtagatgaatagtactcgaattcggcccaccaccactacaccttggcctactaataaatactc

SEQ ID NO: 1703 - DNA, 1501 bp, Oryza sativa
ttggggacgagctagctttgcagggcaagaaaattcttgctagccagtgagaaccgatttagctctccttcgacggcaaactccgttcgcgtgaaaatattggaacaagggcgatgcagacttctatgaaattggcgccgtaaaattagcgatgtttttcaatgactcacccaatcttgtcggcctcttcttccagatcttgttgtgaactctcgctcgctcaaattttgttgtaaattgccctctccaccaacccataaatacaacgaacaatcagtctggatctaaaaggaaaaattgatttatggaagaactcagcaacaagaggaactcatctgtagcagctagccattaatccttgccacaagaagcaaaaccatccaaacagaggagctacaacaaggctagcaagttggcaaatagatggtttagtgctgctaggctagctgggcgagcgaaccgaacgcgtcctaagttaatttgtcctattatatctaacctcgacacttgtactgcacaagacactagtgcgctcccttgaacagctttttttatggctttttcactagaagctgtaacaactttggtttcttttggccatctttcctccaattagaacaggattgcatacatcttaacagcaaagagagatgcaaactattaaagtttatcatcacaggaaaacttatgacatttacaactttgaaattgaaatatagcaagataaatcaagtagcctttccaagtttcttttgaccaaagaagagaaaagtgccaaagatctacatgacccagagttgttttattcaaaaaccaccattcgaaatgaaggtagctagatgcatgatgagggaaattttgttgcatatgggtgaaccccaaagcttacctaatggcattgtccgtcagcatttccagtgcgtccaaacctcaatgagacgcaccgtagataacttatgctcatgcgtcagatacacctaatttgaaccgacggtaaaggattctagacggtgccgtttgtagcggctttttcgctacttttcttggtgagatagaagacagtgacaaaataagttgcaaaaacaacaaaaatgtttatacacatgtacagcatgagctctacggtgtccctggagagcacaagctgtcaccaagccataacaaacggtcgaactgatcttgaacactggatccaatgcatggtttgttcagtgctcaaagagaacaccagcaaactttccatttagaccctcacaagccacaaatatgcggaaaaaaatgtcatattcaccctccaaaaagcttatacaaggacttgtttgtaattatcttaaaatacaggtgggtaattgcaaagtgagacatcttcccttctataaagagcaagcttagcttggtgatcaccaccactccacatctcttctccatcaagaatcaatcactcgctcgtcttctcctccattggagctctcgatcgagcttagctttgcgcttcgttcat

SEQ ID NO: 1704 - DNA, 1501 bp, Oryza sativa
  unsure (1)..(1501): unsure at all n locations
ttgtttacggtaaattggacaattagctgctaataggttcagttttgatgtttagcaaaattcttgtgtgttagcactacaagtttaattgaacattcgatgtataattgctttaaaagttaacgtaagttaggtatttaccatataaaaatagagaatactaccttcatcccataatataaaaaaatttagagttggacatagttactaagaaaatatatgaaatcaaatagggataagttgtgattcgtagggaagtggatgtatgtgagaaaagtgaatagcgaggagttatgattggttgggaagacaatattagtgaaaaagttgttatattataggataaattttaagtgctataagttattatattatggaacgaagagagtaaagcgtagtatacatgttatgccttttcatccatattaaataaacacagacaaagtatcctccacattctcttaaattgaagttcaaacatacataagaactatcgtcatatgtgttatgaagacacatatttgtttattgagtatttttattaaaaaataatggtattatgtccaaattgccaaaaaccacgaggcttggcttgttgcacgtaaccacgagtattatgacctaatagtttcataaaattacatcattaacccatttttctttcatctactacaagcataggaaaaacacatatatgagttttccaaggctgtgttctgtatagcaccagttggattttttagcacacaaaatgagaaaagtcattaggtatgattaatcaagtattaatgattaataaatatatttgtgtaattttttaaagaaacttttatacatatatatattttaaaagagcaccctttagcactttaagttgtgtgctaactaacaacggggaatttgtaatttagagttgtagtttagaacatgatgtaattcatcgtataaatgttgttgcaatatagtataagttatacttctaggtactccctcgttttctaaatatataacaccattgactttttagcacatgtttgaccgttcgtcttattaaaaacttttgtgaaatatgtaaaactatatatatacatataagtatatcaaatgataggaaaagaattaataattacttaaattttttgaataagacgaacggtcaaacatatttaaaaaaatcaacaacatcaaatatttagaacggagggagtattattttttataatttagacaaaattcgtcaaaacccactcaaacccatgcccgcatccccccccctaaatgacaggtggcccccacccgcactcccctcgttccctccgcccccgcntaggcgccacagcttcgaattctccgccccctcgctcccataaaccccccgcccgccgcctcgctctccttatgccccccacctcgcctcgcgtcatccgccgccgcctcccattcccctcgcgactccggcttctcttctcccctcctcttgcgttcgtcgtgagggcgatga

SEQ ID NO: 1705 - DNA, 1501 bp, Oryza sativa
tgtccattcctttacagcaaacgatatttttcaaccaatctttcttatgttttcatggaagacaaacatttggttttaagcttttatgttgaaaaccctctatttttttagatgtgccatctcaaacatacctttggctgctggttcctctccttgagaaaatgctctacaaagaactaatctttccggccattaattaattgcactctctttcttcactttgagaggatagaaaagaaaaagacccatgaggcatgcaaaatgagatagaccattagaatatgattgagtattaattattttaaacttaaaaaatagattaatatgcattttagcaactttctatataatatttttaagaaaaaaataccgtttaatagtttggaaagcgcgcgtagtggaaaatgaaggactttttcctctttatcttgtgtaagggtgttcatagtgctttgacatgctgttcggccaatcctcaacacgtcgtggccagctaggtgttgggtgtgaccaaacgatgtctacggagcctagagtgcgcacacattcttttgatacattgaggccaaacgacgtgttgggggggggggcacgatcgcgttgtggaggtcatggcctcaagtaagaggacgcggcggatatggtgcctgccttgttgtcgtcccccgctttaagccgccgagctgtgccgccgctcgttgtcatcacctgctccaagccacggggcctcctcgaccccttagtaacctcggtggtggcctccatgacctgtctggattgaggcgctgtcgaggagagggtagaggccgtactgtcgcttgtcgttgttgccctgaactgttggtgctggttcattgtacttattttacaggtataacttattgtacgtattcattgtgctaaaaaaaagtcaatctatgcaaagtatgttaggttatgttccattcttatctagagttttttttacggatagcgtactcatctaatctaccaaaacgtgcatttggacttggctggaatgagattcaatcattttggagttgacaatcccaatgaaagctgaacttgtgccttgaaaatacaaagcaactcggttttccgaggaaactaaaaaagttgaaaagaaatatatctgaatgtgaaattattttattccggtttactaacacgaaatctagagatacaacctgtaacagcaagcaatcagtaacggactaacggctagctgggaacccggtgcgttcagcacctgtctcagagactgcatctcaccaaaccgccattaatttacactaatcactcctactactcctctactctctatcaggaggtcaataggagagaagaggagcgtcgtcgagtttgaaatctcaactcgcaaacccccacactactttttcttcgtctattatatcccaacacaacacaaggtgaagctactcctaggcgagagaatctgagagagatgagatgagaaaccttcacccaccaatgatgaaga

SEQ ID NO: 1706 - DNA, 1501 bp, Oryza sativa
cgtgttaaaaaatactctcatcacagatgagtacctcatccgtgacgggtgtaaactcaacacctgtaacatacaagagatcatctgtaacgggtctatatgtgagctcgtcaaatatgttttgtgctgagtctccatcacagatgagtccttccctataacagattaacagaccgtatccctaagcttcatctagatgggccgatgtggcgtagtcggtcgcttattggacccagcccactaatcaagccataaaaagtctttcctaccttttttagggaaggaataagtacactgaagatccctcaacttgtcattgagttacaaaatcgtcatccattcacaaaaccggatatatgacgtcatccattcacaaaaccggatatatgacatctctcaacttacaaaaaccgttcaatctagctcctttagtggttttgaccctggttttatcctacgtgtcagctgagtcagcgtggaacccacgtaggacccatatgtcaagatgcccacgtcatcaccctctctctcactcctcttctctgggcaaccgggaaagccggccggcgaggcgggagaggaggcggtggctgctgcaacgcggctgaaggcgagggcggcggccggtcgcgaatggtgtcgacagcgatgtgtggccgccggcgacgaagcggccccgcacgggcgggcgccgcggcgttggccacggaggtggaggcggggaagggcgccgcggcggtggccgcggaggtggagccgtggaggcggggtcgagcaccgtggagctggactcggagccccggcctgctctcgcgccgcatcctccctttctcagcgtcgggagcgtcgtcgtcgtcgtcgggcggcttgtctgggcaagccggccggcgctgctagggaggaggccgctggggcgaggcgggagagggggcggcggcggcgtctacggcgctgtgtcgcagccagcggcgaagcggccccgcgccggcgggcgccacggcgttgggcgacgaggagaacggcggagcaggcgagcaaggcgggcagcgacctcgctctcgcgtgcggcgtcggcgtcgtcttcatcctccgcagcgagctcccaggcgacgaggctgctcatcacccggaggcgctcggcgtcgccgcgacgaggctgctcatcaccctatcagcgcacatggggcacaccatcgccgagaggctctgcaagacgcagggccagccgaggagcgccggcttgtcgccgcgggctggggatgagagccaacgccagcggaggaggcgtacgaggggcggagggccgcgctgctgcgggcggtggtcgtgggcgcgacatgtgaaaggattttttagctcgccattaaggaataaagtaagaaacgcgtactctctatataaaatgagtacgttcaccgacgtgaaaggaatttttagctcgtcattaagagcttaagaaagttacttggaattctttggtttgttgacaatcacgattcat

SEQ ID NO: 1707 - DNA, 1501 bp, Oryza sativa
agcaatccgcttccactcgggaagcctagtctatgatgcccgcagacatcccgaatcacacagattcgtttctgaccactcaggtcatccatctgccacataggctgattctggttacgattcccaatccacaacaacttttcacaaagcacaggcaaacaaatctacgcaacgggaaccacctcacatctacccatgaccgtgggcacggctgttcgaacagttagttagcctctgcagaggggtacactttacccacaagatacgaacttactccagacactggccggtgtaagaggttcgcgacaaagcctttcccaagccgacccaggaatacctcatgccacatagaaggatcaaatcctcacgtaaacataggccattttaggcgttcacaaattatctccaaccaccttgatcggtaagtgagcaagcttcttgtccttgccttaccaagaacccggtttgtccgaccccgccccggcgttcccaactattggcatgcgaggtttccctgaaccgactagttacttagccagggtgtcccattccaccttgtgattgcactttgattatgctcgatgagtttcccataggaatcggtccttatatgcgaatacgggacagcgccacgtaggcacggctcccgcatcgcgagttttcacaattcattttattttcaaacacaccgacaccacatgtcgggttttgaaggcttcacaaacccatttcctaagttttcgacaatcaacggtgtatgtgggatatttggtacacgcgctcagagagcacggataccgaagtaccacaagggtggagcgacaaggaatcagggtagtacaacctacaggagttagtgcgactactgggtaggtccatcggtttggcacgcaaaccgaggccaagcaaattaagtgtgtgattctaataatgcaagttgcaaacaaaataataatgattttccaattataggagcaattggtcaaagggtgacttgccttgctcaaggtcttcacgaagcttcacgaatctttgagaaaacctgcgattggcggaaatccggtaaccgcaactatacgcaaacaatcgaaaacctagacaaaagaccaagaaaaagaccctatttaggctaaataatagtgccattaaatagatctcaattttacggaattattagaagtggaacggagtcaatcggaggagcggttgagaagatatggattctctaaggattaaggaatttctgtctaaaggaaaaaggatttaataatttattaaaccctttttggaaagaaattggagggatatgatttagacttcctcgggcggcttgggtgcggcccgagaggagaggcacggctcggccgaactaatgggccggccggcccggagaggcggcccaaggaggcgcggggagagtgggggagagagagggccggtgggctgagtccaccttgcggggtcccgagtggggcccgcttgtcagtggcgcggctcaccg

SEQ ID NO: 1708 - DNA, 1501 bp, Oryza sativa
ctctgggcgccatcccttcttccccttccccggcccgaggctggagagctctcccacgccgccgccgctggtcacggcgccctgtcccgacgcggtagccctccgttcctcttcctcgctcatcctcgtcccctctagcttgcgcagtagctcggtagccgtcccgaacgcgcatagacgccgccccaatgcccgccgccgcccggcgcggcctcgccgccattgccgcccgctcccagaggtagctcgccgtcgccggcctcccttggaggtccattgccccatccggcgccggaaatgagttcaccgagccccggatatgctcccgccgcctcgaatcgaaccctcgttgaccaccggcgattcccctcttttgccgccgccaacggtcaccgccgcaatccgccgccgtcggacctcctccgtcgcatccgagccatgggatcgtcccctctcgtccgcctctttgtcccggtgtgctcccccatgaccgaagaccgtcgatccgtgctccggtgagacccccgccgcccgccgtccatctcggccggcctccttcttcctcctctcgccggcctgcgtggcatgccatggaggtgccacgtcagcgccacctcagcaaagaccgagtcaaggcgggtccgctctctcctccctctcggtgcgctcagtccacggagagcctagcggctgcgcgttggctcgccgccctttggtccacccggtgcaccaaaccatgcgccactccgaccctaaccctagccccccgcgccacgtgcacgctccgcaccatgcgctgtgtcgaccgacacatgggccccacccggaacccgcgaggtggaccgcgtccacccggccggtctcccccctcctcccgaaccctaatgggcccgcaccggcccagtagctcggccgagccgcgcgcctttccttgggccgcgcctaagccgcccgaggaagtccaattcgcatccctccttcctttccttttccaaaggaattgataaatcctttttcccttttccataaatcaattctctattccaagattccataaatcatttcctttggtcccgcacatcagcgaatgccaataatattcttgagaatattatttctataaattccaataaatcatttctcgtccagaaaatccatttaaacttccaaaattcatatctctcgatccatagcttcgtttgactccgttcaacttccagtaattccgtaaaattaagatctatctaatggcactattagttagtctaaatagggtcattcttttgatcttttgtttaggtttttgattgtttgcgtatagttgcggttgcggattttcatcaatcaaggatttctcgaagattcgttaagcttcgtgaagaccttgagcaaggcaagtcaccctttgatcaattgctcctataattgaaaaatcaatatattttgtttgcaacttgcattattagaatcactcctataacatgcttggcctcggtttgca

SEQ ID NO: 1709 - DNA, 1501 bp, Oryza sativa
atgtttgtcactttggtattttcttattggtaaagaatcttgactatgctggcacagtgcgtcctgtcgcaacctcatgtcaagtgaaaaagacaagatctaagggtttacctgtcgagcaaaacatttgaaatctctcctatgaacagtaggaataaaaaaaaagagtaatatgaaaagcataaaattctgacagagatataagtgtaaaacggaggattccaaacacggtaatagttgtttgattggaccgtatgaaaaacacagaaatcggatgagagagatagattcaaaggaatttttccaagaggtttaacattttgctaagtttcctccaaaatctacatgtaatgatctattctataggaattttatacgatttggaaaactctaatcctttgaatcaaaaggccaaataggaaaattcctataggatttctatcctatgaaatttctccataaattctttaattcaaagggaccttactatgtgataaattgccacaagcctggacaagtttggtaaccgcttctatgggttgttcgcgatgccaacaccgaatacctcgacgcgctcctaccgaaggagttcgaggtcggtggggagggcatcgttgtcaatacctttttttaatagtgaataaaaatctcacctctatatctaaaggagaaaatatatacggctatttcatcaatacacaggtgccccagctggatgtcctttgccaccttacaaccgacacgtttgtgacgcactacgggtggaacttggtgcaaaaggggatcattacaggtatgcccatgctctactggccgctgtatgtggagctgacgattaacaaggtgctcaaggttgactacatgggcatcgacgtggagatggagggatggctggtagggctggtgattcctgaggaggtgaaggtgaaggtcagactgatcatagagtccgagcattgaaagcaagcttagagagcacgttgaggcgcacagagatgatcatgtagaacccacggcctcgaaggatggcggttcgttattgtgccacgtttgcgcaactcatattcgagttagacaacgcacgagaataaaaaatggtaggagtatgaaatttactaacggtaattactattttttattatatattgatttcttttgtgcggataattaaatataatgtcttagaaaatggactgccactctaatatatacggctttgataggttaagttatggcttatcgatcaaccataaaacataaaccaaaaaattataatggtttgtggattattattatatttttattcttagtagtttaaaagaaatgcatcatatcaaatagcctacgatgaaatacctaaaattgagtttaaaattttaaattttagttacatctcataagtcaacgaacagataatgagacattatattattaatcttactagcatgcgtagaatattctcaaatatgtcttttaagaggattagtatgttgaatatgct

SEQ ID NO: 1710 - DNA, 1501 bp, Oryza sativa
tgctgttggtgtttcctcgtccgcgtcgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagccttccagtggttcgtaggcgccgctccaagccccgccaccgctcgccatggccttgccgccgtcggcgcccgctcccggaggccgcctctcgtcgccggacctccacggcgcctccccaccccatccgaacccagaaacgaaacccttgagccccggagatgctcccatccctttgaatcgaaccctcgtcgtctcgtcgtcgtttccccctttgctcgccgccggttgccgccaccgcgattcgccgtcgccggctaccctccggcaaatctgagccgttggctcactctctcttgtcctccttgtcgttccaatgtgctccccgttgccctcgccgtcgcatggtgtcccggtgaaactgccgccgtccgccgtccatctcggcctccccttcttcctcctcccgccggcccgcgtggctgccacgtaggcgccacgtcggcgccacctcggctttgaccgaaccgagccagtcagccgcctcctccctcccccaccctcgcgcgcgcggtccacagtgcgccaaccggctgcgcgtgggcccgccgcatctctggtccatccggtgcacgcgcgtgaaccgcgctcacccgaaaccctagtgccaccctcatgcgccgctcccacggtgagccgcgccactgacaagcgggccccactcgggaccccgcaaggtggactcagcccaccggccctctctctcccccactctccccgcgcctccttgggccgcctctccgggccggccggcccattagttcggccgagccgtgcctctcctctcgggccgcacccaagccgcccgaggaagtctaaatcatatccctccaatttctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgaagcttcgtgaagaccttgagcaaggcaagtcaccctttgaccaattgctcctataattggaaaatcattattattttgtttgcaacttgcattattagaatcacacacttaatttgcttggcctcggtttgcg

SEQ ID NO: 1711 - DNA, 1501 bp, Oryza sativa
caggctgtcctgagctgtaacctaagttaaggtaaataagtcctctatttattttaaggatttgcaatgattcatatttgtcaccgtggataccagcactatatcctgggactggtaccgagatcgcggttttgtaggaagcggttcgcgccgtttttcctacgacacgctcctattaggtgccgttgtacggtggtgccggattggggtgtgacagcagagctggcggggtagctcgtgccctactccctccttgctaatcgatttagagtaggtacaatagaaagctatatgccagctataaacacatatcgaggagacgaaagaagagagagatgagcagcgggctacaaatttgtagccaactacaggcagcataggctccaagacaaaatgtatttatgacgggtgggaccatgtactaatagtgtatgaattggttattaaattaactacaaataatttggatccagtagttgactatactattaaacttgctcttaggtgcattctcctccgctgtatctactcgccaactccctatcatccactttgctacgagtttgctttttctctaattcaacaatttatcatccactttgctttctttataatacgatgttgactgtatcaactgtttcttcattcgtcattgaattggataatttaaaataaaacacttaaaacacccttcactacatttatagtatatggttgggcaattgattgaccaactaacagttttgaaaaaacaaaacttttgtgcaggctcttttacacaatgtagaagtttatgtttgcgtttgaggaatttttttcattttttaaacgatgacagctagccagcggccagcagattagcacaataatactatgaaaagaccaaagtgacgtgaccaatggcatcatacagtaacagcacaagcacacactacacgcactcattgttgtacggctaaagaggtgcactggggccgactgggtatgcgttgcccacgggaataaacagcacgacgacatgggtgcctgggtgcaccgatccatgggccctcctagttcccacacccacacacccacacccacacgtcaaagacccacggtttccaaccgagaagattcatgcgcggctgcccactccgcatattccgcgtgaatcctctgctctcctcgccccgttctgcccattttgcagctatcaaccatcgcaaaccaccggcccagagccgcatcatcgtttggcttggatccgcatcactgattcactgcacttcgcccgccgtctgcaaagtcaccgatctgtttggtacttacttgtacctttgctcacatggtcagacacgctatgttatgcgccgacttgcaaaaattccactgctacgtagcacactcacctataaattgcattcacccgcttcacactttcgccaaacaaaaccaaccgaaaacaaacattcctctgataattaagttatattatacttccaaagaatcatcgccatca

SEQ ID NO: 1712 - DNA, 1501 bp, Oryza sativa
catctgcctcataggctgattctggttacgattcccacaccacaataacttttcacaaagcacaggcaaacaaatctacacaacgggaaccacctcacatccgcccatgaccgtgggcacggctgttcgaacagttagttaacctctgtagaggggtacactttacccacaagatacgaacttattccgaacacccgtcggtatcggaggttcgcaacaaagccattcccaagccgacccagggatacctcatgccacatagaaggatcaaatcctcacataaatataggccattttagttttcacaaatcaaactccaaccacctcgatcggtaatctggcaagcttctcttccttgccttaccagaaacccggtttggctccaaccgaccccgccccggcgttcccaactattggcatgcgaggtttccctgaactgactagttacttagccagggtgtcccattccaccttatggttgcactttgattatgttcgatgagtttcccacaggaatcggtccttatatgcgaatacgggacagtgccaggcacaacccccgcatcgagagttttcgcagttcattttattttcaaacccaccgacgccacatgtcgggttttcaaggcttctcaaacccatttcccaaattttcgacaatcaacggtgtatgtgggatatttggtatacgcgctcagagagcacggataccgaggtaccacaagggtggagtgacaaggaatcagggtagtacaacctacaggaattagtgcgactactgggtaggtccgtcggtttgacatgcaaaccgaggccaagcatgttataggagtgattctaataatgcaagttgcaaacaaaatatattgatttttcaattataggagcaattgatcaaagggtgacttgccttgctcaaggtcttcacgaagcttaacgaatcttcgagaaatccttgattgatgaaaatccgcaaccgcaactatacgcaaacaatcaaaaacctaaacaaaagatcaaaagaatgaccctatttagactaactaatagtgccattagatagatcttaattttacggaattactggaagttgaacggagtcaaacgaagctatggatcgagagatatgaattttggaagtttaaatggattttctggacgagaaatgatttattggaatttatagaaataatattctcaagaatattattggcattcgctgatgtgcgggaccaaaggaaatgatttatggaatcttggaatagagaattgatttatggaaaagggaaaaaggatttatcaattcctttggaaaaggaaaggaaggagggatgcgaattggacttcctcgggcggcttaggcgcggcccaaggaaaggcgcgcggctcggccgagctactgggccggtgcgggcccattagggttcgggaggaggggggagaccggccgggtggacgcggtccacctcgcgggttccgggtggggcccatgtgtcggtcg

SEQ ID NO: 1713 - DNA, 1501 bp, Oryza sativa
ccaacggaagcatcggttggctccctccactacactgtactgacttcgcccatagcaccggcaaagtcaccgatccgcttggtactgaataaattggtcacgcacgccatagtagtggactagtatggtggtagctcaccatcgccgacttgcaaaaccagctgctacgtccgcgtactttttcgctgaagatcgagcacctataaattccattcaccagcttcactatgattcatcaaccaaagccaaccaaaaacttcctctgctgcttagctaaagaatcatcgccatcatgagtgtggagatcctcgacggcaagacggtccggagcttcgtggaggacgagggcgccttcaactcctcggtcgacggccgcttcgccgcgctcgacgccaaccgcgacggcctcctctcctacaccgagatggccggggagctgatgagcctccgcgtgctggagaagcacttcggcgtcgacgacgaggccgccatgggcgccgacgagctcgtggagctgtaccgtggcctgttcgcgaggttcgaccgcgacggcaatggcgcggtggacctggaggagttccgggccgagatgaaggagatgctgctcgccgtcgccaatggcctcgggttcctgccggtgcagatggtcgtcgaggaaggcagctttctcaaggtggccgtcgacagggagctggccaaagctgcttaaattaatatacctgaaccggcgagcatttaaattttcacacagctacgattttaattgatatatcttgtgttcacaatattgatcattgttatttgatagcctctgttgagctatatttcattgttacttgtgtaactgtgctctttgagatagacaaagataatatgatataaaaaaccagttttgatcaagagaatcggtttgaaagcttgtgtgtgtctactagataccagggtttcatctttcggtttggtcatttggaccagggtgcccgaaatatcgaaatttcagaaatttcggttcgaaattatatgaatttttgaacaaaatttgattaaattaaacaaaatattatcaaatttacaaaaaaaatgaaaaaaaaatcggtcgaaataatgtcgtatctgggttcgatccgaaattttgaacccatgctagctgccaggctttggattctgagcgccacgtcaggaacaataaaatatttgggcctctaactcttcgtgggctgatctgggccgtaggcagacgagagagcccatgacacgatctcatcaattccgtagtggccacgaactcacgtagcgcaaatgccgctcccgtttccgaatcgtgcgatttatctcctttctgtttccgaattttattagtagttgcgatattattaatacaggtttcgtagcggccgcgtctcctcctcccttatataaaggcagcgtttctgcaagttattacccaaatctacacgagagagagatcgttcgacgcatatagagagagagagaggcaaga

SEQ ID NO: 1714 - DNA, 241 bp, Oryza sativa
atttacagcccaaaaattacgaaaacctagctgcatcgcatcttcttctcctttccccaggcggagcaccgtccgatgagcatccaacggctacggtcagcaccctcggaaccttcgagaacaccctccccgctataaattcccgcctttccggtagcatctagtcttcctctcccactcttcctcctccccaaaccctagccgccgccgccggcgtactcgagagaaacatcagcatcca

SEQ ID NO: 1715 - DNA, 1501 bp, Oryza sativa
ttaggggcaaactgtgccaaaaaaaaacaagatgcgtggtagacatttcattcattggcatggtttaatgcaaacaattttggggaccaaaatttaaaccgaatattttaaatataaaagtcaacttgaaacaatttttaactgaatatgtatgcttttgaattgacaaattgtaattttatgccaaaagcacatcctatcgggacccacaaacaaacccaaaacgataaataatttgtgaataaaacttttacctacgtgttcttaacgacctaaaagtaaaggctgaaaaataaacttcgatgaaaaaaaaatctcaaaatcagctttaaatttaatattaaaatttaaattttggttaataattaaacataagcatacataaaagatggggccgtaggagtcctattcgttggtcaccgtatgggcctcacatgatgagagtacatgggcatcatagaaacttcttgaaatcgagagaaaccagtggccgatcgaggtgatgtctgtcggcagaccaaccacaaatcggcacaagtttaaggagtaaggaccatcggtgtggtaaagtgggcttggcacatgctgtttcatttcatggtatcctctatctcgaccaacttgctgctgatgctgctgcttgcctgcttctgccggacgcctttcctcaaagtgatgaagttgccaaacctgatttgagctacggaccaaagttagcttgccaattactccctccgtcaccacaatataagagtttttaagtttttgcttacaatatttaaccacttgtcttatttaaaaaatttgtgtaaatatgaaaaacgaaaagttatgcttaaaatactttggataataaagtaagtcaaaaaaaataaataataattttaaaattttttaaatgagttaaatggtcaaacagtataagtaaaaactcaaaatcccttatattatgggacgaagggagtactatttggctcaactgcaactgcacgtactatattcacatgctaacataagctttgcgtaagtgcttggttttacaacaataaatgaaggaaaagttcttcgcttcttctgcctctgcagcaatgctatgtttaatttaaccacgcacagagcaaggcgcagattcgccgcgtcctgtcaatgatattccaactcactgtcactgtcatatgatctgcaacctgcctaaaccggcccgaatccatgggcttcctctccttttctttatacaacagctagcgtatctccctcgaggcgaacaagaactttgcttacgtttagcatttcttcacttggcgaaaaacaactcgtcaacattggcacatcccacagcatattaccaggccaaaaaccatgcgcaataatctgattaattaacgcgttgtagacacgcggattcgacagtataaatagcggcaactcgttctcacatctcgtcaaacacctacaacacctgaaccagctgagagctagccaagaattcgatcgggcgaga

SEQ ID NO: 1716 - DNA, 1501 bp, Oryza sativa
tattgacatacaatctagcagcagcagcaggcatcgagatgggcgcagcggtgaatgccccctgaaacggaatggaagccgcggacaagacgacgacgaggcatcggagcaagagccgggccgatgttgtgggattcggtcccgccagcgtacgaccaaccccggccgctccgcgcccgcgcgacccgcacgtgagagcaccgcgcccgcgcgcgcaccaccacgcgctggaaatgctcgccgtccgtctctacgctaggcagcctcgcccacacgcacacagccaaagccaagacgcccatccatgtggtgtggcgcagcgagctgaactgctgaagtggtagtggtggtgtggtccatcgatcgatctgtgcagcagcagcataagctgcttggtggtgcgctcccctctgcgcggcggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaagagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttcaccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggttatagagcacttaaacttagttacaaagtacttcctccgtcctaaaatgtagacattttttaggttggcacgggtattaaaaaagtatgtgagaatgattggagaatgtgtatgattagttgaaaagaaaaggaatgtgaatgagaatggttgtgattggttgataggaggaggtaggtggaaaaatagcttcattttgggacaagacactgtgttagaaatagctatattttaggacggatgtagtacttacattgagctacaatgaatcaaaattagattttacaactgtttttgtttctagatttatgatttttgacatattcatcatattctctttttttaacgaatcggcgaaccgccaatttcatggaatacatgagtaaaattgtacaggcacaagacgcaagaataaaaaaaatgtgcaggctcaaggcctttggtcgaaatgcttcgcgcccgccaaggttcatgtttttttatcgcttcctccttaattttggctgttaggctagtcgtcaagagctctttttgctgg

SEQ ID NO: 1717 - DNA, 1501 bp, Oryza sativa
ccttaatcaatttattgcgcaataaagcccagggctgacgtcagcgaggggagggggtggcgccgacaggcgggccccactgatcagcggcactaagggggggagagggggcggctggcaagcgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacggggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgtcggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggcactagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagcgcgcgcgcgggccgggagatgcgggggaagaggcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggaaaggggaacgggccggcccacaaggggaggccgagcgcgggcgacgggtggactgggccgacggcccaagaagaggaaaaaggaggaaacaggaaaaagaaaaagaaaagaaaggattttcctgggatttaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaatttttaaagcaagcaaaaggggggaaacttcagggcgtgacatgcac

SEQ ID NO: 1718 - DNA, 1501 bp, Oryza sativa
gaccacggggggtcggccaactacgacgagctggccaagcgcctcggcgaacacggcggcgtgctgctgacggcgacggtgcggtgcatggacggcaagaaaacgaacggcaagccggcggtggcgacgggtctgatcgggcggatccacgtgcggttctacgacgacaggaggtgctcgtacgactcgtcggagcggcggccgttctacggggcgtggctggggtggacggcgaggtacgcgaacgcgagcgtccacgtcgggctgccggcggcgtgggacgcggcgagcgacgggtggatcaacccggcggcgctggtgttcgacgcgctgcctctggtgcgggggacgcccaactacggcggcgtcgtgctctggaaccgacacttcgacaggaggagccgctacggtcagaccatcaaaggcatgctctgactctgatcgatccgtttcatttcggatcagctgcactgcttttgttatgtggtttcatacaccaagttaaatttgcgtttccagatgtttaatccttgcaaaaactttggcgtacaccaacatgttagtatgtcacacatatcacgtgaagaaataaaatctatgagtgataatttatacagcttcgctcgtgaacattgctgacagtagtttttttgacatgaaacagagcaacacagagcatgcctggtatcatgtgaagagataaaatcactgtacatcacctttgcgtaaaaaaaatgctatggatgcagagtttgtaccaagtgatacacgagggctaaataccattttacccaaggaaagaaataattaaaaaactgttcaaaaatttccaagcaatatctaaaattttctgagacaaaatgtataaatgggatgtgaatgccactaaacttacaaaaaaaaaacatcgataactgcttagttatagttattggctttattgagtcagtttgtatttgtaaattaattgacaaatcggccaagttcaattaaaaccacactaaattcaaaattttgataaaattgattacttctcatcgataaccgctcggttgttgtggtatcgacaaacctctgtggaatggttttcggtgctcaaacactttttcaaagagcactgctacacgtacttattcctactacaagactattatttgttgattaatttgcgtcacaaaattgactatccttccgtcactttcagaatgattttccactcacgtcatctatgctgttattgagccgttaaatgacaaggaaacacgcacaagaaaactgaaaattcaaaagatactttcgtactttgaccagaaatgataacagatactactacataaaagaccctaaaacagcaggattagcctgggtttagaacgaatcacacacttttcttcgaaaccactgtctcctcagttagcttgttcaactagaccaataacagagtttctctatgcagtattcattccatcccaagaaagcaatgcggcaagcaaatgaaggt

SEQ ID NO: 1719 - DNA, 1501 bp, Oryza sativa
aatttattcgtacaagtatacatttttgacatataattttttaaatatatagtcgtacaaactttatacatgtacgtaaaatgtttatatatactccctccgttccaaaaaacaagacaaaccctggtttccgtgtctaacgtttgaccgtccgtcttatttgaaaaaattatgaaaaaaattaaaaagataagtcacacataaagtattaatcatattttatcatctaacaacaatgaacatactaattataaaaaaatttcatataagacggacagtcaaacgttggcacggaaacttagggtttgcttttttttttttgggacggagggagtatattttatacgtatggacgcgtatttcttaccgtacggatagtgatcaggcgggaggtggtgggcgtgcctgattgctaattagcgatatcgtatcctgcatgcatgaagtcacctttctttttttttgggtttaatcaagtcatatagtagatttaatttctaatttgttacttagtttctattggaaatttaaaaatgtttagcttgattttgaaaacttccaaccatgagtatttctaatagagaaatatctattcagcttcaaaaggtatatttaatttgaagctttcaatttaattttaaaacttccaacacaaattttgaaacttttaactcaaaatttaaaactttctaggattctagagttaacttaaatttgaaaaaagaaaaagcgaggtgaggatggagcggacgctgtggccatggtgttgggggccatggttggcaaaccccaggtgctgcggcttgcacattccgctatcagctgtatgtcggtactcgtaggtactcgtaccgttctctcaaccagaggtttcgttccatattacacctgtctcaccaagaaccctatcttcttcgtctgcgagaagaggatcgagctcccctgcccctcccccttatcccgctggtccgctcccttgaagactagaaagagagcgagggggaaagaggaggaagaaagctggaatgggagagaagattagaggagaaagctgatatgtgtggttcatgttgagtttcatattgacttgtcatgtcagctaaaacctagaactatatactttctagaagctctgcttggcaacttattataagttgggtgtccgtgttatactatagccttgtttagatcatctggcaaaatttttcaccatgtcacatcgaatatttggacatatgcatagagtattaaataaacgaaaaaaataactaattatacagattgcgtgtaaattgcaagacgaatcttttaagcctaattgctccatgatctgacaatgtggtgctacagtaaacatttgctaatgacggattaattaggcttaataaaattcgtctcgtagtttacaagcagattctgtgatttattttgttattagtctatgtttaatactttaaatatgtgtccgtatatttaatgtgacacgccaaaactttatccc

SEQ ID NO: 1720 - DNA, 1501 bp, Oryza sativa
gcaccgcagtcgcagccctcgtgttcaccgtccacgaccccgtcgtcatcggccctacacgtccgccgcgccgcgccacgctcgccagtttcgcccttccatcagtggcctccctgccgccgcggatccgcattcgccgcgggcgtcgggcacgccgtacatggcgctacccctccaatctctcctgtcgccttcggccacgcccggccccgtcttccggtcacgttccgccatcgccggtctgatcgcgagcgaggtcatcgcctccgcaatgtcctcattgtcgccatcgatctcatcgccacggctgacgatctcctgtcgatgcgcgatccctgcctcgtgtttcctcctccacatgtcttcttgatccaatactgaaaccttcagctctgataccacttgttataaaagttagtcgatatagcggaacaacgactaaccttcccgatcgcttcaatcattgatcacccaagacatgccagatgacgacacaggaacacacgatatttgttaacgaggttcagccgaagcctacatccccggggctctgattatgggcgctcctccccaaccaatatagctcctagctgctacgagtccatggccacgccgacatcctctccctgcgtgtctacgctacattgtagtcgctatggttatattgtggtgcccccctctctatttaagagagatgccgggttacagaattcgactctaactccaccccctaacacctattacaattccaagtccaactgtaaccaaataggactagtatattcaacacctattctaacagatgcaaatgcacgagataagaagagaaacaaatagggtagcacatgttttaactcaactgacaatgagtactaggttttatgcggagtggagactttgttctccttcaagaatcctatacttcttaaatcaggaacataatccattattcagtcattaataaaactctctttaactagaaaaaaaaaagaagaccgttcaaacacaagaaactcttttaaacccttagggatgtcctctcatatgtcttaaaaaaccatataaatagctattaaaaattataaaataaattgacaacattcgtacaatatatataaatatcaattcataaaattttaagtccaaactcaactcacacattttaagtacaaacccttcaaacactgctcttctgaagttgaagcttgggaagcaaagcccacaatgcccgcaaagcttatggtccagtcgaaagcccacagtgccggcccattaggctaagtaaggccttgggctccaggttggccagaatttgttggcctactacacgtgattccagcgttggaatcatcacgattctcgaggcggcggcgggtgccgaggtcacggactcccatggcggatcatgtctcactgttcagaacctcgcttctcgctttgacttcgtgaaccttgtgcagctccgagcttgttcgccgccgccgccgcgccgtgcgtgcaa

SEQ ID NO: 1721 - DNA, 1501 bp, Oryza sativa
gttttagctgacatgacaagtcaatatgaaactcaacatgaaccacacatatcagctttctcctctaatcttctctcccattccagctttcttcctcctctttccccctcgctctctttctagtcttcaagggagcggaccagcgggataagggggaggggcaggggagctcgatcctcttctcgcagacgaagaagatagggttcttggtgagacaggtgtaatatggaacgaaacctctggttgagagaacggtacgagtacctacgagtaccgacatacagctgatagcggaatgtgcaagccgcagcacctggggtttgccaaccatggcccccaacaccatggccacagcgtccgctccatcctcacctcgctttttcttttttcaaatttaagttaactctagaatcctagaaagttttaaattttgagttaaaagtttcaaaatttgtgttggaagttttaaaattaaattgaaagcttcaaattaaatataccttttgaagctgaatagatatttctctattagaaatactcatggttggaagttttcaaaatcaagctaaacatttttaaatttccaatagaaactaagtaacaaattagaaattaaatctactatatgacttgattaaacccaaaaaaaaagaaaggtgacttcatgcatgcaggatacgatatcgctaattagcaatcaggcacgcccaccacctcccgcctgatcactatccgtacggtaagaaatacgcgtccatacgtataaaatatactccctccgtcccaaaaaaaaaaaagcaaaccctaagtttccgtgccaacgtttgactgtccgtcttatatgaaatttttttataattagtatgttcattgttgttagatgataaaatatgattaatactttatgtgtgacttatctttttaatttttttcataattttttcaaataagacggacggtcaaacgttagacacggaaaccagggtttgtcttgttttttggaacggagggagtatatataaacattttacgtacatgtataaagtttgtacgactatatatttaaaaaattatatgtcaaaaatgtatacttgtacgaataaatttataatacataaaaattgtaaagatgtgtaaagtttatacataaatgaaaacttggtatataattttgtgtacttatgtatgtataactatgtatatgtacatataaactttgcatttatccaagtataaatacaaagtatataaatacgtgtacatgactgaggaaccgatcccgcgggtgcagctctagttgtcccccctccggaacttgcctctatagtaaaaaaactcgcgctacttgcattgatattaacgagttgttgcttcctcctcgagagagctcaacggcgacgaagcagcgcgacgcgacgcgacgccctgcggtggcgtggcaacaccgcaacaatggcgccgccgccgccgtcgccgccgtgccggccgcgagtcaagcccg

SEQ ID NO: 1722 - DNA, 1501 bp, Oryza sativa
gtttctcgtgcgtacgctcactattgggggcatccatccctacctcaaatctggcttaatgatttggttaaattgaaaatacaaataatttgggatattttttcgccaacacagaaaatttgggactggatttaggcatttgttggagaggtgattttggccttaattcacaacaattataaaactgcgaaagatgcttagacctccctgggaaatgctctcatagaaaaaaagaagagttttaataagatcgttagaaaacagaagcagcttttctctcgagttcaatgcgtgatgttgtcgtgtgaaaaccgaaaaccgaatgtgagtgtgggagtgagtgagtcaccgaggaaacgggtccctgcgagtgggactgagttaaagctggcacgacacgacaccacacgacaccagcgatcgctgtagcgtgcgccgcattccgccggttttgcagggacagccacgtccaaattcgaagctgaaatcagggaagaataaagttgtataggagaggcgcacacgggccaatttcggcggcaccacgcgccctcacaaatttggcaggcagcccatcgaatcggcatgggccatggccctcccgttcccggtgccccgcggcgcgcattgggccgtgacttccaccgcgcacgttttggtgggcttcactggtgaaatggcccgcgttgaacagccccgcgcccccgcgccgtacaatgcagcatttctgaggaagaagttaaccttggcaacggtattttctctctcccccaaaataggtgaagttttaaacttttacatatgtattagtaaaatagatataattaaataggaaaatgatatgactggtcaagaaaatgaagtagaataagaatttgaatgatataagattgtaattggttgagaagaaaatgcatacgacgaaaagctcagattcacatttggacatagctggcactgtggtaacacattcacacggtaatcacagagatagagctggtacacatatgtactgctcctaattaagtaattactaccaggctaacactgtctttcagtagcaaacaaagcttaaacacagtactacagtacttgccatggatgaccccgccgccgaacacttgcccgtaataccagtccccaacggctagtttcaaccgttcactccgcccgcgtccgatcccagccgttgaatccacgccgcgccatcccggccgtcgatcctctcgaccgttggaggcgtcgccctccgctccggataaagctcgagccccccaccgcgccgctcctcccacgccaacgcatctccgcgtctctcctctccgatccaagcaaatcaagcaagaacaagaaattttagagagagagttggaagagcgaagagagaagaggaggaggagaggacggccgcctgcttcggtccgggagggagttcgccggagttcttggcgttcttggagcccggaggaggaggaggaggagcaacaggaggccgtacgca

SEQ ID NO: 1723 - DNA, 1501 bp, Oryza sativa
atcaatggcgccgccgctgccggcaagaccggcgagctcaccgtcatctggggccggaacaaggacgagggctcattgcgttcgacctgcgacaccggcctctacaccaccgtcgtcatctccttcctcaccgtcttcggccacggccgctaccggaccgacctcgccggccacccgctcgccggcgtcggcgccgacgtcaagcactgccaaaaggccaagaacgtcaccgtcctcctctccatcggcggcgccggcgaccagtactcgctgcccaccgccaagtcggcgcaggacgtggccgaacacctgtggcacgcctacctcggcggcggccgcaggggcgtgtcccgcccgttcggcgacgccgtgctcgacggcgtcgacgtctacgtcgaccgcggccggtggggccactacgacgagctcgccaggcgcctgaggagcttcggtcgcgagaagccggcagtgcgcctgacggcgtcgccggcgtgctcgctggcgctgttcgacgacgaggtggagacgatgaagacgctgtcgctgttcgagcggctgcacgtgcggttctacaacgagagctcgtgcgactacaactacttcgagacgcggccgttctggggcgcgtggaggacgtggacgtcgaggttcccggcggcgcgggtgcaggtggggtggccggcgatggaggagatgagcgggttcgtggacccgcagacgctgcgggagagcgtgctatcgtcggtgcaggacgatgccaactacggcggcgtcatgctctgggatcgctactacgacaagatcaccggattcggccgtgccatcaaagacattgtctaattgcaatgttactccagtgtttatactacatggttcactgtgttgtttaccaacctgcattgcgtcatctgttactatctgtacccgtctactggcatatgcatgttcgtatgggtcaggcttgaaagtagtatgattatgttaatttagttttgaaatataaaagaatccagcatgtttcactgtgctgtttaccatagttgcattgcattattggttgattatatgtatatataaggctactactggcacatgcatgttcgtatatgggtcagacttgaaaaagaatatattccgtcaatgtgatgcttcttccaggcgtataaattcttcatgcagagaatgacaaattgttgtcatgacaaaaaccattaaaccagcctcacgtttcgtcctgattgcaagttgttgacttaaatttgacttgtctcggaacaaaacaataacctgcagtccgtctccatgtgtagtttggtcgtcgatttctgcggcggccgcgccaggatttgtctgcaggcggcaccggcacgccattgacgacgaccacagctcccccggcccttatcttctgcatggccatggccatggcggcttatatatacctactcatgtcgccggcgatgccttcacatcacgtactaattaagccatcgtatcatat

SEQ ID NO: 1724 - DNA, 1421 bp, Oryza sativa
tgagtaaataaggtctcaacccaaacataatcagtctattttttgggttaatagaattcatgccactaaaattttcatggttttgaaaaataccatcattatttatctattatttatctatttagatccatgccattacaatttcataggaactcaaaatatgccactacgtagcattttctattttttagaacaaaattcccatgttcttcatccccttctttcatacttctctctctaggtggaggggctgctgatagccgacacaagcgagtctaccatcccgtatcgccctgtcgcctctccatcgtcgagttccaccgcccacgcgtttcctcgtcgccgagttccactgtctccgcacctccaatgagttgaacgtagcagttagcactctcgggctcctcaggtagggccgatgtagctgccttcgtcgaatgtgaaggtgtgggggcgatgctctgggatttagcgttgctctcgccagtggcaaatcgggccgtgaccggcgagggtgtttgagcgcagcagatccaaccatgtccgggtaaggaggaaggtggtgtggatccgacgcgacgaagattgtcttctccctcgttagagtaggagcagctctctctctctctcccagtgagctgcctcttgctggtgtcgggcgttgctccgggattcaatgtccatgctagggcaggcgatgcatatccgatgacgacggaggcaagggggcttggatccgcgtgctcgtcgctcctccccacccgcctcctctctcatctggcgacaaaccggtgcatgagaccactcccagcgtgacatgctcgtcgcagcgtcagcgagatcttggagacggcgtgtccagcaacagctcagtacggcggtggcaacgagctcgtcgcagcggcatggatccatacgatttgattttttttatggtgcttgattgtacgagatgtaggagacgtgatattttagtctaaaaatacggtagaaaaaaatgtacaacatgtcatgtatccaattttagaaatactgcagcggcatcttttcaattagtcgaattataatcttataaatttcaaaactagaaaatccaaataacctttgtttttttcccaccaccaaactctggtaatttatatttaatatttttcttattactactaccaaactcgaaaaatatttattttggcaagaaaataaaaccaaacatatccaatattccaaaatattactccctccatctcattttatattgtaagactttttttagttatctagatttatctactgattatgttttctatatatgcctagaatcattagtatctaattatatgaatttacgtaatactagaaaatcttatatcgtgtaacggatgaattacggatatacgtacagacagtaatagaaagaaaga

SEQ ID NO: 1725 - DNA, 1501 bp, Oryza sativa
atcagcgttttgagttctaactatatttatctatacatggtatgtgcgtatgcacggcaggagatgatttccaacactcactcggctgtgtgaagccatcatgtcctgctgggaaggatcgatgtgaaagaaagactgggcggtgctggcgtgctgctcgccgccggccaggacaggggggcgaacaggtaacttgctttcttgcagttattttctgggtttctgttctatctgttgccattttagattgtattttttttcttgctaaaatagcatggaatggtgtcatgggaactagaatgtctttgggtattgcgttgggcctgttcctgcttggttgctccacggctgcaatttttcagaaatttaatggaaactcaccttgacgatctagggaaatgtgggaacactagaagatgaaaatgcctctcatcagaattagtcttagcagagaattgtattgtattgtattggttgcacgctaccaattcatcagggccaaagattgtgataacctcatgacagcatacacatgtggttgcgagctttcaaataaatgtgcatatccatagcctaatttatttattctgctatcataatgtttgtaacttagtgatgctatagctaaatgaggaagcttgctttgttgcaaactatataagagagataagaacccagcattttttttttaatttctagtatctgatcttttcgtaagagtaattttcgctctcttttttttttgcggggaagaataaatttcacttatctacaacctttagttacaagaatagcaatgaacttcactgccaaaaattctgactaccctttactacggccgtacggcgtagtatagtacaatatgatccatttgatcaagagcaattgacagcccatattcatcctagggcagctaccattaaaaaaaaaaatcccctttcacatgcgtaaccttgcagctagttgtatttcctactgttttaagtatgatattgacaatagtagccactgagaggatggacaaaattgtccaaaaataacctcaagaaagcaaatttggtcatctgtgctgcttctctgtcactcttggcttgcaattgttacaaaagccatcattaggccatatttgatctcatcaaagcgcaacaatgacagcaatcaaatgaatcatcaatcttgtaacagccatattaaggagaatttgtgtcatataacaaccacatttagaggcttaaaacctccttaaatcctaggagaatcctaggcatgtaatacataaatcatccctataaaaggggacatttgagatcaatgaaaagagagggaattcacactttcactgttcattcattttgtactctaatacgttatcagcaacgctctactgagaaagaacggtgaaactcacctgcacgtggagggtaagatggcacatcctgttctctcgatgccggttcttcccttcctcgcaacatccgtgctcgccatctccgtcaactca

SEQ ID NO: 1726 - DNA, 1501 bp, Oryza sativa
aaatttgatattaaaaataattaataactaacacgtatataaaatacaatatgaatattacacattagtagttttgtaaagttattgtaaaatttaaaattatgttgtcattttaatatatttgaataatataataaaaaacatatatgctattatatgagagaaaatataatgatactagccgcgcaatctgcgcgggccaccatgctagttcctatgtaatggacaatcctatagagattttcaaataaatttagccagagttccaacctcttgaaaattttcctgattctatctctcatctaattcctgtggtccaatcaaatgatcattcctgcattttccgtgttgtccgaccaaacgattatttatgtgtttatcctgtgttttccagtggtccaatcaaatgattatttctatatttttgtgtggtttaatcgaacgatcattcatgtatttattctgtgttttataatcctctgttttttacttactcctatgtgtttttttattcttctaattttctattcctgtttcctgtgattctatttttcttgtacaagatatgtgtagtaggaatatataggatagtgtgtgcgagtatatacctttatacaggttagggtttatttatagccaattagtaggaggctgtgtttgtaggatgaacctttgcgacggagttaccggtgggtaaatgcaaaaataacgaccacacaattagcaccaccgtccaaacccatttctttatgttgcaccgttaaccacccagattaactcaccattactccaccccgggcccaccccccagtgtccccttccctccttgtttgtttccttaccccttctcataataatctcattcctcctcgcctagaaaccaacgctaatctcttcactcccaccactactactccagcacaaaaaacctcgtctcctcctcctcctctctctcgagctcatctccattttcaaatctctctttgcttgctcgaggtgagccatggcggagctgccgctggcggcggggctgctcgacctgcgcccctgcaagctcgcccctccccctcccccgcccctccccgtctccccctcccctcgccaccaccgccgcccccactccaccgccaccgcctgccgcgccgcccccgacctccactcctccaccggtaagcagtagcagcagcagcagcctagcagctagcgtctctgccgctctcggtctcacttgtctctctctcttgctcccgcccagagctcgccgacgggagcatcgtcttccgcttcgcgcgcccccgggacgacgacgacgaggagcagcagcagcggcgggcggacgccgtggctcccgaggccgcggccgtcgtcgaatcagggctcgacggtgacgccgccgcagctgctgaacctgaggcccgggatggcggtggagaaggggaggtgacggcgacggcgacgggtttggacgcggaggaggtggtggcgagtggaggagcggagg

SEQ ID NO: 1727 - DNA, 1501 bp, Oryza sativa
ctctcatatcttcacctaccatttatgttgtgtccttgggtaatttagttagaaaactagttcacacacgttccctgcggatatgacaccctggaatactcttgggtgaaagctacaacggtatctgtgcgcttgcagagagcttcacctttggaatgtggcattgatttctaccttggtgtgtgtttgagagtgaggagtggaggcctatttatggtgtggaagtgacttgagagagtggggatgctaagggaatattctccctccagctcctctcaaacctccacctatccacaaccgacattagatggtggtttcctaccttgggacttacgccacttacttcaggagatcagtaatcgtcgccacgtggaagctgaggccgaggggagccagccagggttcggccgatcctgttcgcgccgttttctgtcagggtcaccgcttggtgcgtcctcaagtttaggttgttctcctccttgtgtgggccctttaattcgtgtactctcctctgattggttggagttgtgctttcttactagtgttttctctcaattggaacaagtaatcacctgcatactattgatggtcgttatagaccaatttcgatcgtcaatacgtccaaaaataatagagaactagcaatgctttaatttagagataaggtgaaatgggttaaaatcatccattggctagagctctagctcttcgtagcttcacgtgatccatccttgaaagagaacacttgtgtgcgtttagtttagagatcaggtgaaatgggttaaaatcatccgtattttttaatgggatagttttactatttggcattaagaatggattggttccattttttcgagggagagagaggaggtgggttgaattggacccttagattttgaggtgtgaatctaacacgaatattagggaaatattcccctttggagatcaacccatctcacatatcctcaaattaaacactttagaaatgggttcgacctaacccatccgatgaaaaaaacgcagcttgtttctgaatgggataaaggtgagttacaaagaaccattgagctagactatttcctcatttatcaggaacacgcttatcaaactgctaaattgagtttttcgtgaaaaataatatatatatatagaaatttctttttagagtaaaacacacgaccggtccttaaagttgaagcgaggtttcacttagatacatgatctaggaaaatcgtcattcgggtccacgatcttgtttaagtgaatcatttaggtccaaagcacctctgaccgggttgactggcttacgtggccgtccacggaggcagcatatttgcattttagcccccccacatcttggcttccccatttccgatccaaccattctccccgaaatcctcctcctgtgtgatttctagggttagcgattgcagcgtcgattggggtggcggtggagacgtggcggcggccgcgaggacgacaacgatgaagaggagggagg

SEQ ID NO: 1728 - DNA, 1501 bp, Oryza sativa
acatgcaatccaagctgaagaacattgactatgactgcatatatgcaaaaagctccaccaccggctgcggtgggcggttgtgcccatttgaattcacattaacgggcggaaggtgaatcacaagcaggagcaactgcatatgtctgccagggatggcattggcatgatccattgatccgtggaaatctgtgcggcttatatagaagttgatttcaatagagagaaaatttgcccccaaaaactttcagttcgagagttgctcagttctcctctgttttttatccatttgctctgttattgctggatttgatacagtactatcttaagatgttcgatatgccgcctttgccaacaagtggtatcagacctccatccagcgacgtagagcgtgttgaagacgagctcggtgtcacagatcagggtggtggcccaacgagaacgatgccacaacagcgcgtcgttagaagatgctttgtctcattgcgtttttttttttaatgagacaactatcatttcggcccgtattccataacgagtcagctcgagctggctcgcaagctcaatgagccaagcgcaatcaaaagaagcacaacactcattaggccaacaacccacttgacggcccaggcacccaacccaattctgcaataggcaaaaaaaaaaaaagaaaaaaaagaaacactctgaagctaactccaaaaagaccagcgacaatcagttcgcatcgtggcattgtcattgtgcccccatcggctcctctgcagcttgcatggcggccctggcacctttgcactccactcatcgggagcgatggtgcattgcagagcatggctacgtaaaaccaagcaatggtgacgatggagtcaaagcaacacgtgctccacgactcatgtcgtcacgcttgttgggctcacttccccaatcgtcacccaatgcgccgctatcccccggcgtcatcatacaatgcactcctcttgttgctctcgctggccagcacactcctctcgtcgtgtccattaccgtctcattccatgcccctatccgtgtttgccaaagaggaggaagacaaggtggaagagatgaaggaacactggctcgcaagctaaaacaagctagattgaaaaggggaacgtgggcatcaccgcattgacatcggattgggatggacttaggcttcgtcgaagcggctgaatcagtgagctaatttgtttgacgtaaaacgaatgtagcatatgattaattaagtattactaataattatatattttaaaataaatttatttgattttaaaaagaagagtaaagtacacggccagtccttaaagttggagcgaggtgtcacttaggtccatgatctagataaatcgttattcaggtccatgatcttgtttaagtaaattatttaggtccaaagcacctctgattgggttgactggcttacatggctatccacggtggcagcatatttgcattttagccccccccccccccaatcttggct

SEQ ID NO: 1729 - DNA, 1501 bp, Oryza sativa
ctatttgccgaatctgattcatatctcttaaccgtaaaactaaatataaaggctctctctcaactattaaaaccggctcattttacctcctcaagtagtgtgagaaaccgaatctgattcattttggctctctctatccaatgtggcatctacatatgccattacagtgtgagaaaataatacggtacgattatggggcccacatgtcagtgacctctcttcctctaccctttcctctcttctcttccctgtttctctctatctctctcttttctcccagtggtttctagcttctaggggccacgactaacgaaagaggagctggatccagaggccgaggcaacaacgaccttgttagtgggagagctgtggcccgacccgggggatagtagccaggcggagcctagggatggttgtgttgaagaaaaggatggggtcacagaggatcttagtgtttgacaggtggtgctctctggagccatgcgggttgggaggggtccaacaaggacaaggaggctaattaggcggtcactagatgcggagatgaggagggagtgggagtagttgtgggcacggaagcaaccgtggtgcgggaaggcgggagagcaatacaactcaaaggtgccaaatctatcacgagtcccgacgaccgaacgatgacacccttgttggcttccgctggatacgcctccccatctcattctcttgtctctcgctaaccaacccatgctctaggtgatacacctccccgttgactcctgtgatctctccatcgccagctacctgcctccacagtccctaacaccagcgtgggagaaagagaggaggagcacgatgggtcaccgcaaggctctcggatcggtggcgctagattgagggttgttgccattacacgctctgctagtttcctttttggaccaacctcctcgccgagatctgcaggccattgcctttctccttccgtgccctcccgtctctgatggccttggcacctcaacccatcgagggaaagaagaggggaggagccgctaatgccttccctggctttggctctgccttactgccatcctcccaacctagctctctactactgctagaaggtgagacttgagagctgaggaagagggaagggaggagagaggagagaggagaaaggggagagtttacgaagaaattggttaagggtggatcaaggtgggagaggatgacacatgggtctcacttttccttattattttgtcaactttaatgtcatgtagtacatagctacatagctactccatgtagtacaaagactatgttaatgtgtcacgttggtgccacaccagtctaaaccaccatcactgcacatattatcctgctcctcttgtggaagcatcaagatcaaagaatataggaaaggtgatttattgatagagttgtgaatacgtaactccccctatcaagatttaaatcctagtatccacaaatatcacgcacaaacaaatactctttcaatgaa

SEQ ID NO: 1730 - DNA, 1501 bp, Oryza sativa
gaattagagatatggtaagagtccgccatatggactttttttttgtttttttccttttatctcctaaatttgagtctttttgtttttccttttgtctttaggaaagtttgagtcgtgtctataatggacaggttttgtaatttgggtataaatataaacccaagatcatgtaaaaagggacgaacatccaatcaatacaactttcggcgcattgcccccttttttcttttaagtttttcgacgagttcttgcttcaagtcggggcatcggttgcgatctctcaacaagaggtgacttataccatacaatctgaaacgtgattgataaaaacaagatagatggtattatagccgatgggacatatttagggtttgctttgttcagttcatcataaagattgagccaatttggtttaactgcatcggctaaaccctaacgatacgacatcggcttatcggtcgatcggctatcgttcatctaactatatttgttgtttcattgctagttgtaggatcaaatcagctagcacgctcttgacacttgagacaagtcttgtacctgcactggagttaagcaaatctcccgggctgtcgtattttgcagtaacagaatccgagttagagaggggaagctcgcctaagtcgccggcaaagaagtcgaagctcccaaagtggaaggttcgccctagggcgaaattgaatccaacgacgtcgatgattggctccgtcgcacttgtcgacaggaaactcggcgcaacccctagttggtgcgccaactgttgattctagaaatcggcaataataaaaggggtagccctcgatacctaaaagtgtatggatgcggagataaggatttagacatgttcatactctctcaatgagaggtaatatcctactcttgtttaggtattgtatccgctgagtgtagtattgatctggcgatctgactgtggttatcttgctatctctcctactcgctctgtcaaaaaaagaccaagcaatatatacattagtttatatttaattgaactaatttcttgtcatagatatcattaaaattttatatacacttgatcaaattttgaaaaaaaagttaattaaaaaaatatcaaagcgtcttatattgaaagtaatagacgttgacccattgtactgggtcaaaacatgctgataaggtagatgatcatgtccctcgggaacgaaaagctcttgctgtgtcttgcgccgatccgtctttggtctctgcggccttcaccagtgctcttccaacttccaagttccgatagctgggttcgtatcttcattgggctgcgattttctcgataccgtccaggatgaatctcatccaatttgcttttctctatattgcttgatacaagcagctcggtgagtatatccatcatcgttctccccattttcccagttcttcaatctgtactccatggttgattcgatctccgtcctcagggatggaggccccgcccctcgccgccccgatttgt

SEQ ID NO: 1731 - DNA, 1501 bp, Oryza sativa
caggtattatatagatctaggaaggtagccggggatgtattgtacacagggttaaacttttcggtttagacgatttgatcggcatcaccgaaataccaaaatttcagtctgaaatttccaaaaatttgaacaaaatttagttgaatttaaacaaatattaccaaaattcatgaaaaattaaaaaaatgaaaaatttcggccgaaataatagcctaaaatattgggtccaccgacagtggcggatctaggatttagaatatgggtggtccgacctaattttttttttctaaacatactaaatctaacgatggtaatatataccatgcaagtatagataatagaatagaccaaaagtgtatcatgctatattaataaagcatcttaaaacatataaaattagtaattacctaaaattttgacttaaagaagcttacatggctataaaagttttaaaagaattgccatactaatttttcttcttattaggtctacgccttctgttggaattaatggatgggccttagcccactcgaagattaattctttggaaaatcacaaaagcccacctcatgggatggcatgcatgtggagtttagtaccaccttgcttattctaagagagggggacctccttaaaagggaggatgccctcctagccacttgaagcatgtgtggtggagagaagagggggaacacacgcgcgcgctcgctcgcctcgcctcgcagggcaggcggcgcgtgtgcacgacgtacgcgtcgaatggtccgccaaaaattggttcctcaccttgcgcagatgcagcctccttttgcagttttgttttgctgcaaattcggattcgtttttgttttcgaaacgttccgaaaaatccggtgcgtgaaaacggcgtggagtccggataagttacacgtgacttatccggtttggttacgcacagtagagatcgtgcgggcgccctgatcaagcgacccttctctatataaaccgaccagccgtcttcacgcaacacacaaaaaaatcaatctagggtttgcctccaactctgtgctgcgccatcgctcatagattactccatcccgctcgccggcgtgcaccggcgatcgggagagcaggtctccggaacctctgccttcgacgtcctgcaccgggagaaggcggcaataaggtttttgggaagcgctgagcgcgactgctccctgttcgtccgcgacggctcgtcttactcttcgctcgcgtgctgcgcgccttcatagacgcctgcaatcgcgaaaagttcctgccgagcagccggtctttctaccacctcggtgcgtgttcaatatgttgcgcatatttgatctgttcatgttttactgcttagtttacatgtgtagatctaatgatgcgttaatgctagtatacatctgcaatgccatgatttatttatggaatatattaaatcattatatgcctttaatctcaacaatccaaaaaccttattataggcactgtgattttacta

SEQ ID NO: 1732 - DNA, 1501 bp, Oryza sativa
tcaggtattatatagatctaggaaggtagccggggatgtattgtacacagggttaaacttttcggtttagacgatttgatcggcatcaccgaaataccaaaatttcagtctgaaatttccaaaaatttgaacaaaatttagttgaatttaaacaaatattaccaaaattcatgaaaaattaaaaaaatgaaaaatttcggccgaaataatagcctaaaatattgggtccaccgacagtggcggatctaggatttagaatatgggtggtccgacctaattttttttttctaaacatactaaatctaacgatggtaatatataccatgcaagtatagataatagaatagaccaaaagtgtatcatgctatattaataaagcatcttaaaacatataaaattagtaattacctaaaattttgacttaaagaagcttacatggctataaaagttttaaaagaattgccatactaatttttcttcttattaggtctacgccttctgttggaattaatggatgggccttagcccactcgaagattaattctttggaaaatcacaaaagcccacctcatgggatggcatgcatgtggagtttagtaccaccttgcttattctaagagagggggacctccttaaaagggaggatgccctcctagccacttgaagcatgtgtggtggagagaagagggggaacacacgcgcgcgctcgctcgcctcgcctcgcagggcaggcggcgcgtgtgcacgacgtacgcgtcgaatggtccgccaaaaattggttcctcaccttgcgcagatgcagcctccttttgcagttttgttttgctgcaaattcggattcgtttttgttttcgaaacgttccgaaaaatccggtgcgtgaaaacggcgtggagtccggataagttacacgtgacttatccggtttggttacgcacagtagagatcgtgcgggcgccctgatcaagcgacccttctctatataaaccgaccagccgtcttcacgcaacacacaaaaaaatcaatctagggtttgcctccaactctgtgctgcgccatcgctcatagattactccatcccgctcgccggcgtgcaccggcgatcgggagagcaggtctccggaacctctgccttcgacgtcctgcaccgggagaaggcggcaataaggtttttgggaagcgctgagcgcgactgctccctgttcgtccgcgacggctcgtcttactcttcgctcgcgtgctgcgcgccttcatagacgcctgcaatcgcgaaaagttcctgccgagcagccggtctttctaccacctcggtgcgtgttcaatatgttgcgcatatttgatctgttcatgttttactgcttagtatacatgtgtagttctaatcatgcgttaatgctgtatacatctgcaatgccatgatttaattatggatgatatgtcatcattatatgcctttaatctcaacaatccaaaaaccttattataggcactgtgatttaacta

SEQ ID NO: 1733 - DNA, 735 bp, Oryza sativa
gatggtcggccataaaattaaccaacactcacttcggttacgcttcacggctttgagccatgctagtagtaatacaagtggagtgaaaattataatctcaaaatcatccgcatacatatatttgcttaaaacagtgtatactcgctgcaccatatataaagtgcagtataaaaaaaaatctgatatacgcatatgcatgcatccatatactctggccgtgcatttgctatcacgtatagtttcttcccaatagcaaattaatccatatatgcatagcaagcgacaacattgcccacttcgattacacttgatggtacagtgccacgctagtagtaatacaggtggggtggaaattaaaataggcaatgcaaattgtcacgccctaaaaaaatcgattaaattaaaaatgcatgttttaaatcattttttagaaattatgttaaaagcctacaagctaaaccctaattttctaggaaaattttcaacataaaaatgagctagataaaattttattaaatactatacttgctcctctattttctagatttttctgggaattatttgagcaagggaagtatttttaataaatgaaacatcatttcacaaattatttttattgaaaaagttctaaaaacctcttctttaggttattgggccgattttggcccaatactccctcctctcccgcgggcgagccggcccaacccactcagccgccgcccctcctcctccagc

SEQ ID NO: 1734 - DNA, 741 bp, Oryza sativa
tggatccaccagtgtccggcgatcggtgagctggtcgtggagttgcatttgcagtggacaaattaagcaacggaatccagagtaaccaatcctaatttagcacaaattaaagcttcaaagcatagataaatagagacaggtaaagcattgtgcattatgctaattctgcttcaatgcgatgctgagttgaacctatcagtcgcactacgaaaatataatatatgccaccagtccacattaatatatgccatcagtccaagatgatgcaataatctgaatttttgataaacaagatgatgcaataatctgaattttcaaaaagcatttaaaaaaactgtagcgcttgattatatcatgtttacagcatagcagcagcagaaaagcatgagcatatgaataggaacatgagcacaccattctcatcatcaagtaatatatatatgtactgaaataatctggaaacactgaaaaccaataaatatgttgcacatccccactgttaatgaaccataattctgaaaaaaatgacaggttaagctaagcaatgcctcatgcatgtagatatcagaggctgagtgaaatcaacatctaatacgtgcatagataagtcacgatcattggttggtcatccaagaagtcacgattattggatagcagaccatattcttagggcattatgacttcgcttactccacatcaaagattcaattttttttcataaaattacttgcatagacagaa

SEQ ID NO: 1735 - DNA, 1501 bp, Oryza sativa
aacacggcgaactcaccggtgaccaaaaccacggcggaagagcaacggacggcgccggcgacgaggaagaagcggcggcggtcttcgggtcgacggtgacggcggtgctccggcggtcttcggcggcggcgaagcggtggacggggacggcgacgacctcacgatcccgatggtggcgacggcgaccgacgacggcggctgcaacggcagcgcggcgcggctgaaccgacggcaacgacggcgacggctagggctacgcggaggcggcgctagacgcgacggcgggctaaggcaaaggtggcggtggatagaggagagctcgggggtgcttttaaaggggctagcgagcggcgacggaggcccacggcgaccggcgacgcgaaggaaaggttagggttagaggagagagatgaatccgaatccaactcaaatccaccggtttccaaagaaaattagccgatgtttccaaaagagaaaaggaagaggagatctcaaggatcatttgccctcaatcaatttgaccggaaatagagaggggcgatggaatttggaagggcaacggcagcgcagctcggctagggttcggccgggcgacggctggaggaggaagacgggtccgacaggtgggacccacctgtcagcggctgagagaggggaggaaggggcgcggcggactgggccgactgggccggggagggagagagaaagagagaggttttgggccggctttcggcccaaagccaaaagagacttttaaaaacctttttcagtttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaagcttttaagatcaattctaattaaacaacaatttatatatttaggattttaattagatcattaatgatcaaataattactgaactgctctttgtatcatttaggaattgagctctgaaaaatccgagaatattccagagagttgacttaatcatggagaatttaataaaaattaaatctgtaaggaagtcccaaagcctaggtggtgcaacgctccaaggcatgtcagcgcgaaatatctggatggatggggtctcaaataaagcccaaataaatacagtaaccatccaacctcatcgcagaccccgacatgtcttgaagggtgcactacataggctctaagccatcggatatgaaatagaagacacaaccgttggaataaccacaccagtcatctacgtcatacgcccgtcaaccactcgatggtggcgaccaaaagcgtaccccagagactcgatctcaacaaaggcatattccccggttatctcaaccatttcaaacccatcctcatgtgggactagttgcccaggaatgcaacatagcctcacataaatcatctcaa

SEQ ID NO: 1736 - DNA, 1501 bp, Oryza sativa
cagagtaaaactattcgaatagccgtgcccgcggttatgggcgggtctaacaatgtctttcgtgattagtctcacccttctcatcataataaaaggtgctttaactggtaataatttgattagctcctggtttggaatggtatattcctggtttggagatagaactgtgcagtcggggtggttgttcagaatggttgggcctatgcaacagggtatgttgtatagtgttggtttaatattgtttaattatcacttaactgttttataattctcaaatgtttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttaatttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacactttgcggggggcatcccacttgaaggcgcgcggcggcggctctccttctctccgtccctctccccccactggcagcgcacagccgcccctcctcctttccgccatcgcatccagcacctccacctccaggccagtggatccactgccacgagctcgggagcagcctgatctggcctccatgagctcgggggcggccaaatccgcacctccgttgctccctcgacttccaccttgccatgggctgctggtcactgcgagcttgaggccggatctgaccaccttgagctagagggcaaccagatctacgcggttgctaggaaaccaccacgacaatggtggaggcaccgatggccagatccatgcgccacgatgatgaaggcaaccaccaccagtgtcacggctccttccccatgctctggcaagaggatattttatggatttctttgttgattttattggttttctcctaatcttgcttgttgacattggttatcccttcgatgctgcaatggatagctaatgcttggatagtagatgatcatttgcgataaactttgtgattcactctgtgattttgatgttgaaaaaaaattgtgattgattgataacaatttaaggctcgaacgcgaggtttttgtgctactcgatgcatcggttgattcgagccgatacattgagctggtttttttttattcctgaaaccttaaaggtgttcttaccgagtgtcggttagaaaatctagcacccatcagtttttcagtagtagtgtgtgcagatagcattaatcatatatgagtatatcccagg

SEQ ID NO: 1737 - DNA, 1501 bp, Oryza sativa
atttcgcgctgacatgccttggagcgttgcaccacctaggctttgggacttccttacagatttaatttttattaaattctccatgattaagtcaactctctggaatattctcggatttttcagagctcaattcctaaatgatacaaagagcagttcagtaattatttgatcattaatgatctaattaaaatcctaaatatataaattgttgtttaattagaattgatcttaaaagcttaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaactgaaaaaggtttttaaaagtctcttttggctttgggccgaaagccggcccaaaacctctctctttctctctccctccccggcccagtcggcccagtccgccgcgccccttcctcccctctctcagccgctgacaggtgggtcccacctgtcggacccgtcttcctcctccagccgtcgcccggccgaaccctagccgagctgcgctgccgttgcccttccaaattccatcgcccctctctatttccggtcaaattgattgagggcaaatgatccttgagatctcctcttccttttctcttttggaaacatcggctaattttctttggaaaccggtggatttgagttggattcggattcatctctctcctctaaccctaacctttccttcgcgtcgccggtcgccgtgggcctccgtcgccgctcgctagcccctttaaaagcacccccgagctctcctctatccaccgccacctttgccttagcccgccgtcgcgtctagcgccgcctccgcgtagccctagccgtcgccgtcgttgccgtcggttcagccgcgccgcgctgccgttgcagccgccgtcgtcggtcgccgtcgccaccatcgggatcgtgaggtcgtcgccgtccccgtccaccgcttcgccgccgccgaagaccgccggagcaccgccgtcaccgtcgacccgaagaccgccgccgcttcttcctcgtcgccggcgccgtccgttgctcttccgccgtggttttggtcaccggtgagttcgccgtgttgtcctctacccgttggtgtcctccgtttgcgtcgttgtgccgtcgttcgccgacgagcgcgcgaggccgagccgtcgccggtgatgaagtcatcgctgacgtcaccgctgacgtcatcgtcgccttgtcccgtgaaccgcggtagatcaagttgatctcggccaccggttttggatagaatcgatctcggccgttcgtttccgtgagcggccgccgtgcacccggttcaccgcaaaccctagccgctgacgcaataattcccttttccttttcaaaaataattcattattgcgtcataattcaattaaaatctatataaaggttt

SEQ ID NO: 1738 - DNA, 1501 bp, Oryza sativa
aacagacggtcaaatgttacaattgaccaacaagtgaaacattaagttatatatggtgaaacaaaaaaaaaatagcaactgaaacatttaaatattttatgaaacatggtgaagatacacgttgaaacatgtcgcagtcacatatgaaacaacatgtattaactgactgaaacatatgctttcttttatcaaaaataatcatgcgatatcttgttctaaagatttaattacaacgaatacaacggtacgatcagatcatagattggataagtaatttaagagaaaaattattttgaagcttgctgaaataaagcatgtatgtatggatgaggtggagagagaggagagagaatagtagcaggtagtttcaagaattttgtgaaacatactgaagacacatattgaatcatatcactattacgtatgaaacatttagttttaacggtttgaaacacttgtttttcttttgacataatcagaaaattaccgagcaaaaaagaagtggtaattctaaagagtactttcgtccctttaactatttttttcttttgtgagatgagaaatttcagaaactcttttagctttttcatgtgaattgtttatcatgctatgttttactatattcagcgtatgcgtcgcgtactgatatagcgtcctcctacctggcaggagttgccatgtataacggggccgtatgccgttgtcttgtgtatatataggcgttagattagtttaggcaaagaccccgaacaaattatcaatctactacttatcttctactttttagttcttttctatttcatattttattttcatggctgagttctactttttagttcttttctatcagccctagaatttggttaatttttaccgttgttcaccagaaaacggtcatgcttctgtacgaaagcgagaaggttatccttttctaggttgcttagaaactagtcgttcgttgtcacgtaaatatgatatttaccttctttgctaatttgcttgtaaattagtcgcttaatttcgtgaaagtgaattaatctagaaatcggttctgctagccggttttgatctaacgattttggcgactctattgtttgcaccgcaaatcgttaggtgattctatgttgaccatgaaaaagtatcaacacactgttagagtggagactttaatggagaggttattggattgaaaggtaaatttgtctctgagtctctcttttggtaaactaaccaactggaatatttagagagtcggatctagagaagagatgtggacctatgaaggaacgtttggaacaatttactcagatttgatagaatatcaggcgactgatgtaattaggcccgtcacaaccgcagaactgccttgctagctacttgatccctgcccccttgttcatttcaatttcaaaaggagcttgattcagcagctgaaaaactcagaaaattataggcctgcatttggatgaagttactggttaaatatctaaattcaaaattc

SEQ ID NO: 1739 - DNA, 1501 bp, Oryza sativa
cattttattcgcttattaattagagtaataattgtactctattatcaatttgttattgtgtgcctcggctgattcctggacgagggttcacacacatgtaagcgtttggaattttggatagaaattccgggcgtgacactttgcggggggcatcccacttgaaggcgcgcggcggcggctctccttctctccgtccctctccccccactggcagcgcacagccgcccctcctcctttccgccatcgcatccagcacctccacctccaggccagtggatccactgccacgagctcgggagcagcctgatctggcctccatgagctcgggggcggccaaatccgcacctccgttgctccctcgacttccaccttgccatgggctgctggtcactgcgagcttgaggccggatctgaccaccttgagctagagggcaaccagatctacgcggttgctaggaaaccaccacgacaatggtggaggcaccgatggccagatccatgcgccacgatgatgaaggcaaccaccaccagtgtcacggctccttccccatgctctggcaagaggatattttatggatttctttgttgattttattggttttctcctaatcttgcttgttgacattggttatcccttcgatgctgcaatggatagctaatgcttggatagtagatgatcatttgcgataaactttgtgattcactctgtgattttgatgttgaaaaaaaattgtgattgattgataacaatttaaggctcgaacgcgaggtttttgtgctactcgatgcatcggttgattcgagccgatacattgagctggtttttttttattcctgaaaccttaaaggtgttcttaccgagtgtcggttagaaaatctagcacccatcagtttttcagtagtagtgtgtgcagatagcattaatcatatatgagtatatcccagggtttcatttaccgcggtaaaccgcgcggttaccgcggttaccgcgcttaccgcgggggtacggtaaggggtaaaccgcggtaaccacgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtatatcctgcggaaggaacttctaattaaaagggctgcagcagtgtagcttcaaaaagtgaatttgccatgcaaggttatcctcatcatatcgatccatagggcaaaagcaattacaccagatcaatataatggtgtcgatcatctcatcaacagtagattccgcgtgcatcacacccacttgtccgcacacaagaagagaccagctaccaagcaatttgcagcggatgctaattcagctggcaagcaatccctccatctatatattggctgcagatgatcagatgatgcgctaaattaatcaatcatatacta

SEQ ID NO: 1740 - DNA, 684 bp, Oryza sativa
caaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggccgatcatcgcatgcggctgtcttaaccagccgcatgcgataatggatcttcgcatgcggctaatcaacccgccccgggggggcggtttttgcaggcgccgccacaagcggcccgcatggaacctaccgatcccctcgtacagaaaaacgatttttgtagtagtgtataacttatgacgcattacgcttaggtatatgattctaaagttgttaaaaaccccacccccacccttatgagtttgagcatgaaatttacctaaaattcaatctacagtgtatataaaatttcaattattaagtttttagtttaactcttcactatttttgtaaaaaatgttctagatataacttatgaggcattacgcttaggtatatgattgtaaagttgttaaaatccccacccccacccttatgagtttgagcatgaaatttacttaaaattcaatctacagtgtataaaaaatttcaattattaagtttttagtttaactcttcactatttttgtaaaaaaaatgtt

SEQ ID NO: 1741 - DNA, 1501 bp, Oryza sativa
aagatctaggcaacgcaggtgacaaaaacaactaaaaactaattacgaaatcaaactataagaaaaattaaaatcaacttgttgaactttatgggaaaagctggtcatgtgatagtgagttgtaggtaataagttcaaatccataaaatcaagatatacctctaggatctctcttttctaatatgtgttaggagacgaattcataaaagtgttgtattgcttgtatatttgtgtatgtgcatgtgtaacaataattaccactttggttatggatgaacggtaaaattcaaacaaattttataaaacaaatacatttcagtttgattttattacctgtttaccaagcaatttctagattcctaccggcttgtctgatcaccatgatgactgaggctgtgttctttgctcctagtcccaactcctctcccttgtttctatacaaaagttgcttaaaatatcataatgatccatttttttaaaaaaatagctaatacttatttaatcacgtatcaatagactactcctttttcgtgtggaggagttttgttcccatccacccaaaactaacacagcctgagcagttaagatgactagccccaacgtttggcatattgaagaaaaaagcaaaacgatatatttacaaatgaaaaataatttatgaataaaacttttatctacgtgttcttaatgatctaaaagcaaagaataaaaaataaactacactgagaaaaccccaaactctaaattttaaaatttaaattttggctaataagtataagcataactgtataagcaaaatgatgatgcttgacatttgccatccgtaccgtgatcctccttttactgctcaccaagaacgagttttaacacaaattaagattgatagaaaatgatgtgattgattaagcttataaagttaaaataaaatgtttataataaagtagtataagacggcctcgacctcttggtgacggccttgatggaggcattggaccttgtagtcaactcagtacatggcattttgcggcgagcaacgtcgacgacttgatggaggtttagacaagtcggagtcaaaagaaacggactcgataggcaaaaaggactgccatgattatgattggagtccctggcaaagtttggccgagttcaactaactcacacctaatttctgaacaaggcctacgatttataaaaaactgtatggaactgcactaattccctaatttaaacagatcaactggcctcaatgtatgtttgaaattcatgtgagccagtcaatactgcattttataacagcttcagctatttatataacggaattatttaaagttgacaccaatagaggactagaagagtgcagagtgcataacgctgagaacaagaccatgttttaccagatgctcgctgccattctccaagcacttcttataggtacgtatgctggctgcaacatatgttcaccattattatcatcaccatttttctctttctgaaattgcct

SEQ ID NO: 1742 - DNA, 1501 bp, Oryza sativa
tctttcttacaagaattatagtagctagtcgatctgactgctaaatggtacttgtgtttatatgttcttccgtgcataatcgatgaactaaaaataacgcttacgtattccgaactcctaagcagttcatcttatataaaaaatttctatatatgattttctaatttgcaagtaaatttatattatatgtcgatatcacaaatcattcatcaaccttttagaaaagaaaaacacgactcaaccattcaattatatatcgattgaattgttatatatggaaactatatagtcagattcgtagttaagggtaatttttttaattgcaattaaaaggtatctccaggattgtgaaatgcctgaccttttttctagagtaaaaggtgcacattattggttactcgcttcacttgaaaatattagtatttttagaaacacgtcataaaacgcgcacactcacctgtttatatcacactataaacatttttcttactgatttcaatacatgaaaatcctaacattttcaaaaatattataggtgctcggaggaggaagttaagcaattttaaatttggccatcaatatgatatatagctaaaaggaaatcgttttttactttagtatctttaatttgctaagcaatatagaaatgtttatattttgagacagcagcattagtaacttaatttgcattgatgatcacgttgtcttttctttttctctaccgtaagatctggttgacccgcagcaaatggcgccattgctccctcttatttttatgccctcgctctttgtttttttttttttacagtactttatggaaggttcgcggtaagatgcatatattattggtcgcataaagaaggcgtaggcgcgcgcgtggcctttgaatcatagccacccttagcatgtgcgactcgactcatcacaacatgatatagctagttctagctgtcatccatcttagctagctaacctgcgggtagttagcagccatggcgtcgatcgacgagaggtagacgacgacgatatccatatccatatgcatgcatggacaacgcatataccatggaatagatgggttcgaccaactttaatttgatggctaccttctgtttccattaacctttcatcattccattcgtgcacgcgcccgcatgtacatgttccgctgttttccatcgatccatcaacagcatgcatatgctgcagctgcaccctgtttcagttaattccaatcaccaatgcattgcatatattaatccagatcgaggcacacaagaacagactatagctacctatatctatcttgttatttctacctagaccttaattaactcgttccgttcatccatgatccatctatatatagacgtcacccgtgcctccattcttcacaccaaaaatcatccccaatcttacatcaactacctacttcctacgtagcccagtaactatacattattaaggctaaccagtaactaactaaggcacacgtacgcaa

SEQ ID NO: 1743 - DNA, 1501 bp, Oryza sativa
ctcccggagccatttcacttgattaatcggctcccagagcttttttcattttctcggactcccagagtcctgctgcccagcagcacaacaatctgcttccactcgggaagcctagtctatgatgcccgtagacatcccgaatcacacagattcgcttctgaccactcaggtcatctatctgccacataggctgattctggtaacgattcccacaccacaacaacttttcacaaagcacaagcaatcaaatctacgcaacgggaaccacctcacatccgcccatgaccgtgggcacggctgttcgaacagttagttaacctctgcagaggggtacactttacccacaagacacgaacttgctcccattgccgaacccgtgttcatgacgcacggcggaaaaagggagattcgcgacaagaccttttcctagccaacccagggttacctcatgccacatagaaggatcaaatcctcacataaatataggccattttagttttcacaaatcaaactccaaccacctcgatcggtaattctgcaagcttctcttccttgcttaccaggaagccggtttggctccaaccgaccccgccccggcgttcccaactattggcatgcgaggtttccctgaaccgactagttacttagccagggtgtcccattccaccttgtggttgcactttgattatgctcgatgagtttcccacaggaatcggtccttatatgtgaatacgggacaacgccacgtaggcacggcacccgcatcgcgagttttcacaaactattttattttcaaacacgccgacaccacgtgtcgggttttcaaggcttctcaaacccatttcccaagttttcgacaatcaacggtgtatatgggatatttggtatacgcgctcagagagcacggataccgaagtaccacaagggtggagcgacaaggagtcaaggtagtacagcctacaggaattagtgcgactactaggtaggtccatcggtttggcatgcaaaccgaggccaagcaagttaaacgtgagtggttctaataatgcaagttgcaaacaaaataataatgattttccaattataggagcaattggtcaaagggtgacttgccttgctcaaggttttcacggagcttcacgaatcttcgagaaatccacgattgaagaaaatccggtaaccgcaactatacgcaaacaatcaaaacctaaacaaggaccaaaagaaagaccctatttagacaaattaatagtgccattagatagatctcaattttacagaattattggaagtggaatggggtcaatcggaattacggatcgggagatatggattttctaaggttgaaaggattttctaatcaaaggaaaaggatttaattaaaccctttttgaaaaagaaagaaggaggggcgaatttcagactttctcaggcgcttgggcgcggcccaaaggattttagcggctcggccgagccattgggccggcgcggccacggggag

SEQ ID NO: 1744 - DNA, 1501 bp, Oryza sativa
cttacgagtccttttttgtcgggacattccgatttgctccttggagaataatttggaagagctgggcacctttgaagtgcaagttcttcgtgtgtttggcaattgacaatcgatgttggatggcggattgtcttgacaaacgggaggtgtctcaccccgccgtctgtccgttgtgtgattaagctgaggaatctattcaacacattcttgttaattgtgtctactcctagcaggtttggtctctaattcttcaaaggatagggctgatcttcatctcaccaagccaagataccatccgcttctcgagttggtgggtcaaggctattagaggtttggataaggatagaaaaaaggtctcaaatctctcattatcatggtggcttgggagatttggaatcataggaatgcatgtgtgtttaatgaggctagtcctagtgttatgactgtaattcaaactatggcaaatgagtgtaatctttggtgtttggccggccggagccactaagcttggcgagttccttagaaggtcgattatcccagttgggtaattttgggttgtgtgagccttttttgttttgtaagtagcgtcttttaagtgtttttggggagaatggtgttttagtcttttccccatttttatacctttttaatgaaattatatgcatactcatgcatattaaaaaaacattgcggatattattatttatcgcttgcatttttgctttagtttactctcggtctgtttttatcaagaacttgaaactaatatgaaacaaaagtccctgaattttctggaggggacataattgacttgtatcttgccattcaggttttgtagagccattgattaggaatgtataattgaaatacaccgaaacaagattctcagctcaatttctagttaagttgtagtttcaaattaaaacaacaaaagcctagcataaaattagaatttgtgtaatcggttggtaccaaaccagacaaatgaacgttgtaccgagcactctctgaccactgatgtctgatgctactctgctcatgctccatgtggttcagtgaaggcaccttgtgctagcactccgtggaactccagtgacttttgaaccgaaattcctgtagcctcgcattccaagtatctctaacccattttgtttcatcaaaatttaacaaaacaaaggaaaaaaaagaataaagtttccttgacaatcctgctaaaatcttaattgcatatgcttagctgtcaagtttcttttcaataatggaatcgatccaagctctagatcaaacatttgctatttgccctcacactgagaaaccaagggcctgtttggcacagctccagctccagctccacccctcctggagctggagctcagccaaacagtttcagctccaccaaaactgggagtggagttgggtggagctctctcacaaaatgtactagagttgtggagctgggtttaagcagctccacaactccactccagactcaactcctgga

SEQ ID NO: 1745 - DNA, 1501 bp, Oryza sativa
acctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcgtaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtctccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagattta

SEQ ID NO: 1746 - DNA, 1501 bp, Oryza sativa
agctcccttgaccacctaagtcggtttcctccccgaaaccgacttcccgtgcctataaaaccacagccgagcccctcctctcaacccctcccgctttactctccacgctgccgcgccattgtcgcccctgccctgcagtcgccctcgtcgtccatcgccaaagcaccagggagaccggtgcgtgcgaaggacgcgagaagaggactccgggcgccgtcatcttccccttccccggcccgaggccggagagctcgctcctgcgccgtcggccgctcgtcacagcgctcgtctcggctcggtagtgcctccctccgttctcccttcgcgcttgccctttccctcctttagctcgctcggtagctcggtagccgtcccgaacgcgcgtagacgaagccccaagccccgccgccgcccggcatggcctcgctgccattgccgcccattccagggagccgccgctcgtcgccggcctccctcggggcccctccgtcccatccaaccctgggaacgagttccccgagtcctagagatgctctagctccgacgaatcgaaccctcgtcgtctcatcgtcgtttccccctttgctcgccgccggttgccgccgccgcgattcgccgtcgccggccaccctccggcgaatccgagccgttggctcactctctcttgtcttcctcgtcgttccggtgtgctccccgtcgcctctcgccgtcgcatggtgtcccggtgaaactgccgccgtccgccgtctattctcggccggcctcctccttcctcccgccggcccgcatggcagccatgaaggcgccacgtcggcgccagctcggctgcgaccgggtcaaaagactggtcggccgcctccctccgtcacatctttcatgcgcctggtccacggagagccctagcggctgcacgtgggcccgctgtctcttggtccacccagtgctcaagccgtgagccgcatccacctccctctcccccgcgccccccctcagttgggccgcctccccgtggccgcgccggcccaatggctcggccgagccgctaaaatcctttgggccgcgcccaagcgcctgagaaagtctgaaattcgcccctccttctttctttttcaaaaagggtttaattaaatccttttcctttgattagaaaatcctttcaaccttagaaaatccatatctcccgatccgtaattccgattgaccccattccacttccaataattctgtaaaattgagatctatctaatggcactattaatttgtctaaatagggtctttcttttggtccttgtttaggttttgattgtttgcgtatagttgcggttaccggattttcttcaatcgtggatttctcgaagattcgtgaagctccgtgaaaaccttgagcaaggcaagtcaccctttgaccaattgctcctataattggaaaatcattattattttgtttgcaacttgcattattagaaccactcacgtttaacttgcttggcctcggtttgca

SEQ ID NO: 1747 - DNA, 1501 bp, Oryza sativa
aacagtagtaagaaaacaaatatatatacctcaatcttagccttgaaaagatcataagcaggcccctccttttccagatctagtagttcatgtgcttgcaaagctgatccgcctagtttgcgagagcaaaatccaatcataggttccacttcctcaatgcgctgacggcataaaagttgattttctatactcccatatttcccaagctcctcatatacagccctgtgataaaacaatacatcactcagccatcaatgatctcccaacaattataatgcaaagaagatttagcagtggcgctgattatcaaatatgtacaaacaacaaggagaacaattatggaaaaatatatgcaagaaataatggccaaacttctagaacctaacctggtgttcttgaaatttgtcattgctgcctctatgttcttctcttgctcaaacagcaaggtacctttcatgtatgaagcatatgcctgcaaaacaattttatcaaagaaattatttaatgttagtattgtaagggttattttctcatatggcaatatcaccttaaaatttcttgatttgagttttctcaaaaaaaaaaaaaagggggtatgaaacacacctcagcttccaaagacgtcctggaatctccttttagagaacataaatgtgaaaaaagcgttgcccatttgacagcttttctaaatctacctaacatgtagatacgctgttgtgcatttggaccagcagttttcttttccatcgcatgactccatgctctctcagccatataaaatactatgtgtagaaacctgctctcatatgttgaaattacttcagaatgtaatgatgcaataaatgtctaaaaactacacaaattcaactgtaatgctcaatgccattgtacttcttgatgaagtcattaaaaaaaatgatgtgacatacatatatggcgataataataaatacttttgctgggtgatgggaatagcctgccaaggaacaatcagaggcatcatatgcaattaccaaacaaggagtgcaaacatttagcaaacaataactatgaagcaagattacactgagctcatcactatgcgtttatgacagggcaccaaacggttttaatcatcctcaataaccacccaatttcaccttcttttgtggtgctgccatggtggtggtgtctctatgcgtgtgctctggttttcactaaggaaaaatgatggatataggaacttaagactgtcataggactccaacccaattatcctagacacccaggaggttaacaacttctaccaccaggtcactggtctgtttccctactattgctcttagcagcttaagtaagatagcagtcccaaattggttcactaaatagtttaggtggagcaatatcctgagatctagatggcaagaaggcatcatgctatgaagtatgaaatggtaacttctttcaactttgaaaatgggaagacaacacccggatattgaagtatgaacagagacaccaa

SEQ ID NO: 1748 - DNA, 1501 bp, Oryza sativa
gcttctcggaaagaagaagagtcattgtcgttacaacaaacataatatgaaacagagggagttgaatgatttcacttcacaaattttgcctgtggcaggtatccaccaatttattcctgtccacttcaagtctcaaacttgaagcttaaattttgtcaagtcatctggattctgtgatctacagaaccttttatatactcagaagtgtaggttggaatatgaatgtacatctctttgtattttcctcacttttacccctatttactatgaactttatattgtgttggtggtcattagtttgtgcatccttttttgttttgtgctctttgttaagagaatgttttgtgctctccgagaggtttggttatgctttttgttagacgaatattgtaataaatgaccgtaggatttattccatcgtccaaaaaaattctaatgtttttactgagaactcatgcaactataaatttagtgcacaacgtgtagtgtgaaccacggctcttggttggtgcaagtcacggtgtgaacccttttttctccttcacaaacttggataatggcaatgatcagctaatggtgaccccaattttgttcaataatagtatattcttttgtgacagagacccaattgtttgtcatgtaatttgagtccacatcatcacagtaccctactcttatactcctctatacaaatacaactacaatattcatctatacttttatatgtcatggttgttaacccaaatctcttgtaatgcaaatataacaacgagacaaaaaaagaaaatcacaattttatagtcaactagtaccaaataagccaaaaattacccttatcgtaaagacacatctacatcgtcaaattaagcgaatgacatttcttatcttaattaaatcattctacataaaatcctcgatccgactcaaattattccccatttagacaagatcgtctaagataacctccatttcttcacagaatacactcaaacgtacctccatacatatttgtatacacatacaaattgattatacacaagttcctatagaagatacatataacatgatactactacatctacaaataaagatagagggggagaaagagaaagaactccatcttccatagttccatccaacatccaggcagaggcagagccatccttggcttcccaaaaactctcttttttctcttctcccttcctttgttgcttctcctcctcctccatcgtctcctcttcaccttgcgtcctccccatccaaagctcacaacttgacgacacacgcacacgcgctcccatgtcctgtagcctcctctccatgtcaagccacgccgccccctcgccgtcgcagccgtgagacatccctccgcgccgcggcgagacttcccctgtgtccatgttcgccgctggttcttgattcgttcaggtctcgtgacaaacttgcttctcctcctgatttaatttgtccggtgcgggaagggaagcctccctctgcagca

SEQ ID NO: 1749 - DNA, 1501 bp, Oryza sativa
aagtatcatatgtcttcccttatgtagcaaagaataagaatttgtgctaaaatcagattcaagctgatgactcttcatccattgccatcccaataatatatgacatgatgacataggcactggaaccacatcacactcaacattatctgaaaattcccctaataaaaagggcacttttactcttcttgtaatgctgagattgcaacttgtccactctagtagatatggatctggatgtgaacatgtgaataggttcaatttctccatgagctcaatgctgaccaagttgaccgcgctcaaatcatcaatcgtgaaggcacaagaagcggactgcaccttgcatcttgagtgaaacaacttggtacttctaccatcttcctcatccaaaaagataccactagtgtgcaacatcaacttcatatttcctgccattattagttatacaagaacacaagatatataggctggtggaatatatatgttgaaaacactcaacctcactcttcttaccaatcgaaagttcttacccttccttttagagtaaggggttgatcacaccctgctagtggtagacaacttaaaaggtgatggttaagcgaattcatagtttaggagcaattgcacaggtagtaaatatgtggagcttggagggctaagtgtttgtcctagcaattctgaattcaagatattttctcgttaagtaataatccaagctagaacaaaatgcctagttgctgatcacaagattgtttacacagattttggctcgtgtcctaaatataatttgttaaattataaactaatgtattatctcaaatatagtgcgtacaaaatatatataataagaattttatcgggagacagatggtgaagtaatttaattaaatagcggccacgaaataaatggccatgaaataaaatgtaattcacttatattggacaaaaataatttttggcttaaaataggaatacatatgcgcgttccacataagtagcgtgaacaaatattttccatgcgcttttcgtcggaccggcgaacgctaatacttagctttctcgttgtatccgcatacgaaatttggcctgaaacatatggccatgaagtgggattttctcactgacccgaaattgtcacgccccgaatattttcagaaaaggcgtgcccacgatataaaatagcatacaaaaattaaaatgtaaaccaaaatagatgtttatctggctagtgaaaaatcgtgccccaaatagtcgcgacttaaaataaaaatgcatgccacgtccacgccgctataatggcgtggatacatatacacgcgcatgccaaactaaagagggtcgcgttcgccattagtccagcatttttatctcgatagctagacgtgggctggaggaagccaccgtgataatatgcgaagccaccgtgataatatgcgcgtcaggacgcgacgcgtgtcgcaaaaaataaatttacggcagtaacagcccgctcgataaaaatagt

SEQ ID NO: 1750 - DNA, 1501 bp, Oryza sativa
aaaccacggcggaagggcaacggacagcgccggcgacgaggaagaagcggcggcggagatcgggttgacggcggcgacggtgctccagcggtcttcggcggcgacgaagcggcggacgaggacggcgacgacttggcgaccacgacggcggtcttcccgagcgacggcgacggctggaacggcggcggcgcacggctggagcgacggcggcgacggcggctcgaggttgacggcgctagggtgctacgaacgacgagaggcgaaggcgagggtggcggcgggtagaggagacaccggggagccttttaaaggggctaggaggcgacttccggcgacgagaaggaaaggtcgagctcggagagagaaaagccgatccgattcgacttcgaatccaacactttccaagccgatttagccgatgtttccaaaggggaaaaggtagaggagatcccgaggatcatttcccctctattgattcggccggagatggaaaggagcgacggaattggaaagcagacggcggcggctcgcgctagggtttcgggcggcggcggcggcgcggggaagacgaacctgataggtaggacccacctgtcagcggcagagagagagaagagcggcggctcggcggactgggccggactgggccgagggaaagagaaagagagaggttttgggccggctttcggcccaaagccaaaagaagacttttaaaaacctttttcaatttaaattattcatgaaatgcaattccatttattaaaaatactttcttagctcaaataaatcccagaaaaatctaggaattatagaattaagcatagtatttaacaaaattttatctagcccaattttatattgagatttagcaaattaaaattagatcttctcatctaggcttttaaaatcatttctaataattccttttaaacaacaatttataatttaaggatttttaaacaagaaaagctcttaacaattataattagatcattattgatcaaataattactgaactgttctttgtatcatttaggaattgagctccgaaaaatccgagaatatttcagagagttgacttaatcatggagaatttaataaaaattaaatccatccatgctttatatttaggaaattttatttcccacttttaacttcacttgtaaattaaagaacatttaacataaattctattattagtttatttattaaataatttataaatcctgaaacaaaaatcaggatgtgacatggtatcagagccatacgactgtaggaaaagaccaaaaggcgccccaccccttttttttctaagttggccaagggagaaattcccatttagtaatactttcaaaaataaaaacgttatgtttacaaaactctgtacgattttcatcttactctaaactattttcttcacaaaacgagttttactcttaactgaccttgggtttttcttaaaattagatggcagatcaggattcacccgctacctgggaga

SEQ ID NO: 1751 - DNA, 1501 bp, Oryza sativa
gacgggttcaacgtggcggtggtggtgacgccgcacgggttcgagcaggggcggctgtgcccgtcgctcgggtgcgccgtggacctcgccgcggactgccccggcgacgggggcaggggggggtgcatggcggcggggcaggcggaggcgttcaaggcgaggtgcccggacacgaggacgacgccgacggacgtggaggtgacgccgcagcggtgcatccagccagccgagctcaaggtcgtcttctgcccgccggacaacacctcctccactcactgactgattcattgatggttagcaaggaggagtagtgattagtcgcaaataataatcctaattagcacgtagtaagaggcttcatgcgctgatggtgattgcattaagaaggcgcgcgtctgttcgtcgccggtagctacacttgttactgttagaaatgcatgctgtacgtgtgattcattcaataaatggtttaactccgaatctgccagttcagacctcaatccgatttatttgaaccatcaccaaattgaattccactagctacatagctaggccacaaacaatgcatggtacaaattcgtaaggttattattaatctgtgtggctgaggattgagatgtagtacaattagtatatggcatctgcaatatgctacgcatgtctctctccatcagtgccctgcttaattggtagctcaggcaaaataattatatttaccaccattgccgtcagggctccgatgcatatatgcttcattttcatttcgactttataagagtatattttactttaagggatactccttccaatttcataattcttaatgctttagataatgacaaggttttcaaaatatatctttgactatgttttttctattataacatgtacaataaattaaatatattttagctttagtaatttgtaagataaatctatatatatatatatatatatatgttgttctagtgaattagaaataaatattttttatattaatagttaaaattataaaagtttgatcccaatcttatcgaaaacgtcaagaattatgaagccggaggaaggattgagatatgattgattattatatcatatactctaatagacttgctctcgttttccctaatgctagtgctacgtccgtggtttacaacgaaattgcgaggaacatcaatgaatagttgtatgggttcaatttttatctatgtttttctgcgggccgggttggtttgtttcctacgcgaccaggaaagtaggatggtggaagaaaagatgtccgcttttaaagtagtggagcaacgaagcactatggagtatataggtccatttttaatataaatcaatatggagtatataggtagttagtggtagtaagtagttaaccttatgacgaagtaatcaccaaattaaggccatgcatggacgtctcctcttcctcttcgtatatatataccacacgacagcggttgcatccatccatcgatcagaggaggcatca

SEQ ID NO: 1752 - DNA, 1053 bp, Oryza sativa
ctttacccacagacccgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtctcattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacgatgtatgtgggatatttggtatacgcgctcagagagcacgaataccgaggtaccacaagggtggagcgacaaggaaacagggtagtacgacctacggaaattagtgcgactactgggtaggtccgtcggtttggcacgcaaaccgaggccaagcaagttaagtgtgattctaataatgcaagttgcaaataaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagacctattagtagtgccattaaataggtctcaattttacggaattactggaagtggaacggaggcgatcggagctacggatcgagggatatgaattttggaggtctaaatggattttctggacaaggaaaaggaattattaattcccttggaaaagaaaaggaaggaggga

SEQ ID NO: 1753 - DNA, 514 bp, Oryza sativa
caccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatggcctatacttacgtgaggatttgatccttctatgtggcatgaggtaaccttgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcataga

SEQ ID NO: 1754 - DNA, 1501 bp, Oryza sativa
agtaaaatcatattaaaaatatataattttatatgggtgctagccgcgcaattgcgtgggccacccagctagttatattattaaaacagctttgaaagaaggcatcacattcgctgtgggggttagaaattcccacattaatcggagaaaaagaaaaggagagtccaaatagaaatacaatctaaaaatagctgaaattcggaattaaaaataagcaatattgaaagaagtttccatataagaacccaatacgagatgaatcaaaattcaaaataaaaataaaataaaatccaaaattagaaaagaaaaggatagtccaagtaggaatacaattttaaaatagctaaaattcggaattaaaaataaggaatactaaaagaagggtctatataagaacccaatacgagattaattaaaattgggaataaaaataaaaataaaatccaaaattagcaaaaaaaaaagttcaactaggaatacaatttaaaattagctaaaattcggaattaaaaataagcaatattgaaagaagaatccatataacaacccaatatgagattaattaaaattcagaataaaaataaaataatatccaaaattagaaaaaaataaaagagagttcaagtagaaataaaattttgaaacaactgaaataagagttcaactagaaatacaatttaaaattagctgaaattcggaattaaaaataagcaatattgaaagaataatccatataagaacccaatacgagattaattaaaactcagaataaaaaataaaataatgtccaaaattagaaaaactaaaagagagttcaagtaggaatacagttttgaaacaactgaaattgaaaataaaaaataaaaatatttaaagaacacaataagatatgaattaattttttttaaaaaaaactaaattctgaaattagaaaaagaaaaataagatttcaattaggaatacaatttataaatagctaaaatttgtgataaaaaaatattgaaagaaaagaccatctaaaacacatgacgagataaattaagtaacatgcccgatgatagttgatacgacatataaaaactgttaataaaacacataatagaatcgtaatgacgattaaaagagggacggcaggcaggccatgaagcaaatgagcaaaaaaaaataaatcccattgataatcatattcgatttttaaaatctcaataacaataaaaaggagaagcagtgggcgtggtgtataggagtgtagttgcagagccgccgacggttgacgagacttttagaaaataaaaaaataattccaacgatagttatgtttgatttttagaatcacaatgacaataaagagtaggcggcggacgagccgtagaggagcatagtggcatcatttgacgagataataaactctaaaaactagaaggtccaatttttaaaggttcggaacttctaaaaagtaaaaataaaacaatgataatcatgttcgattttaaaatctcaa

SEQ ID NO: 1755 - DNA, 1501 bp, Oryza sativa
agcatgttataatgctgcttattgatcactaccagaacatgtaaattaatcgcttcaccttgttgcaccagatttctgggaggaggaattgtttcctgaacttattaagcccttgccagatgatggtcagtcattgctttcagttttgctagctattagtatcacatgatcattatttactcttcaccttgttgcaccagaattcacgcagcttttgaaaaaggatctaaagtctcgtaattatcccatgccaatcaggttttggggtgagtcattgctttcacttttgctggttacttttgttgcacattttgacggtattttctagcaaactcaactgtagttttatgtttttttaaccagggggtatgcgcttgaaaaatacttttgaagaggaatttgctgaagatacatggtgcaaactgagtaaaaaggttgctttaaatacatcccaaagtgttgtctcacttgcttcgttcaaaggtgagattacaatgttatatgatctttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacgcgcgcgctcgctcgcctggctcctggcaaggcaggcggcgcgcgtgcacgacgtacgcgtcgaatggtccgaaaaattggctcctcacccttgcgcagatgcagcctccttttgcagtttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttacta

SEQ ID NO: 1756 - DNA, 1501 bp, Oryza sativa
  unsure (1)..(1501): unsure at all n locations
agtggacggtctggatgagtataatgacagtgtttgacgggacttctagaaattataaaaaagatgtccaacaggataataaactctaaaacttatagtttttagatccaatttttaaagattccaaggagaatgaatagaaaacagtggtagatcgagcaagcaaataaataataatatgacagaagtaaggggtagcaactgttgtaactttagaaactaaagaaattagaaacatgaggataataaggtttagtatttaaaaatcttaagacaacgagataactatttaataaatttgaagtaaaatcatattaaaaatatataattntatatgggtgctagccgcgcaattgcgtgggccacccagctagttatattattaaaacagctttgaaagaaggcatcacattcgctgtgggggttagaaattcccacattaatcggagaaaaagaaaaggagagtccaaatagaaatacaatctaaaaatagctgaaattcggaattaaaaataagcaatattgaaagaagaatccatataacaacccaatatgagattaattaaaattcagaataaaaataaaataatatccaaaattagaaaaaaataaaagagagttcaagtagaaataaaattttgaaacaactgaaataagagttcaactagaaatacaatttaaaattagctgaaattcggaattaaaaataagcaatattgaaagaataatccatataagaacccaatacgagattaattaaaactcagaataaaaaataaaataatgtccaaaattagaaaaactaaaagagagttcaagtaggaatacagttttgaaacaactgaaattgaaaataaaaaataaaaatatttaaagaacacaataagatatgaattaattttttttaaaaaaaactaaattctgaaattagaaaaagaaaaataagatttcaattaggaatacaatttataaatagctaaaatttgtgataaaaaaatattgaaagaaaagaccatctaaaacacatgacgagataaattaagtaacatgcccgatgatagttgatacgacatataaaaactgttaataaaacacataatagaatcgtaatgacgattaaaagagggacggcaggcaggccatgaagcaaatgagcaaaaaaaaataaatcccattgataatcatattcgatttttaaaatctcaataacaataaaaaggagaagcagtgggcgtggtgtataggagtgtagttgcagagccgccgacggttgacgagacttttagaaaataaaaaaataattccaacgatagttatgtttgatttttagaatcacaatgacaataaagagtaggcggcggacgagccgtagaggagcatagtggcatcatttgacgagataataaactctaaaaactagaaggtccaatttttaaaggttcggaacttctaaaaagtaaaaataaaacaatgataatcatgttcgattttaaaatctcaa

SEQ ID NO: 1757 - DNA, 1501 bp, Oryza sativa
attctcagccaatcaaccatcttttttcattcacttaagaaatagtttttttcattttcccccttttccccctttttcttattatcaactcttttactatttcagttttttcttacgcgtcaaatatatttaacactacgaaactaacttaggtgaatgttgggactgtcttaatcctggctaaagtccacaagcatacaaacgtaggagctttagtcagacgcatgactgtcacgtattggcacacgtagcaccaccgataccaactgcagttgtctacttgcccacctggcgttgccaagctggtgggagccatctccattgctgccattccaattctggctgtcctggctggactgatgcgccatgtcaacattcaaattcaagtgcttgtccatttacataaccttttcttttctgtctagggggactttagtacgtgtgacagttaataggggagcatatctgtatgtatcagatacatgcatgctccagaatttctcttcagagtagaagaaagaaaaggaaaagaacaaaatgatagagcatggcacaaaagataccctttttaaaaataggagtatccttttgactaaaagttcttctagaaaaattcggaattagtgagtgatcagtgtcagtgttaagattcagtaaggcccattaacaggacggccactagtgtttagtgggccagtgaggtgccgctgtgcaggcccactagacagaaccaattcccaattttgggttgtaatagtagccgaaatctagaagataccgaatctggtatggctgtaagctaataatggtcagtaaggaccagaagagggatatgtacaatgtataaaacaaaactcattttttctgtcgctgttcgattagtttgctagcaatgcagttgcttgctagctggtggatggtagagttcaaaactgccaaacatgaaatagccgcagaatttaagtttggagtttggactaaatatactccaataataatagctagtacatgtagtgtgcttttaagataggaggtttctaaggatccctgcatatgatagcaatgaggtaccaggtctaataatttttttttgaaagaaatcaatacgatattgtgctatttcattgaatgtaaagataaaaaatacaacctctaggtgtaaggaaaaatactgtacatggctacacaacgcctatggttgatttgagagaaattctccaagccacttgctcctgccatagcctaagtttgcctcctttatttttgccataaggctttttttttaatggaatcagcacgagattgtgctatttcattaaatatagcgggagaaaagtacaacccctaagagaagaaagaaaaaaagctatacataactatacgtgtggagggataaactcgctaagttttttaagctccggcaagaacccaagttcgtgtttcttcctttattttggccaacaatttttgccataaggcaaggagccacagcctccttttg

SEQ ID NO: 1758 - DNA, 1501 bp, Oryza sativa
agtggtgggagcaaagtgaaccgaacagttaggaggcaggggtgtctctagtggcggagagccatcaaagatgagaaagatagcaggacgggggcacataatgctgcggcggcttagggagatggattgatggtggaggtgtggtcgggtgagaaggctaggagttggtgctagcttggatttggaattcgtcagagagagagagagcgcgtgagggagttcgctagagaaaggtggagggagagcttgctagtgggagaccacttgcctacactcgacctacccgatgagaaagaggaaccgtctatgcacttgattgttctggtcgacaagggaagataagaggaggaaagggaagaagagaaagtgggctaggctagcaacgatgcatgtaggtttgtcatcttgcagaattttttagttttaattttttttattaagcgaaaggggttgtagcctagtagtaaagtactcaagtagtacttgtatgtcctaggttcgacttcctaagaaaacgaatttaagatttgaatatttcaaatagaggcagctccattcgtcctaagagggagatagagggacgagcctaccatttttcgagtggtgctctaggtggaacgatttaaatacagatagccccattcgtcctgagagggagacagagggacgagcctaccttttttgagtggcgctctaggtggagcaaaaatcgttctataggagaatagtaagggtggcgcttgcaaaagtgacaggcctaaacggatggtcgttaacgtgagctatcaacaatctatcacgtcacactatgaacaatctgccacgtcacacaaaacaccctctgggaggacggggcgtgaggggttatgagtatatttgtatttttttttccaaaccgaaatttttttaaaaaaaattataatattttttatgggaaaacattttaggctctgtttgttccccatggttcccaactccccaccttgtttcccacgcgcacgcttttcaaactactaaacgatatgtttttgcaaaaagtttctatacgaaagttgcttaaaaatcatattaatctatttttttaaaaaaatagctaatatttaattaatcacgcgttaatgcgaacatcgttttacgtgccggggaggagggatcccaacccctcccgaacagagccttaatattcatcttgtattcgctggttgatgggccgaacaaacttgtgcgtaacctgaccgtatccaattttggccggcccatcgtgtccgctatcttctaacaggccggcctctccccgccgcctccgccgcctccgctcctccttggcatgcccacgtgcctgcctcctccgccgcgcgccgccatcgccgccgtcctcacctcgctactaccaccgccaccgggcgcctccgcgtccctcgctcccgccggccccgccgccgccgtcgcccggcagatccgccggaacgacgggcaccacccgggggcagcggtagggatg

SEQ ID NO: 1759 - DNA, 1501 bp, Oryza sativa
ctcttgtctactgtccgatccaacgcctcccttccattcatggcatctccaaaaaaaaaaaaaagcaacaaaatatattctctttctagagtcatagtccgatccgacctgttcgatctcggaaactttttaaattactacttttggatcataaatcgggttggatagttgggcacctggcccaaccaccaactgccaccttatgctgcttctcccctcggctcgacacgttacgcgcggtccaacgttttcgcccggaaaaaaaaagctctcatgccgtccttgtgacctgccgcggcgccggctgccgacaccgcacgcatcggcgagcgaatcgctcgctcgatcgcgcgcacgccgcgtgcgatacgctttttcgcgctcgcgctccggcgctcggcgagcgcgcaccgagaccacgaccatcgcggctagcttttttttacagtgtgggtgggttaatcgcggggcgcgatcgagtgatgatggaagcgtacgtgatgttttcgtgtgtgtttttgttgcacgcaggtcagggagggggaggtgcggcggcgagacggcgtcgtcggcgggggcggacccggacgcggtggcgcagagctactggcacgtccacgcgcaggacaggagcgcgtggacgcaggagatggacatccggtcgccgtcgctcatgtagtcggccggccgatcggggaggtggagaggcatgcactgtagctccggcggcggaatctctactgttgccaaggaaggaaagaagaaaaaaagaaaattcattgatcgtgtcatcgtgtggtgtggtgtgcgtgtgcgcggctgcggaccgggcatcgtgtccccgttccgcgtcgcatgtcttctttttttcgcgctgcgtgcgcgcgccgcttggcgcttcgcgcgcctaatttttagtgtgtggttgatgcatcatccgtccgccgtccatcggcagcatccagcagccggtgcacggggaagttgccgacgacggcgacctgcaaaaattcatgtgatttttctgtacggttttctataaatgtatagtagtattatgtctcgttttatgtggttttctgtacggttttctataaatgtatagtgtgtctcgttttatgcatggttacctgcacttgattgcatgaacagtgatgggatggccccttgagaattaattaggtagcgcatagcaatcgagaattcgagacgctcttttgtgggaaagcatggcaaatggcactggcccagacagcccggggccgcagttgtgtcaagtggttagccagtacagggaggggatcaagtggcctttcatgtgagaagagataggccgatccaccggctgtttcatctgattgaaatgatttcggtgtgacggtgtcccagcaaatgtggacgtctactcagtttctattccaatgaaaaagaaaacgagaattggagagagacgtcccttcaaacattgttgaagaaaaaattgtgagcatgttagtgattg

SEQ ID NO: 1760 - DNA, 1137 bp, Oryza sativa
ttggaggacctaaacgagtgatctacaagtttagggaccgggatgacactgtcgaacaagtttgaggacctgaacggtcaatttgcgagtttagggaccgggatgacacaacgatacaagtttaaggaccggtgatgaactttactaaaaaaaatgacatatatatagaaacagcgggcggtcataatatgcgtatactcatccctataaacgcacacgcacggatacactactcctataagcacctccaaaaaactggacctatatcttgagatcaatgaaattatcacgggacgcctcgctgaagactaggccaacatatcttgatatcaacaaagtcatcacagggtgtctcattgtcaacaatacgtcgtctaccattaaaaaaataattagccataaatacaagcttagaatataggacttgaattaggatgggctaattttatcacaagtaaactaactagtttagctaacctcacttcgcaaacttaacatattttaatgtaaattccatatctaaatataacaacttttaacccttacgatttgtccctaaatataacaacttctccaccaacattctctttccaaccaatcacagccctccaccattcacttttcccacatacctccattagtcatccaatcacaaccctctaccattcactctacttacttttttaataactgtgtccaactctaaaacttattatattttgggatggagggagtacaaacgatagttaaacaatcacatggtgaaaaacaaattaactgaaacagaaagaatataatgctgtacttttagcaaaacttttgtttctctcacatgtactccaacttaggagtaaataagtgagtttggtatagggtttgaagcactaccaaatatcggtagtgtcaaaaatttagataagtttttggcactattagtttgtggttaggataaagaatttcgggttgaagcatttttgaaatattggtggtgtcaaaatttagataagttttttttacactattaatttgtgggttgctatggtagatttgactgcactctataagtttagccgaacatgactccgttaatccagctggctattataaactactagcattccatacatcttgtcgacg

SEQ ID NO: 1761 - DNA, 1501 bp, Oryza sativa
ccatttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctacaaggcagattggcggacctacctaatttgtcgcatttgatccttcctttgttaattgctataccatgtccccttgtaaccacccagttgcgcctcgatactcgtgcactctgtgcaagtatcgacggtcgccttcaaccttaaaatctgagtaacaacttgggtaaaactggagttttacaaaagacttggaaaacccgacacctgggtcggtgcctccgaaccaaatgaatttccaaaaccgcggaccggggatcctaccgggtgtacggtttcccgctcttgcacttaaggaccgtttccttggaatttcatccgaacataagacaagtacgaccacatgggtggaatgggacgcccctggctgagtaaattgctaatcgggggagctttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggacatgggcggatctgaggtgattcctagcgtagttttgtttgtctactgcttgtgaaattgctgttgtgaaaaggggttcgatgtttgaaaaatctgcagctgatgggatcagctaggcccgagtggccgtttgaaaagttgttggcccgggtggccgtttgaaaagttgttggcccgggtggccgtttaaaaagctgttggccgggtgccaactttgttgcaatcctaaagattgacacattgcacatactccgaccggacgagacgcactgtctcatccgtgtcgtttgagaagcactcacttagttgttttcagaaaagagttcaaataaaatcaattgcaaaaacaacagccttcccttgaagcctgcattaaacacttatttcccctggcttgctgagtacccccgtactcactcttgctctatataaatatccccccccagttgctgaagaagatgaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgtccgcagcccaacatgactgtacttc

SEQ ID NO: 1762 - DNA, 1501 bp, Oryza sativa
gccgagccgccgacaagcaggtcccactcgggaccacgcgaggtggacccggcccaccggttccccctccctctcccccctccccccgcgcgtgcctttgggccgccttctcgggccggccggcccattagctcggccaggccgcgccccttctctcgggccgcgccctagccgcccgagggaagtctattccccctccctctttcatttctttttccaaaagggtttaattaaatccttttcctttagacaaaaatccaataatcttataaattcaatatcttctcaaccgtgtgtccgtttgactctgttcaaattcaaaaaatcctcaaatctcgagatctatctaatggcacgcttagaggtcaataatagggctttattttcgccgtttgttgagttgtcccgtttcacgtgtagtttcggtgcccgaagacccgcggtgcgaggatttcgaggatcaagctcaagatctcgagcaaggcaagtcacctttgatcatcttgcacctataatttaaatctaagtatttcttttccgcaaatattgcatgaataggtttatcacacgtaatttggccgtggcttgcgagatagcctaccggccccaatcctaaattgctgcaattaccctgcgtgaattattgaatacttaaaactcctttgtcgactgttgtgcttcgatgcacgggccttcaggcacgggcatcggaacacctcccctcaaattaaaacatccaacgatgggtaaaacttggggttttacaaaagacttggaaaacccgacacctgggtcggtgcttgcgaactaaaatgaatttccaaaatcgcggaccagaagacgtaccgggagtacggtttcccgctcttgcacttaaggaccgtttccttggaatttcatccgaacatatgacaagtgcgaccacatgggtgtaatgggacgcccatgtctgagtaattagctaatcgggggggggcatgatgccaagagacgtggattcaacggggtggtgccggggagaacccccgggtttcctggcacagtatggtctgggacctaacctggtgttggtctgggacccctctcgttggcatatggtgaacctgtgtcagctttcgaaatgccttgtcatgaaagcctcaaggtctctagatgtcacgccccgaactagtcccgaccggaactagcccgtgacgctccaaattaacctgttaatcgataccagtcccaggaaacagtgctggtatcacagggagacagagtatcatagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggg

SEQ ID NO: 1763 - DNA, 1501 bp, Oryza sativa
cagcagcaaagcaatccgcttccactcaggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctattcgaacagttagttaacctctgcagaggggtacactttacccacaagacccgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtctcattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacgatgtatgtgggatatttggtatacgtgctcagagagcacgaataccgaggtaccacaagggtggagcgacaaagaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaatttacggaattattgcaagtggaacggagtcaatcggacgagcggttggggagatatggatttcctaagattatttggattttctatctaaaggaaaaggatttatcaaatcccttggaaaagaaaaggaaggagggatgtcatttagacttactcaggcggcttaggctcggcccaaggggtcatgcgcagcgcggtcaggccattgggccagcgcgggcgcgggtggtcagcccattaggggcgcggggagagagaggccgacgcgggtggacgcggtccaccgcgcgggacccacatggcggtggttgggttcacggtgggg

SEQ ID NO: 1764 - DNA, 1501 bp, Oryza sativa
gcacatcatgattttcatgtttcaaaattgccagcatgttcttatccatttcttgccagaacattgtggtaaatctaggaaccttcttgtttcacatgtttcttaaagacgatggtgatatggccacttatgcgttctgtcttagagaatacagatttttgtcaagtatatatacgttccagtgagcatgttactcatgccaagacaccattgcttaactaaaactgatcatctctgaaagttccaaaatattatgttaaaagaaaattatgtcaaaaagtcccaaaatacccgttggattcttttttcttctgtgcctctccccaattgacaatggcaatatattggacccaattatgaaactactatttattttataccaacaagccaaatacatcaagctacaatgtattgatgtagtggatgtctggtagctggttattgaccttacaataaacacttcaagtagaagttgcgcttcctgctgtcagcttatttttcagaaaacagtccctctgtcatcgtagcaattgcaagacattgacaaacttaaattgagcaaagactatcgaaaaacaatcgaatgggacataaaccaaccatgatttgatcaaaggtatgggcaattctgatgccgttgataaggatgacagcgtgtcttgtggatcttgctactaattagcaattagtacacagaagctgaatgatttccattataaaaaaatagttagtactcacattgctgcaaatgttagataattcaatttcggtataacacttcattgcatgctgccctacagttattcaattgcattatattttcccttgaataagaattgcagtgctgagagtaggtttactatgattttgcctgacagataacaaaattcaagaaagaacagcaaacattttactatctctgattgaatcatgtccatcacaactaccttacagtccagacctgaaaatgcaggtgtatatgcaacaagttttctcatcttctctctaggaattcagcatgatgggactgcatccaggtaaggaggccatcagacctgcccctattcaaattattgcagacataatcttaattctcagattaccccgtgttccacgactccaattcaccaatcaaccaatcacttcaattgaacacaccccaccccaacccccggggctaactcagcatcatgtgctggcaactcgtttattttcttttatcctcctttccatttcaacagggaactaaattagattgatccatacgtacatgtctgcacatgtgtagactactgatgaacatttcctggttattgaaataccaccattgcccataattggcttcccagacacaaacttctttggtataaagatcgatcatccacaggaaggagagagcaagcttacagctcacagcaatcagctaagccagtagccaatcctcactcactactcatcttctcttcccatctttgttgcttgcattcagagatcatccaat

SEQ ID NO: 1765 - DNA, 1501 bp, Oryza sativa
cttcgtcatttgtagcgttgggaacgccgacgccccgtgggagctcaagggcacgcccagcgcgcggccttggcatcgagctcgtgttcctgccgccatggaccatctcgagtcgacctgcctcgccaacacatttaactcccctccaggtccaaaacgccctaaatagccccaagatccatgcagcgaggtgggagatcagcgtcatctttcccggctatgactgagctccgccccgcacgatcctgtcgacccagtgagtttcgatatgtttccttccacctggagcaacctggaccacccttgacgtcgtgcatatgatggatgtccatacatctaaccgatggtgccgttcgccattgccctgttgctgcgagactagtccaccggcgctcgagctaccctgacctcgccggacctgtctcggagctcggtaagcttccttggggtccgtgtttgctcctgcatgcattgccttgctcactccacagacgtagccatgcaagcatgttcaacccgactacggccaccgcaaatcaaagtcgctagcgagcctccagccaaatccgacgacaaaaccaccaccggagagttcgccttttactcctctgtgttttctcttttgggaccaaaccgagtcgcgccgccgttcgccgccggcgccggcgagaagcactggtgaccaagccagcccatgcctcatctggtctgggcagctgacaggtgggcccgaccaggttggaatagtaaaagatgagaatatgataaaatggtttattctataactgaagtaagtttaaacttcaaaaattcataactgattcattttgaatccttatttgagtgaacaatttttttagaaccagtgaaaaatgctctttgtactaaaaaattattgaagagatgcatgtttgaatctattctataccattgagtttgtccgagtttaacaattttacactaacattgtctctatctataatatctataatatgtcaacgacttcatcaattgttctacaatatgccactggatcgaaccttcttttcaaaaatacccaaaatacatggtcatacaagattagcaattgatttatctcattagaagtttcaaaaaaatatgaaaattttcatgtagcctccttacacaacatggacgtttgtattcaagtttcaagtttttttgcatttctacttttttataaaatataaattatctattatatgctatataaaatacttaatataaatcatctttcatacactacataaaatatttgtgtattatcttttgtgtaaccaaactgtctctcatataccacacaaaaatatttcttctaaaaataaatatattagaaaaaacttgaaacttatatacaagtccccatgttatgtaaggaggccacataaaaattttcaaattttttaaacttctaatgagataaattaattgttaacattgtatgtctataaggtattttaggtatttttaataaaagtcc

SEQ ID NO: 1766 - DNA, 1501 bp, Oryza sativa
caccgacctttccttccacctccatctccatctccatgccacttccgacctgtcctgttgctcccgctgccgctcgccgccagctgaagccacccagccacacccccatgctcgccacctagctccattctccgcctccgcgtctcgcgcgccgccctgtgagagagagagagagagtgaagagagagaggaagaagggaagaggagatatgataggtgagtcccaccattttcttaaaaagaaatgttgactggattgggcgagagggtaattcatctggtttaaaagcttagggtgagcaatatctcctcttctggagtaattcggtcgacctcgatagtgaggggataattcgtactttttcctaaatcattccttatttgtgactggttggattttttcttacttacatgacattgttagcggttccacgttaacaactcttttattaatgtcttaattaatattttaatatttactataatcaaagtataacgcacgataaatataaccttagaacttacggcaaactctgtcaaataacatgaacaatgtagtactattctacttacacttgagtagatgttttcttaacaagttggggaaaactatatacatatacatacgtcatcaaataaacctccgtaccaacattttataaagaaaatttagcgttccattccatgtggtttggattaggagtcaaagtggcaatcagggatactggctggtacctaattaagctggcataatgctaattgggattagctagctcaccggcacactccggagatctggcagtaggcggcagcaaccagcagcttctgcacgccctgatattctacgcgacgcccgtgcgtgtcctggaaaggcgacagggcagttgcaaccgtttgcctggctatagccaggacgcattggtcttttctgtttgtacaatcccaaatttgtataatgaactgaattactttacatgaagcaccaatttaacttgaaaataataaaaaaatgtctacattcatttcaactagtgccggatagtttgtacacacgcgtgaccgttaccgaggatgctatagggaaaagatcagatcgccgcagaagcaagaacacactcgagagaagaaaaaaagataacatatggagtgagtacaagagtattagtattaggctcgcaccaacacaaatgagacgtcgagaagatatagaaggatagggatgtcatggtcatgtaaaaagaagtacattcaatttatctctcattaataaggttgtaagatatgacctcactatatggttaaaattcatgcgaaataatgaaatatcatgtagttctatccgtgcatgacatttgactgaaaaacccaaagttcttttttttcattagagtgccatacaaccaatggctcctatgcaattgcagtgcatgcatttagatgcacagccccatcttggtctaaccgtaccgtctccacagtttgccagcctgcaagagagccg

SEQ ID NO: 1767 - DNA, 1501 bp, Oryza sativa
taggaccgcatttaatgatcgacattgttgcaaaataaaacctaaattgtttggctttccttccactttaatctttgctaaaaggcgataagggtgcttatatttatgagtggagggagtagaaatctagtgaagtttagtattcatcactaattacgtcactttgagcgtgggttaaggtagaggggatggcagggtgcacacatgtgcaagatgtacacacaagtgtgtgttaaataatactactatatatatatatatatatatatatatatatatatgaaattaaaattgggagagctcgtggaagtggaagtatccatggaactcgatggaggcatacctgcgtaattcaccttgaagtgtcagctctcttcaagtgatccgcatactttggaattaattgatacgtggatctgcgcctatgtattactccttggagtagtagttattatataggcagattatgatgtcctctctgagaatatatgtggcagctgacagcaagcattggcaagttaacctttattcctttcttgtcaacgcttgtcaatgctttaatgatcatggatcatcatgggtgcatgaggagtagtagcagtagcattgctccgtgcacatatttacggatgcgcttactcttactccctccatcctatctaataaattcaagttttaaaatatttgaccaacaattgatataatatgaattttatttgatgaaaataatatcattggattgatatttgaatttaatttcatatatataattttattgctataaaccttatagtgtatgagaaactataagctaaagaatagttttgatctgtatcgagtttgatcgtgtcttttatattatgttttatattatgagacagagggagtacgacattagtatacattgttggattaattgatcttgtaattggcaatgttcgagctgcagacaaaagatgctaggtgcttcttgaacatcactgctcgtcgtagcacatatgccttacctaatgtcaaagttatactggcactgcgcctcttttatctactcacgggaaagaaaagggccagatgtgcccatgactactatccctgttctaaaatataaataatttctaggttggtatgggtattaataaaagtaaataaaacttattagaaaataattgtgattggttgaaaaggaaaagtatgtgaaaaaaataaatggagaatggttgtgattggttgtaaggaatgatatgtgaagaaatagaacttcatttgataaaaatagctgcattttaaaatagatgtagtggcttctctatgcagtgtggttaagactaatccgtgtctagaggattggttacttaaaaaagaaagtgaaatatggtgggacatgatatatggggccctaaagcgtgaagtgtcgcaaacatctacttaacccactctccatcaccatatatatgcattcgtcctaaaatataagaaaatttgattggatgagacacatcga

SEQ ID NO: 1768 - DNA, 1501 bp, Oryza sativa
gaaatttctatataaatcctttcatggccttagatgttttcaaataaaacaaagtagctagacgccacaatcaaaccaaaagcttgcttgactatgtatttgattctagccacctggtagccagaatattacgattagtttgttaattaattgaagattttgtctccacaatacgattcttgattttaggcgactaagttcgacttttctaaaaaataaagaaagatagacgcctcaataaaatcaaacgtttgcttgaccacgtgtatttgattctaactacactttctgacgtatttgttagcattggtatttggtggtaacccatatcagatggctttcttgaaatatccccgtcaccagaaaaaaaaaagcttgtaggttatttttgaataaataaaagcttttatgtttttttaaagaaaagcttgtaggttttctaagctcatggagtagtattttaccaacttgcactttaaagttttgtaagctcaacgtaacttccaattatatgcacgagtaagttttttatgctcgcggtaatttactagctgcacttgtatgttttataagctcacaataatttactaactatgcactggtaattttctaaagtcaaaaataatttaataactgcactggtaagttttgtaagctcacgatattttactaataactatgcaggttgttttgtaagctcaaggcaacttgctaactgtgcgcatgttaccccactgatttcccctatttgtgcttggatagcttctagaacattgggaattatttccactatatactactccagtagtacacctttgctgagtaattatattactccccccatattttagtacatgatactgctaatttttatccggtaaaaattttaaaactttaaccatccgtagctctcaaaatattgggtttgaaaacatagaaacttttttttatttataagaacttttgcaataatattttttgaaaaaggaattttataacattataagtatgttagcaaaaaaatcagttagagcatactccctctgcctcataaaaaacaacatattaccggatgtgacatatttatagtataaagatgtgtcacatcctatcttatatttattttttaggggacggaggaagtacttttttcatccttgaaaaagaaaatcgatgaatataaaaaaattttctagttgtatgtgttaacggtggcaaattattatcccttcgcgttcacttttcactcaccctacacatacttttactatttcaaataccaatgcaattaccccactttatctaaccctaatacatttaatcgtacttttataatattttgatgtaataattgttcataaagataaatttattttatgataaataagaggttaaatataaacagaggcgagtagtactttatttatggaggcaatgcactgaggacctgtttggtacaactctaaggtcccatttgaatcgtaggtagaaaaaacgaagg

SEQ ID NO: 1769 - DNA, 1501 bp, Oryza sativa
gacataatagatagagttctaacgttacttgacatatgataggaaagacaccaaaagcaaaggaagggggggggggggggggacgcatctcaacagggaagaactgcagggcacagcaccagcaccagagcgaagacccaagacagcaacagagcagcctcccttgaacaaaagattgtgtgattgactgattcatatgccttccgtgagcaccagttccagctctttggtggcagcctcgtcgaggttacagactttagccaggtctttgatggcagacggtgaaacatgcatcgccagatcattcaacaggttgtgtgtacggaaggtgtgttggagattgatcgaacatgaggctagctaatattgctaagttttggtatgatttcttatttatttcctagagtttagtaagaaactaaatagatgtatatatttagcaactttgctaaaaaatggtatggtttgaaatgacgtcaatctaaacaagccctattacagattctctgtgtagaattgacgactgatcgagactgcacggctatttatagcctcggtcatgagctaattacagttagtaaaacacgcagtatagccttttaccttaaactggaaattaagtaaagatgctcatacacatcgagggaagatgaaaggctgatgcgttgacctagctcgagttgcttccgccttccggtgatccagttcatcactggctcatagaaggacgaccgggtccaggcctccagggcgatgaacttacctagtagtagaacctaagatacaatcccaagacaaacacttccgaagagtgaagctaaggaggggatacttgagtagctacagctagtgataagtaaggctgaaacattcaaagcaaaagaaatgcttaattttatatgccacttgtctttcgttttacctcagaattcttcggtatattctccgcaagtcggcaacaataggaagatggacgtgctggccattgcatgcaagaagagccaaggttaggttcatgcatcgtgtcgattggggatgaaaattaataggtgaggacgcgttcaaaaaatgatcaattgctcaattgttctcggcaacataaactgtaactcgttgaccacgttgatcgtagcttaatttgatccaagttaatagggaagatttacctacatttgtcgacaaattttctctaaaaaattgacaaatgtaactataacataatcgttgtgaaattacactctaacttacatgtaatttgtatggaactttcaaaaatctctttgtaactgtcagggttacgggttcggcataccctttacccttcgatatacgttgcatatcgatatggcatacccacgcgcatgcggatatttcctgtatattctaaggaaacctttcgcgtaatttacagtagggaagaatcctacccggacagaactgggtcgttgacgtattgtatagggtctgatacctccaagttctacttggagaccaccagatc

SEQ ID NO: 1770 - DNA, 1501 bp, Oryza sativa
aatcctcagagcaaagtgcagataaagtcgggttctatgcattgtccctctcacattttgcatgagcttctggatatctttcttctttcccacaagtattttacagttataaattgctttgatcagataattctcagcagcaatatttaagcactgtttcactgcggatgtttaaaattgaatacataaattaacttatcgcataattgtagagagtctgaataaaagtagtttaaaactttttcatcccccgtgttcttcacttgaagattgagagaagatttacctcattttccacgtgtacgttgtccgaactactaaacgatttgtcttttgtaaaaatttatatataaaagctactctaaaaaccatacaaattcattttttaaaatttaaaataattaatactcaattaattatgtactaatggctcgcctagtcttacctatcttcttgattttctccttacctctcctcacaaacaatcatacatccacttgtcacaagagaaatatataaagcaatatatgaatcggctaaaagcagaacatatatcaactaattgatcacaggcaaccattggggcttcctatttgatattatgaagtatatagtacgcatacataattaaacctgccttccttcgttgcaacacatgttattttgctattcatttaaatatttaatttatctctaccattaattagccactctatgttctaaaatatagggacgaagtaagcactccacggtaataatctaaatcaaactaaaccttaaatatttaagttgaaatgtttttcttgaaaaaatagcccataacttatttaatttaaataatgctccaatttgagtatcaattggcttatttagaaaaggaaaaagtccaaataccccatacactttacatagaaatccgtctagcaccaatcggacatccaccctccctaaactttgcaaaaccatcatattattccctaaggtggttttgtataatggtttttttatctaatttgtatataaattagatgagtttgatcacatgacatacacactgaatatatgtattaaaatctccacttaaatctttatttttaccacttgttagctctcacttacaaacaagtaccaacataataatagtatgatattaccgcataagtataaattgatgacttaccactaatgatacgtaaatacgttatattagttatttaaagttgttcgtttaagcttttaaaatatgcaaaaccaccatccaaaaccatcttagatggtaatatgactgattttacaaagtttagagggttaaatgtccggttttagaattcagggtgctagatggatttcatccaaagttagggggggggggcatttggactttttccatttcgacaatattttctttttcagctccaaacatttacatcgcattgcaacacacgagtatttttgctagttttaaaataaaatgtgaaaatatatgtgccattatgtgaga

SEQ ID NO: 1771 - DNA, 1501 bp, Oryza sativa
ttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgcccagcccccaccacgaaattacccaccccccatcgcgagagaaaaaaactactaaaaaaatatcgcgcataatcccaattcgactccgactcggccattccgtccccaaacccacgccgactcgctccgcttttttaaatcccccaacccggaacgaatttttccccttcgtttccaccaccaccccccaccaccacgacgcggatggcatcttcgtcgtcttcgtcctagcgcgcggcggccgccacgcgaccctgtttgagagggggaaaggggggttccgctcggctaggcggaggaaggacgcagccgcccctgtcccgcggcgaatttggatgatcgaggcccgccgtcgagggtaaggagtgatggaggaagcggcggcggcggcggcggatttcgatggcggcttcggcggcgccggggaggacaacctgtccatgcccctcggcgacttcatggccttcctcgataacgaggactggaaggagcagcagcacgaggtgcgttactactcgccgccttgccctaattcgatttacgcccgggtgtatttttttttcttctgtgtgcgtcggatccgattcggtgcgcggggttgttggggggctgggcttgcgtctgttctagggtttttgattgcatcggggccggatgcgtggatttct

SEQ ID NO: 1772 - DNA, 1501 bp, Oryza sativa
tattattcagagaaccgccttctggattaaacgatatcatcagtggtgtaccaacaatatcatctgcatcgaaagaggaatgttgtataactgttgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcaaccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaaaaaagcttctttccgtcccgtgaatcaaaccgggcaaatcgtagaagacctatacgcaaattgcagaagacctataggtaagcgaatccagttcttccccagtagtagctttcaagtttcttgagccgtttacgctgcagtggctgccagctgctctgtgaattttgacgatgcttgctcttttttttttctggccctcgttttaccggttccactataaataggcaggtgagtgcttcttgtcgtaatagtaagctcatcacttggcaccagctgtgaaaaaagcttaattagtcaattctctccgtcagttgattttgtttggccaacggaacatggtaatttctccctgtttgttcattaacttgtgtgtatttatctgcatgtatgaatgattgcgtgcgtgctggcaaaaagaaggaatggaaataaaaaagatggttctttgatgtagagttctctgggaaacgaacatttatatgggagtatgtttagtgtcttcatgaaacttgttcgtagtttgtcctgctagtttattatatctttgaagtaaactttcagtttccaggttacactttcagaatttcagtagcttgcttggttataagatcaaaatgacatactgacatcaaatatctatcctgcaaaaggtagaaactgaaccaagcttagcttttgttggtcggtagaattttgttaggaccaagaggcttaactcatagatatgcaaggataacagaaatcctgttagtcaagaagagtaatactaccaattatattgatttaagtgctaatagatggtggattacttcatgatgtatcatgaacctaacacaaatataatgatctgttca

SEQ ID NO: 1773 - DNA, 1501 bp, Oryza sativa
aaaatacacataaccttaaactcgtgcgatgttatcttttcgcttatgtttataaagataatccattctatgccattgacaaagcatggattcaacaatataccattgacaaagctcagttctataatataccatcgaataactacttttcttccttacataccatcgccggcggtcaacagttagtcaaattccgttaagagcaagaaaatatctgttttacccctagggtacgatgcatcctcatcgatttcactgatcatgatccactatttattctcattgatgaaaaatagaaattgcttgtctttttatcatccaagattttttaccgcgatatggcattatgcaaaatctcaattttatgctaggggtaaaatggtcatttttcatcttttaacggcggttgactaacggttgactaacgtcgattgcatataaggaagaaaatgagtcattcgatggtatattgtagaactgagttttgtcagtggcatactgtagacccgcgctttgtcgatggcataaaatggattgactcttatacttatcagccgaaatttaaaatttcattgatttaaggtttttccatcgtagtttattttttagcatttgcttttagatcgttaaaacacgtatttaaaagttttatttacaaattattactccctccgtcccctaatataagggattttgacattttgcttgcactgtttgacaattcgtcttattcaaaaaatttgtgcaaatataaaaaacgaaaagttgtgctaaaagtactttggataataaaataagtcaaaaaaataataattctaatttttttaataagacgaatggttaaacagtgtaagcaaaatattaaaatctcttatattgacatagtaagtattcctttacaaatatattgtttagcttatttctcaaataaacaaaatgatggagtagtagtcatcacatctcccgtgaatagggtgtgtttagtttggttgaaattgaaacgatgtaatggaaaagttgaaagtttgtgtgtgtaggaaagttttaatgtgatagaaaagttagaagtttgaagaaaaagtttataactaaacaagggctaaacaaatttcgtgttccaaaatacaaatgttgtacagtattacgaggagacgagaaggaagagccagccaaccatactacctttcggctggctgaccggggtggcgtcgctgtcccgggccggcccgcgtagccgactttcggttgagccgcccgccggccccgccccggcgaggcgtcgcacccccgccgccgccgccgcccccactccacttgcttcctctctttgtctcccttcccttcgtttttggctcgttccggcgggtgggaataatatagctcaggcgtggcgagtttggtcggcgcatgccaaccttttccgtctcctctctctctctttttgccctctgctcctgcctgcctggctgccgcgatcgcagatcgggatctcggctcagcg

SEQ ID NO: 1774 - DNA, 1501 bp, Oryza sativa
tgaaagatatatttttcttttctcttctaacatgtttttgtcttttttgggactataaatataaatatgagaagcaaccattagatcctgctataatagtatggtgggcttttgtataaactatacgtaaggttgttcgagggtatatgcgagattatgatatgtatgagaagtttttcttttcaaagtagcctaacacatatcaatttcccccgagagaaaaagagaggaagaaaccgatgtaggaaggactactttgatgattgctagccgactctctaggttaacggttgtgtcctccaactattgaagtatggttttatcttcaccacttcgtgccatgcatatttatttggtagtgaatcgtactcccaactctccacccctcccccccccaaaaaaaaacgccctaaatctcttgtaaagatgggtattgggtaagcttcttttcaacatattctctatttgtcatatcccatatactcaatgtgatactaatggtttacatctaccacatacctcctgactcttgccaatcatcttatagctgtttagatgggactaaaacttttaagtccctatcacatcagatgtttggatactaattataaatattaagtgtagactattaataaaacccatccataatcttggactaattcgcgagacgaatctattgaacctaattaatccatgattatcctatgtgatgctacagtaaatattttctaattatggattaattaggcttaaaaaatttatctcgcaatttagcttttatttatataattagttttgtaagtagtttatatttaatactttaaattagtgtctaaatacataggctaaagttaagtttctgtattcaaacaccaccttacaactgttggagtgctggtgaggctgctaactttcttctcaaagccatagcgagtattcattgcaaaacctatatatattgcaaaatggcctgtgtaccaaaaattccattctactacgaactactagtagtatcaaaatgtagaaaaaaagagaaaggtccagattcatgtggggactttcctttatttcattctcaaggaacgcgagagaagagaaccttactttagccagctctggtacaaaagaaaagaaacgagaacaaaagcgaagcaaagggaggcgaagggggagaaagggaggcgacaaaaactccactctctcactccggcacagcactccccccacccacctacccacgccgctccacacctctcgttttcactgcttgctgcgagagagagagagagagagagagagaggaagaggaaaaaggaaggcgacgcggctgtcatctctctcgcccccgctcccttcccttctcctgctcagaataccaagtactcggatcccgaaccctctcccccctctcgtcgtcgacggcgacacgacgactccgctgccagcgcgtcggcctgccccagcggctcggagcaggggcggagagacgggaggatggacc

SEQ ID NO: 1775 - DNA, 1501 bp, Oryza sativa
gcacgacgctgctacagtgtgcacatctccctgcagcgcagccgctgccaaaccggattggcacgacacgcccggattctccactgttgccgcacgacgcaggcttgcagctccctcctgtccgcttcgttctcttgtcgctgttgaatttgtcctgtgccgcatgtgtaatacgacctccgtttcatagttttattttaaaattaattattttggcttcgtttaagtttatagaaaaatataaaaatagtttcaatataaaacaaatcaactattaaaatatattttaatgctaaatttaataagactagtttagtactataaatgttcctatatttttcaacgtattactatactctagtatgtagatgtattattacgtaggagacaacggagtacatcttactgcattcagcatgcagcagcagcagtaattagcttggttttgatctccacatggctgaccggttggccaacaatattttctcgtgtggctgcaagtaggggtggatagcgagtcaccccggctcagttcggtctaaatcgttaggataatgagctgatgaggctcgtctcatttgaaagctcgagccaacttgtttggctcagctagcaaatcaaagtagtagatggagagaagatggctagcacgacggtattagcggcttggcgttggagttgggaacaattcgacttggagacgggcaagaagagcttgttttgacctggtgctggtgcttctacggttgccagctagatgacggcgagctctagtggcggcgcgtagtgagcccacgaccccatacggcggcgccgatgggagatggtggcgacgagagtgagagacgacgtccagcgaagagaggctggacaaagctcgaggaacgtctcccaccgcacctttatctccatcgtcgcctgccgctggattccccttatagttgcaccttcactcgccagcatgcaccgccggtgaaagcacccgacgttgaccaccgccactaggggcggagctagtatatattaggggggtgcccaggaacccagtcaagaaatttttttagctatacctcatctattttcaccatgtatgcaccccctcaatacaaacttagacactcgtattagcttaaactcgatctaaaatagagtaaattaagcaagggacaccacactactagaaaactcattttcggcgtcgtaggggatcgattttcgcaggcgggcatgtaattcagagccaaaaccccgccggcaaaaaaagtacccggggtggagggggcggtccgcctgcgaagattgatctttgcaggcggtccatataagcgtcgcctgcgaagattgatcttcgcaagcggcagacgtcgtgcgcctgcgaagatagatcttcgcaggcgacgcttatatggcccgcctgcaaaaatgcccctatatagtcttcttcctccccgagccctgttcattctccctgacgtttctctctcctaaagtgacttaaata

SEQ ID NO: 1776 - DNA, 1501 bp, Oryza sativa
ccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccttctccatttcatctacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgcgtgaacaaacggaaccaaagctagaggccacccgcattgcaatgcattttccaaataccatctccacactcgagagttttgaactggcattagttcccaataaaaaccctcagttgcccgacttactataacattgattgttatgtcacttgtctgtggatcaactctcaagcccctcattaaccatcattttatagaaggtacactcatctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctaggcagcaggccttttataggcagcgaggcctgccgcccgaccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggtggcagggtctatttttataatttttttggccgatagattatttctgtaaatatttttttaaaaaatctaaaac

SEQ ID NO: 1777 - DNA, 716 bp, Oryza sativa
tcgtctcggcagctcttggctccgcctcctatcctctcctcttcccctactctcctctcttctctctctccgcctccaccagtctccccctctccctctccaaaccctccatagctataggcagcagctgggggtgctggcggcgttgaggcattcttgaatccggcgtggtcgcttccccagatccatcttttttggatcgtttcttcgggcgatttggaggagcaaagaaagccctcccaaatcgcagaaaggagccgcctttgcgaagctcctgctgccttctctgctcgttgttcctggcctgggatcacatatccccgcaaggaaaaaaaaggagccgcctttgcatttattcttttggccccttgggagatcgccctcgtcaagatttggtgggaagtgggaacccaattcgctcgcggttctcacttctccttgtgtggaaaggcgccgctttggctcctgtttccccccaccgctcgctcccgcgccgctcctctccctatatatctatctctctgactatcttgttcacatacgcctgcgcgcctgcctaactttgttttacttcgatccatccaccggttttcggcatcccccgtctcggcatttgatcgttgcttagtcgcttgttgatttgacgcaggccagatcgctgtctggcgcttgttttattttgagttgttgcggtgtgtttgctgttcttggttgga

SEQ ID NO: 1778 - DNA, 1501 bp, Oryza sativa
ccagcctctcttcgctggacgtcgtctctcactctcgtcgccaccatctcccatcggcgccgccgtatggggtcgtgggctcactacgcgccgccactagagctcgccgtcatctagctggcaaccgtagaagcaccagcaccaggtcaaaacaagctcttcttgcccgtctccaagtcgaattgttcccaactccaacgccaagccgctaataccgtcgtgctagccatcttctctccatctactactttgatttgctagctgagccaaacaagttggctcgagctttcaaatgagacgagcctcatcagctcattatcctaacgatttagaccgaactgagccggggtgactcgctatccacccctacttgcagccacacgagaaaatattgttggccaaccggtcagccatgtggagatcaaaaccaagctaattactgctgctgctgcatgctgaatgcagtaagatgtactccgttgtctcctacgtaataatacatctacatactagagtatagtaatacgttgaaaaatataggaacatttatagtactaaactagtcttattaaatttagcattaaaatatattttaatagttgatttgttttatattgaaactatttttatatttttctataaacttaaacgaagccaaaataattaattttaaaataaaactatgaaacggaggtcgtattacacatgcggcacaggacaaattcaacagcgacaagagaacgaagcggacaggagggagctgcaagcctgcgtcgtgcggcaacagtggagaatccgggcgtgtcgtgccaatccggtttggcagcggctgcgctgcagggagatgtgcacactgtagcagcgtcgtgcagcggtggacggcgaaggaatcctgacaggtgccaaaaccctccttagatccgggggacccccacccaccatacacgcatgcgacccactggcacgcggacgggtaggaataggatgtggtagcatccgaggaacaggggcagtttcgtctcgccggcgttgtatttccacatcaacgtgatatgagtaggcttgctgctacggtacgaagcatgggtgatggcctgatggctacacgactgcgtcggtgactcggtgtggctctagatcgagtcggtacggtattggtttgttgactcgtactctcgtactggtcattgggcggtacacgtgtatctttatctgaaccgataatggtgctatccataacgatcaacggtgccttcacaaaatcacaagcgaatgattttactgccttgctagaacttccaaagatacccgcttcagaaaggctttcaccgtctccactccaccaaacagaaacacagaatgcataatgtgtgattacgatcaggcagagtggtacacaggtactgtagtctgtaccctgtacctattaccaccattttaagcgaacaccatcaaactcataaataacctgccactcactcgctgcacactagtccttcag

SEQ ID NO: 1779 - DNA, 1501 bp, Oryza sativa
tatatttttctataaacttaaacgaagccaaaataattaattttaaaataaaactatgaaacggaggtcgtattacacatgcggcacaggacaaattcaacagcgacaagagaacgaagcggacaggagggagctgcaagcctgcgtcgtgcggcaacagtggagaatccgggcgtgtcgtgccaatccggtttggcagcggctgcgctgcagggagatgtgcacactgtagcagcgtcgtgcagcggtggacggcgaaggaatcctgacaggtgccaaaaccctccttagatccgggggacccccacccaccatacacgcatgcgacccactggcacgcggacgggtaggaataggatgtggtagcatccgaggaacaggggcagtttcgtctcgccggcgttgtatttccacatcaacgtgatatgagtaggcttgctgctacggtacgaagcatgggtgatggcctgatggctacacgactgcgtcggtgactcggtgtggctctagatcgagtcggtacggtattggtttgttgactcgtactctcgtactggtcattgggcggtacacgtgtatctttatctgaaccgataatggtgctatccataacgatcaacggtgccttcacaaaatcacaagcgaatgattttactgccttgctagaacttccaaagatacccgcttcagaaaggctttcaccgtctccactccaccaaacagaaacacagaatgcataatgtgtgattacgatcaggcagagtggtacacaggtactgtagtctgtaccctgtacctattaccaccattttaagcgaacaccatcaaactcataaataacctgccactcactcgctgcacactagtccttcagtttcagtcccctcgcatcgccataaccacctcgcccaaatcgaagcacactagagagccacaagacccctcctcccgacacaaacaaccaaccacactacccttcgcgctggtctcgaccaccggagatggccgcctagctagtgtgccggtggcagctggaaggcatgggctgctgcttcagcaagaagcgcaggaagcagctggccagtgcagctgtgttctcccgccgctgcaagccgccggccgaggcccgcgacccgccgcccccgccgccgttgccggaggaggagaaggtcaaggaggtgctctccgagaccccgagcgctaaggtcagggccgaggcgaagcccgtcgccaatgtggctgtcttggaggagccggaggcggagaagcaggcgccgaagcctagcgccgatgcggatgtcacggtgagcgatcttggtagctgcatgtcgctcgccaccgacgataggtccgaggcggcgtccgagtcgtccgtcgcgaccagctcggtgaccgggccagagcggtcgccggggaagccggccaggaggaagcgcccggtgtccgtctccggcgagctggcccatgccatttcccggcgcgaccgcgccgccgccgccgc

SEQ ID NO: 1780 - DNA, 1501 bp, Oryza sativa
acggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttgaagtcctcaggagcccagtcccatcggaccccctggtgggtcctcatacagtcctcggacccggtgtactcccaggcgtcccgggcgcgccgctggagtggcgcgatccggcgacgaagatagtcgccgaataccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccgaaacagccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccttcgcccagcgagactatctcctggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacatgaaacaaggagttagggcgcaagcggcgaagacaaggggaataatggcgagagaaaggaagcaaatctcttcctcggcgactttatacccttgccaacgctgtgcccggctcctcgtttctcgcgcccactatcttgccccctcgattctcgcgccc

SEQ ID NO: 1781 - DNA, 1501 bp, Oryza sativa
cagcgcaggtgggcagcaagagctggtggcgaggccatggctatggctgtcgcaacggcgccacgccactgctagccaggagcaccacggatggcagcgctcgtcgtggccgcggcggaggctagaggcagcgccgacgtggacggcggcgctccttgtggtcacggcagaggctggaggcggcagtccttgtggccgcggcggaggttggaggcggacggcgatgctcgtcggggacgcggcagaggcgggaggcagcgccgaggcagacggcgacgctcgtcgggactcgggaccatggcggtcggcggaggcgggaggcggcgccgaggcggaaggcggcgtgatggatggggtggggatggatggaggcagcgctggtaggtgagggactgaggtagtggggacttctagggttttgcaatttattgggtttattgggccttctagtcctattgggccacaatttggttttctcggttaaaattcggttaaccgagcccaatgaccgaaatacccaaaataaattcggtcttttgatggctaagaccgaactactaaccgaatttcttggtctcgatcttttcggttcggttcttcggttcggtcttattttgcccacccctacctattatactcggaggacaactctgtgcgtgcgagttggctgactcgatctcgattactgctcacgttcacgatagaaataacagggaaacaatcgaaaggcgttttcgaccgcgcgcgtgaccaaccatgagctgaaatctgaaacgaaacttgatttgtgtttggaaccttgggttctcaacccctctctatcgtattccgcgcgcacactttttaaactgttaaacgatatgttttttgcaaaaaaaaaattctatacgaaagttgcttaaaaaatcatattgatctatttttttaaaaaattagctaatacttaattaatcacgcgctaatagatcggaacatgctattcggaacacaccaatttgcatcgaccggcacggatgcatggtagaattggaccacatcaaacatgcacgcggatcatccacgtgccaagacggaacgtgttcggcgaacaaatcaaattttctgcgaaacgaacaaccattataaccggccggccgttagatatattatttctgcgatttcatttcattcattgtttaacaatagcaaataagttgatctgcgaatttcgcggggccatcatccagttggcacttgaacctgcgcatgttagttttcccttaacaaaccagaaacaacaactgctgatcgttcagagccggccaatcaccccagctataccagctgctgctaatcatagcaaacctaacaatgccccagcctgtgaaaggaactcccagccaagcaatccattccttattccaaggcgaccctgccctgcctaaacaaagcacacatgcaacgcaaaaacagcctaaaagcctccccgatcgcagctatataaacacgacacctctcgctc

SEQ ID NO: 1782 - DNA, 1501 bp, Oryza sativa
tgttttctgatgttcttcttactgtgattgtccacgatagaggccgagtttagggtgtgtttatttcacactaaaattgaaagtttggttgaaattggaacaatgtgatggaaaagttggaagtttatgtgtgtagaaaaatttttatgtgatagaaaagctggaagtttgaagaaaaagtttggaactaaacaaggccttaggttgtgtttagttcctgaaattggtgggaagtttggggaaagttggtagtttggaaaaaaagttaggagtttatgtgtgtaggaaagttttggatgtgatgtgatgtgatgaaaagttgaaagtttgggggaagtttggtgtgaactaaacagggccttagttctaaacttttttttttcaaacttccaacttttccatcacatcaaaactttcttacacacataaactttaaacttttccgtgacatcgttccaatttaaccaaatttctaattttagcgtgaactaaatacacccattaaattacatcaaatttggctgcgtaaatccgctttggatgcatagaatgggttttactccattttctaagaaaaaagaaattattatcaaaatattgtatttatagaagtccattgttgatttgtttctttctttgtagatcgttgttgaaacttgacaaattgaatggcagatttggctgctagtatttttttttgaacgccaatttagctgctactattggacgcaggagaaatgctaaaggcaaagatgcaagagaatacttttataaactaggtggagtatctagtaatcttattcccctctttggctctttccccaaatgcaatttttgcacaattgtactaatgaaaagcatcattagactagcagtgggacccatagtatgtgcaacaagaattttcttagatatctcaatatatcatcatccatcatatccaatcaagaaaatggaacacacaaggaagaacaaaagagctctcactactgacatcatcatcaaattaggggacaattggaattctatttttcttttgccatggtttatgcaggagttgaacttatttccccaaaattcatgtggaatttggcatggcagcctctgtttgaataaactaagccaaaccaaacccatcactttgggtcaaaggcagcaaagaagcaaaggaaaaccaagaaaggaaaaccccaagaggaggagagaaaaggaggaaaaaatgctggacacgctataaagcggcggagcagaagagtggcaaccgcagagcccacacgtaatcctttgcccgtccccccgcgttttcacctctcacccctgaaactttctttatttacaatccaggacaagttggaggggggtatatatgctggcaagctaaatcctggttatttcgagtccctaaacgcaaaaaaaaagttgctgctacgcgcacacgcgcagcggcgcagcctccgcgccacccctccgcctcgccgcgtcggcgactgcaaggcggcgt

SEQ ID NO: 1783 - DNA, 1501 bp, Oryza sativa
cgcaggaggccgtcgtcgccatggaggtcgtcgtggcgacagcggcggcggtggatctgtcccccgcccctcccctctccctcccccactcccttgcttcgatcgcttctgcctccggcgacacgtatgtccatctatctcgccgccgccgccatttttgtttcttgggagctcgccggtgacgtggtatgtgtgttggtggtgtgttcagatttgttgatttatgtttgatttttgtttccttgccctcgatttgtgttctttgatttgtttcattgttctgatttggttttgattttgatttgggttgatgcagctggaagtgtgctaggcgcctccctgctcgtcggacaccccggtggcaactgcggcgccgtccgacgagatggcgaggccgccctggattttgctgtggtgggagtggatttggagggcgtatcggggatttcgcccttggatttcgccacgagggcacgcgtgggcgaagccacaacgctcacagcgcgcgcgcctccagtcttctcctctgctcgcggcatcgttttgacgaagtcctgcgtcgctcaacatggagatgaggttccaacttgagacgcgggttcgagcgccacggcagcaaaaatccaatgtgtcgccccatagcaccggtccagggtggagcgctgtgaaaggcctaatagctgcacagtgtggtggcattgagctcactcgatcgccttcataaagagcggtgtagcttcgagctacggcatgcagttcgtatccggcctggcgaccttggtgtcgtgcaatccatcgctcatggcgctcaccaagctttcttgcctccttctcgtctgcgtgacgtcgacggccaccggagccaggtacttcccacagatcgactgttcgccggcgccgacgtccaacagcagcaacggcacggcgttccgcgcgaacctcctcgcgctgcccaccgacgacctccccgcccaggccgccgcgacgaggttcgcctccacgcaggccggcggcggcgaccgcgcgctcgctctcagcgtctgcctcggcgactctacgccggcgctgtaccgcgagagcctcgccgccgccgtcgcggacgtcgtcgcgggctgcggcgcccgcgccggcgcctggctcgacgggtgctaccgcagctacctcgccgcctacgccgccgacaccaacacgacgatgtcgcccagcccagcggggggcgagttccaccggtgggtcgtcaccggagacgtcctgccgttcagcgacaacctgtacgcgacgttcctcgacatgagcaacggcgtggcggcgcggatgctggcgatcgacgtcggagcagccacgacgaggacggggctggccgggcgcgtggtggcgcagtgcgccgcgggcgtcgcgccggcggactgcgtgcagtgcctggagggcgcggcgcgagagataccgagatgcttccgggaggcacgtcgggaggagcagggagagggcgtcggcgtcgtgg

SEQ ID NO: 1784 - DNA, 1501 bp, Oryza sativa
aggacctaaaaatcctgaatagttcagagtttcagcattgatcacctccatacaaaagaatttcacatttatgatagctgtgccattccagagcctgactgatgcaaatgttagaattagccggcaaaaacttggcaagtaacaatagaagttgtcatctgtaggattagcaagacagcagccaatgactggtagcagcgcagcctcctccaggatgtcccctcctccacgcgccgggctcaggctgggcggccggccgtctacaccaccgcgccgtcaggcccagcggccgtccgcctccacgcgctcggcagggcagtgcctcggcggcctccacaggtcgcggcagggcagggagttggcctcgcgcggcggctggcccggttcagtccgcactcgcggcgagcacggaggcctgcgcaggcacgacggcggcgagcctcccagttgattcgtgctcacagcgatggccggacgcgggcgggcgaggcgaaacgacgatgcgagcgcgcgggaaggatcgggggcgggcgccgtctcccgcgctggataggggctggatgggcagcgaaatttcgacctgcaggcgggtccaagcgccatgtccgttggatttgtttcggatggtccagatcttcccaatgtcacgctgtgacttgcctttacaatgtcacccaagctgagtccccctcagcacgtctcctccttcgcctcgccttctcctccctctcctccctcgcggcggacgccggggacaccgccgccgtgcgcctcgcctcgccatcgaccgcgccgcccgctccgcccgcgctgcctacgccgctcgctcctcctcccgctcggactcaggagctgtgggggcggctgtagtggacggcgcgccgccgacggtgggagcagcgggagtggacgagacggcgccgacgggcggtcggcggcaggagcggacggcttctacacctctgcggcgcaggaggccgtcgtcgccatggaggtcgtcgtggcgacagcggcggcggtggatctgtcccccgcccctcccctctccctcccccactcccttgcttcgatcgcttctgcctccggcgacacgtatgtccatctatctcgccgccgccgccatttttgtttcttgggagctcgccggtgacgtggtatgtgtgttggtggtgtgttcagatttgttgatttatgtttgatttttgtttccttgccctcgatttgtgttctttgatttgtttcattgttctgatttggttttgattttgatttgggttgatgcagctggaagtgtgctaggcgcctccctgctcgtcggacaccccggtggcaactgcggcgccgtccgacgagatggcgaggccgccctggattttgctgtggtgggagtggatttggagggcgtatcggggatttcgcccttggatttcgccacgagggcacgcgtgggcgaagccacaacgctcacagcgcgcgcgcctccagtcttctcctctgctcg

SEQ ID NO: 1785 - DNA, 1501 bp, Oryza sativa
tggaaggttgggactgcacttagagccttcgtttctcccaaatgcagcacccacaccgtccgttctgtgtagctgcgtgcgttttgacgtggccttcggggaaattcacgcttgacgtgacgcggtcgtctcggctgatcggctctctccgagcgaagagattttctaagcgggcgaacgtgcgaagaagatcgtttattgccagaatgcagatagactttgtgattgggtggagagccgtgtcgagtcgacactcgagtctcgagcgtcatatgcgagtgcttccaagcgagcacgacgtggaggtgaagttttacacgatgaccctgcttcttccgtggttcacaaatcacaaagttcacatcgtaattagcacggtgtgttagctaaatgagaaaatatgtatggcatcgacgttcactccttttcatttttctaaagaaaactgctagcttaccgaatagcgtagacttataggcgaagttttgtcaatgagcaattgctaccgttcgcctttcagcaatttcggatgaagtgcattatgagaaagttgtagacacgtcacagctactactatatccaatgacttgcctcctagcattatatatatatactcttattagtaaacatttttttatgaaagtccacgtagtctagtggttatagtgacttaagtagtacccaaagtcctgagttcaaatctcctatggaacaaatttcagattgggttgtttgtggggctaagttccctatttcaattccctatttcaatggccatatatatccggttggatgtagaggccaggtaaaaaataccctttctttaaaaaaattagtataaacatttatgtttgcaatgcaatacttaggccatgtttagttcacactaaacttcccccaactcccaactttccatcacatcacatccaaaatttttctacacacataaactctcaactttttttcaactttccccaaacatctcccaatttcacaaactaaacacaaccttatgtttaatcccacctccttcgaagaacaatcacacataaactcttaacttttttttcaaactaccaattttccccaaacttctcccaatttcaaaaactaaacataaggtccaatttcagaaactaaacacaaacttatgtttgatcccacctccttcgaagaacaatcggaagtactagtgtgataggcaacacaaaggtcatttctattgttatttttaccttttgacgtcgacaaaggccgtagttgcatacttgcacgcgcctatgttcgcattgctcctctaaaaatatgtccgcattgctgaggtgtaatcgcactgtaactgaaggtgtgtgcttttctcacatatcagaggctgatcataatgtaataaatgaacatatatagctaacgcaaatgttataacgtgaaggattatgttgcaacgcgctaaacacaggtccaacactgtatcaaaactcaaaagtttcattcgcagagtatg

SEQ ID NO: 1786 - DNA, 1501 bp, Oryza sativa
cacgactgcatgtgcgagtgcagctcctgcggcttgaactccttcccgcactgcctgcagaagtgtgttacaacatttcacaagtcagttcttaaacaggttataaacgatcaatggaaaagaaagtgattgttcagaaaaaaaaaaaagcagagtcgtgtggatgctgatagcttgtttggggtttcaaagtagacgtaaatctgcacttgatgggccggcccatgaaatttctattcagactgctcgataacgagagcctttgttatcttgatgggccggcccatgaggtttatagccgtactggtctagcacattgcgcacagcgagcctgaataggtggcaactgcaacaacccaaccgaaaagctgccacgcaaggttcttggacgagcagaagaaatggtcaagaacgagaaacagatggacagcgtacgtgcaggcggtagcaaaatcagttgagaggaaacggggctggctagtcaagagtactcacgagcaacgcggcaaactcgccggcttgtgcgaatcgccgccgtctcgcttcggcttcgccttgtctttcctgcctcttcgcaccttcaccttcttgcccaccctgtcacgccagataatcctatttgagcactgtgtaatcggatgatcgaattgtgtggggtttccgtactcaccggaggccgcagccgtcgatgccggggcacaccggcgtaggaggccagtcgccgccgtcgtcgtcggcgccgtgccgcaggacggggcggagcgcggtgtcgtcggcgtcggccgcgccgcacgtcaggaggttgtggagcagctgcgccaggtgcatcctccgcgcgctgcccaccgccggcggcgtgtggctgctgatcctgccgctcgccgctcctttcaccttctgctccggcgccggcgccggcaccaccaccgccttggagaccactttcaccacctctcgctgctgcttcttccgctcctcgcgaaggcctcgtggcaggtctttcttcaacggcgccgtactacggctcgccggctcgccgggcgagtcctcgtcgaccggcggcagcgtcttcggcgatctctcgtcggaatctggcgccgtcgtcgtcgtcacctcctcgacttgcttctgatcgcacgcgaccttcacttcctgactgtccagtttctttggctcttcagctatcacaaacaaattttgtgaatttgttaatcacgagccatcgtcatcgtcgaacgagaaaaagaagaccagaaaaaaatatcaccgcacctaaagaagacgacttctcctttggcgattcggtggctcgccggacgtcgcagcccttgagcacgtactcgttgtcggagatgggggtgatgaggtcgtcgtccatcatcaggtcctgccatatatacccagccttgtacttcctaatcaagaatcaattataaacattcctaaattgctaaatctatcgggtaagcaagaacatgctaaaaatgatttaggaattaac

SEQ ID NO: 1787 - DNA, 1501 bp, Oryza sativa
gatctagccgatgggcgcgcggcctgtagacaaagtagtccaaacctcgtgcgttggcgatgctgtcggggttgacggggacgcagaggaggacgagatcggcgtcggaggcgatgatcttaggcaccacgcggcggaagtcgaggccggggcagtggacgcagaagcgggagagaagcggcgggcgggcggggtggaaggtcgcctggatgcgcaagccggtgctcgtggtgcccacgccggtgctggcgttgggcaggtcagcgatgaggcaccacctgtcgaggaggaccatgccccctgatgagccgtcttcatggccgtcggactctggaaggggaggagccgtggtcctgtagggaacagtcggggcagccatgtccatggacaagcgaaggataacagatccaatcgcagggaggaaccgaatgtgggacggggtttttgacttaaaaaaaactaattttataactcatctgaaaaccacgagacgaatttattaaacctaatttattcatcattaacacttataggtttctataatatttagctattcatcattaacactaattctgatttctatgcaaactatgcaattagtttttttatctatatttaatgctccatgcatatgtccaaagatttgatgtgaccttttaggaaaaaattagcaactaaacaaggacataggagaactaaattattgtgcaacccctcctctaccaagttagtctaagagagattgcataattctaccagaattggagacacaaagatgtagaggtaagactcttcttatttattcattaacttgtgcaatacaatagcacctcctcccctcaatatataggcatagccatgagtgcttttcatatttagtgacggacctaattagtgggtaaccgggctggaccttcatgggccggtggtttccttaaacaaatcaatcagatccaatttaacttttggggacaagagtctagggttcacgaaggacatttttctccacgtcactcgtgtgcggttaccatcaacagcacgtacaacaaagacgctactacatgtggtctcgagtcttcacatgggctaaaaccacaacattgttatagctcacacaataggaataagtttactttgagtgcctaactagtagccgaatcttattcatctcgtttaaccacgatataagatatgttgactttccaactattaaaacatgtacaatttttctcccggtggttctgaacgtggcgactacgtggaggtgtttgacatgatcttcatcctacgtgatacttatgagcgcagtttgagatctaatcaaccaagcgatgccggccttgtcaagtgggaataaattatgaaatggccatgtgtcttatttactttttttattaccatggattatttgctttatacttctaaaaatatgttttattaaaaatattttatcttgtttagaccacttattctaaaccatttgtgagtttcatttctaaat

SEQ ID NO: 1788 - DNA, 1501 bp, Oryza sativa
acgaggaaggtggagggagagcggtggaagggaagagggagggttgcaccaacggtgggaggagaacggcggaggaggaaagggagagttgtgctggtggtaggaggagagcggcggagggggagagagagagctacgtgccgacatttggagaaagcgtgacggggatgaccggacgaggatgggagggtgtatttatatttctttttctaattttcgggatgtttgatgtaaaatatgaggactaaaataggaaataatatgggttgacatgcaaaaactgaaacagctttagaactactgaacactatgaaaaaaactgatttgagacctatgactttatcatacatgatatcatgatactcctgtagtaatgtcttgccttatcaatggatgtcctctcagctgctttccggtctcctgcaacgagagtgttcacactgattaaggctattattttggagctcccctatatacggatggattaacatgtgataaattaagtattagctaacaaaacttaaaaatatattaatataatttttaagcaattttttataggaatttattttagaaaaatagcttgggaagtgtgcgctaaaaatgcaagaggtgagttggaaaaaagttatgtaaaactgagcctaagccgccgtttgtttggaacgggtaaactatgcaagaataaaaccccacctcccatcatcactgttttaacccaaagtgccaaacacatactgagagaccgctagtgctgggactgggaggagagcgcagaggaagaggaatactggaaagctgacgaaagaggcaaggaaaggaaggaagctagcacgcacatatccagccagcccaggattgcagattgctatccctcttattctcgcaaccacgctgatcccaaaccccattccgcctctctcggccggtctctcctcgcgggataggagaaagtcagcggcgggcgcgaggtcggtcgagtggagcggccggcaagaagagcgaggagatttaggagggggagatgaagcccgtcgagcgcgccaagctggtgcggagcctccggcaggagtcgcggcggctgcgcctgctcgtcctcgtcatcggcttcttcctcgtcacactcaccttcgtcgtcatctccaagcccgacgccctcctcttcaaccgtacgccatgccgtcgccgcttcttcatcatcttcttcttctttttcttcttggatccttggatcgatggtaacaccaagcgcctcactcgtttctttgagttcgcagtgaacggccggctgtcggtggatcatgcgccgcgctcgctcctgatccgccagcggatccacgccgactccaggagatccgccgataccttccccgccgccgaggatcccaaggtggtggacgaagacgaaggcgccgaggacgccaccgccaaaggtgaaaagctccagagctaattgccgccttgctgcagtcagcaaatcttgggcctagcgtactgacct

SEQ ID NO: 1789 - DNA, 687 bp, Oryza sativa
cataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatagaga

SEQ ID NO: 1790 - DNA, 1501 bp, Oryza sativa
cttcgttgcccatgtgtgggcaagcggtggagcttggggggcccttgactttgaaggtgccggaagaggagcccgaggaggagttggtgcaggagcctgaagaggagtcggtgcaggagcctgaggtagagacggtgctggagcatgaggaggagacggtgcaggatcctgaggaggagatggcggagccaaaggagatggtgcacgagacgctgcttgtcgcccagggaggatgatgtaccgcctatgccatagaataatggcatggcttgtgtctcgtagatgcgtctcaccgtctcctccagggtaatccaactcgaggtcctcgtacgcgccttcgaccaactcaacttcgaccttggagtatcctgctggaatcggcctgcagtggtaagtacctgaagggtccgttgggatggccatgcccgacgccaccttcatgtggtgagaggttatttattagtaatcaacatatataagcagcaactagcagaatggccaaatctaaaatatataaactacgagcttacctttattgataagttcttgaaaggaatatgcagctcacatggtgtccgctgagtgatgtcatcaacggggcaggtggattcgtcctgggtttgcatggcgtccatgctctgtgatcctacttgccccgttgaggcgcagctgctacggtttcctgacgggctcaccattgtaggaggaatggtcggctggggatcatgggaccgatgtgcggccatacgttcatcaaccttccttgccacctcctcttgcatgctgcactcgtagctcgataccctgaactctagatctgcaatcttcgcctcggtatctctcttgctcctcatctgactcctgtatgtgtggatgtcctccttgaacccaatcttccaaggaatcacccctttccctcgtgttcgtcctggatgctctggagtctgcagggcgagtgacagctcgtccctctctctgtccggtcggaacgtgccctgagaagaggcttccacttcgtctgttagtcgacgcgcagcctctcatatctgatcgccgaagaccagtaagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttctatcatcgcctgcccttgttcacctgtcttatatgcaacgaactcgtcccagtgatcccttagctttgggaatgtgtcgaagttcggtgtctgcccattcaggatatatttctggtacagatctcccttgaagctctgaaactgttctgccattttcttcagagtccacctttgcactttgtcctctgtacccgcgggaagggttaatgtctcgagcattgtggttcacagca

SEQ ID NO: 1791 - DNA, 1396 bp, Oryza sativa
gcgagagctccccgctcgcaaagccggccccgagcgccgatgttcgcccgcgcgcagcgtggtttcccgcccgagccgcgtcgtctgcgccgtccgcgtcgcccggtcccgctgcccagccgcgccgcccgatgcttcccgcgcgcgcgtgccgagtggtcgaccgcctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaagccgcgcccctcctccctctgccgcgacgctcccgctccccttcccctttttcccgaatcggcaaaggggcaagcccctttctccccctccttttcccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcatttttgcctccgcgccattgccgccctctgtttcgccatcgccgatcgtcgttgcgcatgtcggaggagccggcacgagcaaggacgcggaagaggacttcggccgcgccctcttcttcctcttccccggcccgaggccggagagattactcccgcaccgtcggcctctcgtcacagcgccccgtcccgcacggtagtgtctccctccgttcttcctcctcgctccatctcctccccttagatttcggtagtagctcgagtagcctccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttccctcgccaccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcaccgccgccacccgccgtccattcgcggccgggtcgtcgtctacctcccgccggcccgcgtggcagccacgtaggcgccacgtcggcgccagctcagcctagaccgggtcgagccgaccccggtcggtccctccccgtgcgcgcgttccaccgcgagccgtgaggctgcgcgtgggcccgccgcatccgcgtccaccgcgagccgcgcg

SEQ ID NO: 1792 - DNA, 1017 bp, Oryza sativa
tcctgcagcccttccggcgccgatttggatttaggattttgaatctggcgcttggtggttttttatataggcgcgggggtttggcgatccgcgtgatgtggggtgcgcgccgtcggatcgagatgggagggaacggtggggattcgttttgggggggcgatccgtgggagcacgcgacggaccaatcaggtgcgcctgtttcgtgttggtgtctcaaaatggaccctcggtgttggttgggccatgcgactgaattaggaataagttcaccggaggaccctcaatttaacagcgagattttttgaggccttcaaccataaaatcagaaatgttcacccctaaactcattcaaaccgttcaaagaaggtcccatgacaatatttgcgcccggttttgctgacgtggcatcctagtcagcaaaaaatataaaaaaaatatgtagggcctacatgtaagtgagagaaaatggtgtaggccccacatctctcctttcttttctttttctcttctcttctctcctcctctcaagcaggcaaggcggccagcggcggagcaggggcggcggcggcgggagagggggagagagacggctggcacgatggcgagctcagcggcggagagtagcggtggttggggagaggagcggcaggaaagggggcgccggcagtagcagttggtgtcggcggcggcggcggccggcggcgagaagagtgtgcagccgctgcggggggcagtcgaacgaccaccgcgacgaccttgcccggggtatctactgcgctgtaggattgagatgtcgactagaggggggtaaataggcgatttaaaactaaatgacacctaatcaaaactaacctaagttgctaggcttagtgagggtgaactctaactaagcaactgagttatgttttgcaaacctagagtgatagtggctcaactatatctctaggaaagtaaatcacactcctatgtcaatgtttagcaatcctagggtgatacgatctcaagtatgtctctaga

SEQ ID NO: 1793 - DNA, 792 bp, Oryza sativa
taaggtaattggtgaaatctttcgcacttgtgccgcagacatgttccgccaatcaaggcctcctcatttttcatccctaccatgtcatattctgccccatgttcacactaattgctcattttatacccatgggggagaaatcgctgtttggtgtaaactgtcagactaatgtagttacctgttatactgtaaatatattttacatttcaattggtaactcaagaagaagtcagcttggaataggacaaacaaatggtccactatttttgctctctaaaagtcattcaaactaggagtacagcctaactcgatgatgtcaaatcatacaactctgaaagagtctgctctggaagaaccttctaatctcacatttaaacaaccacctactgtgcgctctttttctacgatattgccatgctgcatcaggttcatcataacttatgttccatttcttttttcttcaaggctttttatagtttctgtctgattttctacgattgctctggtcgaacctattcgtttggtaatgatgtgattacgtctgtctaaatagctgggatatttatatccatggaatacaaaatattgacaatgatttctagtgttgccaattcttattgatttttggtgggccaattgggtcctatgatctcttttgtgcagttaatcattttttaccttcaaaatttgacattttttcagcttgttcctggatttctgatttcattaactggacttatattgaaacggaattaattacgaacctttgtactccatcacaggttgttgcca

SEQ ID NO: 1794 - DNA, 1501 bp, Oryza sativa
gcgacgccaccgccttgcggaggcggccgaggagcggcggccccttggacccctgacaccggcggcgttgccggttggcgtagatgtcgttgaggatctgcttgtcggtgcgcgggccgagctgccgcgacgacgacgcgcccgacgtcgacggcgacgtggtgcagtactccagtggcccggagtactgccgcggctggagcgtccggaacgagaaggagttggagctgtcgaacgacgacgacccgatggacagcgcgccgtcgttgaggacggaggcgccgccgccgccgccgccgccggtggaggccatcgtcgacgggttcgacggcagcaacacgccatggatggcgaacgccggcgcatcgcgtccatcgaagctcagaatgtgaccgatgctgttgcagccccccgcggcgtcgtcgtcgtcgaacgcaacggcgtcgtcgccggcggcgtggtgaccgcgcccgcgcccaccaccggcggcggcgtccgcgaagcacggcgtcgccaggctcgccaagctgttgcccatggtggtgatgaggacgactcagacgagacggcggcggcggcggcgatccgatgcgcgcatcgatcggaggggggatcgaagtggcggcggcgcggcgggagaaggcaaaaatgggcggcgagggaggggcgttgacattgccattgcatcaatgctttgtttatggagttgaccttgcaaaaggatctaccaatatatctatatatcccttaatttatctctctttctttgctaatactatatatatctcgttatatatatgtttgatatatagttgcatcttctaagttttcttcttcttcttcgcattcgtctctagcttgtgcgcatggagttgactttgtatcgaagagtatagttaattagcgagctggtctaattaattttaattacgacgtgtcgtgacgccctgtagctagtgatgaagtgaaattaatatatcgattgttatattaagtctcacatgtgaaatgccaaatttgtatcatcaactgtgttcaggtcaaactcgatcgccatcgcctgttgtcagtaagtttcaagcacaatctcacttgatcaaatccatcacacttaattaccatcttcttactgagagtagagcggaacactactgtacccttcttttcaattgagtttcgtgacccaccatctgacgagcaatacaagcagcacttaattgttctggtttaatttgttggtggtgtatttaatttactatttagttaataactaggaaggtagcccgcgcagttgcgcgggcatattatttaaactatcataatttttgttgttattagaaagaatttagggtttcctttgtaacacaggatttttagaaaataatagaaaatggtatataaatgattttgagaaaagaaaagaaaatggtatataaatatgatagaaatgaatgtttaaaatatagtatggaatagaatggatgtttggatagagtgtaaa

SEQ ID NO: 1795 - DNA, 1501 bp, Oryza sativa
aaggaaaccctaaattctttctaataacaacaaaaattatgatagtttaaataatatgcccgcgcaactgcgcgggctaccttcctagttattaactaaatagtaaattaaatacaccaccaacaaattaaaccagaacaattaagtgctgcttgtattgctcgtcagatggtgggtcacgaaactcaattgaaaagaagggtacagtagtgttccgctctactctcagtaagaagatggtaattaagtgtgatggatttgatcaagtgagattgtgcttgaaacttactgacaacaggcgatggcgatcgagtttgacctgaacacagttgatgatacaaatttggcatttcacatgtgagacttaatataacaatcgatatattaatttcacttcatcactagctacagggcgtcacgacacgtcgtaattaaaattaattagaccagctcgctaattaactatactcttcgatacaaagtcaactccatgcgcacaagctagagacgaatgcgaagaagaagaagaaaacttagaagatgcaactatatatcaaacatatatataacgagatatatatagtattagcaaagaaagagagataaattaagggatatatagatatattggtagatccttttgcaaggtcaactccataaacaaagcattgatgcaatggcaatgtcaacgcccctccctcgccgcccatttttgccttctcccgccgcgccgccgccacttcgatcccccctccgatcgatgcgcgcatcggatcgccgccgccgccgccgtctcgtctgagtcgtcctcatcaccaccatgggcaacagcttggcgagcctggcgacgccgtgcttcgcggacgccgccgccggtggtgggcgcgggcgcggtcaccacgccgccggcgacgacgccgttgcgttcgacgacgacgacgccgcggggggctgcaacagcatcggtcacattctgagcttcgatggacgcgatgcgccggcgttcgccatccatggcgtgttgctgccgtcgaacccgtcgacgatggcctccaccggcggcggcggcggcggcggcgcctccgtcctcaacgacggcgcgctgtccatcgggtcgtcgtcgttcgacagctccaactccttctcgttccggacgctccagccgcggcagtactccgggccactggagtactgcaccacgtcgccgtcgacgtcgggcgcgtcgtcgtcgcggcagctcggcccgcgcaccgacaagcagatcctcaacgacatctacgccaaccggcaacgccgccggtgtcaggggtccaaggggccgccgctcctcggccgcctccgcaaggcggtggcgtcgctgctgcgcgccgggccgtgcggcttccccgagcaggaggagcccgccgccatgatcaacggcgtcggcgtggtgaggaacggcgaggagagcatcagccggaacgtcgacgcggcggcggcggacgacggtgcggagagggtg

SEQ ID NO: 1796 - DNA, 1501 bp, Oryza sativa
cacaagtgttcttgcttttttttcaaaaaaaaaagaaaaattattgctgcctgggtactttccttgcatccgtttagtgctactattcggctagagtgttggcagtttttccctagcaacaaagatctgttccaaatgcgcgaagtttagtatcgattcggtgtcatagtgatgaatgaacatgtggagttgtaagcaggtgccttcaattttgccatggatggtacaggccgtacagctagagttcttgattattatttttgttgggtagagtatatagttggattatatccagccttagctgagcctaacctttagctggtccttcaaagattttgtatatggggggcggccgtagttggcgactacctggcttgtggctcccattgcttcttcaggaaacccttagtggcttgtttggcatcttgaggaaaggggattgggagtttacacgagggaattgatggtgagattaagatggaaatttgatttttcatcccagtctcttgtttggtagaggtggtggaaattgacagggagtttagttggagattaggtcattagtgaaaacggatggctgagatttgtttaggcgaagtaaaggaggaattccctcccaattacctgcccctacccaggaattgaaaaggagggagttccttcctcaattccccatccccatcccaccaaaattcccatgtctcccaatcaaacaaaacagttaatagcctcatccctctaaactcccaatcccttctaaaaactccccccaaccaaacgggccgtaggtgtcagggcacctaacattcttgaaaagcttattggttttatttgaaggagttatgtttgttttgtcacacagcattgctctagtaatcaggtatggaaagtccacaagcaagaatcgggatcttgcctactagtcgtatgtgaatcgcatgtctctattgattgttgctcatacgacatgcctaaaaaggcttgcttaattaactgatgacgagatgtgtgaaagggaatatgcatgaccagtcatcatgttgttattaactatttatgcgattttcaccctgatgtttggtcctcagtcacgttatcaaccttttgttctccataagcattattatcattgtctgatgtggacctgtgaagtgttcattacttatcaggctgtgatatatggacatctcgccagccgagcttgcgatcaacatagtagatcctgtcacggaattcagtttgttagacagcctttatcctgccaggcatttgcagtgaattgtgttttaattcagattgaatatttcagccaaccaattacagccaatcttactataaatagtcatggacaaatcatttactgctttctgcatcctcccctgtttttaattagttgctctcacatcatgtacttccacaaatgtatcaactgcaatattaatatatgtaacgagcaatgttgaatttatttagcttgactgtctgccttgttgttacctgt

SEQ ID NO: 1797 - DNA, 1501 bp, Oryza sativa
aataatacagcattcagattatttccccccatatatgtaaactttgctcgtttgtttcttcagacatatatactgtgcatgaaggtaatgcaaatatcttacctgaagaaatccagccagcaccaccagttcttcagagaaatcaaggcctttctgcgtgcagaacaaaatagcagcaacgcaaactaagagcatacattgcagaacactgcaggcagctaagatcaaactaccatgctagtaacttgaaatgaaatgaaaatctccccgggtcagtgaggaacttcagtgttgctgtcatacacaaaaggtgagagagtgtttttcccccctattgacagttagattaattttgttcctacgaaaacagattgaagcttcttgcttccagaaggagtaattatcctgcgatctgtttgagacagagagattaagatagtgacttgagcgagtgagtggcagactggtaaaactggcgacctaacaaatgtctccatcgctcgttagcacatgcaattaagcgggatagtctccacatatatccactaattaattaataaacgttgaccagtatgatgtcgccaccgatatggacacagatcggcgtcgtaactggtcagagcaagcactaataattacgtcctaattaagtgtcaacaaatgctgcattatttacttggtcagtagaccactagaagccccggcctaagtactactggtactagtagaaccaaggtaacaaaattcttgaaattaatatcaaggtaacgaaaatggtgatcaatgatcaagtgccagcatgaatggttcgtacaacacttgcacctgctacgtatatactccattttgtagagttgcttgcagtttatagttcctctagaaatgcagacctggttggtcgagttgaatgtgtacaagtgttaattacctagagatcttgttgctagagaagaggtcgtcagagatatactactgcaacaataaatgtacatctttttgaagagaaaattagttttatatattcacgctagcaactgaagtctaaaatgtttgaccaaacatatatactctagatgtatatatagtagccaaactatttgagataaggatatacttacttggcaatgcataatttgctctactagttactctctttcttaaaaaaaaacttaattaatttgctagttgaccatgtatgtcgatggagaccaaaatgagtgagggatctagaagatgacacatgtgcatctctgattaatttcagcatgcatccaatgggtcgaaatgaaatggttcgtcagtttgtgcatgagcctgcgttgtcgcagccaaaaaatcgacgaggcaggcccatgcactagctaccttggtcaaccatggctgcagcttcaccttcactagcttggaccaagctaagcacagccatccattccattccatataacaagctagcgatcgaggccactcaaatccaccaacaagctagctgacaatcaagtca

SEQ ID NO: 1798 - DNA, 1501 bp, Oryza sativa
tatgactgcagcatggtgatctctcttgttccgctgatctgtaaccatgccctcaagcttctcatttatagccgcagtgcttgaaatcgtctctttggtaagttggtactttgactccttgccggccttaactgtaaatacagtttacaccaagatttcaggcataccatgaaccatttggcagcgaagtgcagtttaatttaccagacaatgcttctgcaagaccatcttccaaattccgcaactgaaggttgagtccactcagttcctctgcaccatccaaaatgttatgaaaataaatgcacaacagaaacacaaattttatcgtcgaacacccttacaggaaaaagaccatggacaccgactggcaatgatcaatgatcactattgaggtgctaaaaacgcaggggataacaaggcggacaaccccttcccatatggcttacaagggatatataaaggagaaatgtaggagccctaacagataaaagattagaagtctactaggaaactataagagaaaacgataatcctgtaatacaaagtcctattaggaaactcatcggaatgtattgctagctgaaattcagcaatatttaacacaaaaatttcagcactcatcggaggggaaaccgggtagagttacttcaattcactcaaattcaattcacattcagtaccaagtaccaaccacattttccaaataaaataaaatcgaagatacatcagacacgcgtccaaagttcatttcgcacaaaaaaaaatggggggtgtttattgaaacgagagagattgagggggtggggggagggattaggggagggcgttgccttggcgggagatggtttgacgggcgatggagcgggaggagagaagcgcggcgcggtagttggcggaggtggaagcttggcgctccctttcgacggccatcccgcgctggtacgccgccagctgcgccgccatctgccggcacagctccgcccctcctcctcctcctcgtgtgccggcggcggtgcctccggcttccatgctaccaactccctgggcactggcggcgtccggcgtcggcggcggagggatcggcggcagccgacggtggccggagtgcgggttgaagtgaggagttcgaacccaaaatttgtgagaagaaatttctcctttttggtctgagaaagaagaagaagacaaagcgggatccattccattgtgtgggcctttttgtgaagcgtattgggcctcatattgggcttaggcccagatcatcttgaagaagagctgtgcttttacccattttgaaggctaaatttgaccatattttctccactttactcatttgactctacatttcaaaaatgaagttattgtcttatcctattctctgaagcaagttaacggtgttgagactagagctcaaggtcaaaatgtcatttatgcccttgcttatttgacactactttctcacaggttctgttcatttggttcaattttgtgcccttactgt

SEQ ID NO: 1799 - DNA, 1501 bp, Oryza sativa
ctataaggcacaaatgtacaagtatgacatgagattgtgttggttagtgcattgaagataaatttgatttacccaacaggttatgagctcaaggattgtaaatagcaagggaaaatactttttatctccttttttttacattggttggatatggtcgtggcttttgaagccaaatgttgtccggtgatgggagaaaaccacttactctataccaaggttttgtagctgagatagcgatgatgcgctagtggtagatcaaacactcacgtatatctgatggatgaggattgtcaatagcaaggggacatactttttatctcttttttttacattggttggatatggttgtggcttttgaagccaaatgttgtctagtgatgggaaaaaaccacttactctataccaaggtgttgtagcttactatgtactacatacaattttactatgcatagtcgaccacaagatcaacgagtgaattcgatttcgtttagggttggcaagtggaaaaggaggaagattagatagactacaattaaggtgatgacagaagcatatgtactagaaatagcgatgacgcgctagtgatagatcaaactctcacatatatctggtggatgcgatcgtggtttgttttttcctctcagacaagtggattttagtttcaactagaagtcatagttagcgataaaaagaacggttggtcagagcaatgttttggagcttactatatatacgcacgtcagctagagccatgtctaggacaccctggtattatggtttatttattgttatggatagtgccatagtggaccacaaaattaacaagtagacttcgagttaaggcgatggcgggagcatacatagtggacagtgatgacactagagctagattaaacctgcatatatatggtactccctccatttgaaaatatatggcatatttttttggacaagcctttgactagcagttactttattataatatgttttttatgacgcaaaattgatgttatgagattcatattcaaaagtacttccttatgattgtgctagcttttgtgtcacataaatgatatatctagcaattgttagtccaagtcttgttctaagaaaacaaaatacaacttacatttttgaatggaggaagtatatatgtttgcggaggtgagggatataattagtaaggtggacaacggcttgacatgagtaccatcactacaacaaaaaaaaccccatatagaggcacttttggtagagacacttttttaattggctctaaaattaggagttttatagggtagagactttttagaggcactttgaaaattgcatagaaaacttttactatagagagacactttagagacatttttagtatgtttgattctattttatcttgtagagaaattcttcatgtactgtaaaaattgcatgttatgtaaaagacattttaagctatatagaggcacacctttcaatgttaattcatacttaggaacta

SEQ ID NO: 1800 - DNA, 1501 bp, Oryza sativa
  unsure (1)..(1501): unsure at all n locations
catcagtacagctataaaaaaaatagacatcatgcgtgaatcgtgatcgaaacattagttcttggtaagaattcgtctactccggctgatataattaattggtaaatatatttttcccaactgtacgagatcatgaggtcaatctttccggtaaaagtggactcttttttactttaccatggcattagctagcaggtagtacaatatatatgtacgatcgcaacaataactataattgtatcaacattagtacggatgaaacctttggcgagctaaaaaccaatataattaagcagatgcgattcattgatcatgactcatcaggtcctaattagccaacgaattaaccaattacctgccacgagttgaccagaaaccatgcgtgcatgttgcacaaattaaatcaaaataaaaaaccatacggtccagcatatncttcgatagatcataatatggctccgttagaatctgattatatgatgaatatcaagtgcgcacgtaaaacgagataagtcattagcatataattaattaagttttaattattaaaaaaaataaaaatggatttacttggtttttatagcaaaatacactgtttattaatttgaaaagcgtgctaacaaaaactgaggaaaaatccagatgttgtggatgttgttggagtttagaacaggacctatgtcataatatgatcaaaactggttaaaatactggttaggtcatatcatatttatagttaaaaaagattttagtaccagacaacatagccatcgataattaatgaaacaccaatatttaagatatacatgtagctctagtcatttgaagattcttataaaaatacgataatatatttataaaaataagtgtacatgtgtgtgaacgaacgtgtcttcgtactgtattttgggagaaaaatatatagctagctagaagtatatttaccggctcgatatgagatggcctaattaattaagctgatggcgacacccaaaaatgagcactagctaactagagaggaggttggctatgtcggcacggtagggttaaaaggttatcttcttttgttttatttttcttttttattttttagatagatgcattttgtgttccggttgatccatgtatcacgcttcaaagtgatcaaacccgacagtgactgcctgtcctggtacggcagcttatttgacgagagcaccccatggatcggattttacaatcatcaaccaagtttggctagacaccctcacacattatattgatataaaaatgctagatactaactcgatccgttctaaaatatagatatttttagagttgaacatgtgtattacaaaaagatagaattaaatgaaggttagttgtgattggttgagaagtagaggtatgtgagagaattgaatgatgaaacactggtggagaaaccatctttggtcggtcggctaaattccacaatagtcccggttctaataaaaatcgggactaaaaagcatttttagtc

SEQ ID NO: 1801 - DNA, 1501 bp, Oryza sativa
acaataatgatcatgataaagctaactgaaattactcttgatcagaaaagatactgaagtttaaagaaatagcaagtataatcatcagtggctcgatgatcttttcgaccgtgttggactctagctgacagtgggcggcagcgtacaactactactagccttctctttaacgaagcataacactaaccaccatggttgaaaaaagagacatctccacaatcagcttaatcatgaaagcagtgacctttttctctcctcgcaaaaggatcaataaaactactactcttaaggagggagaagaaacagattaactgtgcagagttgattcccaatggcaatgatagtgctggcctgagtgaagaacaatttcagagtaatagcctgcagtcaggtcaggtccaacagtacagtttactgacgaaacgtcgcggctgacaaacatgttgtctgctggtttgttcaaatcctgctaattgcagtatttctgatgcaacaaaatgttattcttagcagagggattatatggttgtgtcgagttataaccagctgacaaactgttgttggtctggaatctaatggtgattgattagctgtgtgttcttagcatcagagagacttgattagcatctcttttcttaattgggagtatcttgtgcggtatatgaggagggacatgaccgatcaatcgatggagatattgcttcctgttcacaaatcgctgccatttggccggttacctctcgaatcaaaataccatcaggtttgatcggtgcagcaaattcgtgaataaagataacgaaaacgacagctcacggacgaacaatcgacttcttcttgttacctgaaacaaggggaaaaaaatgagaatatcattggaactacaaggaaaaaaaaaacatttgactactgtagcacatcaattattggcactggagcatcacgtgaaaaggtaaagttatttccaacagtactggactgcagtaaaccgacgaggacgaataatatctcttgtcggttcagtttctctctagtataagattattactctgaaactgaaactgaaaaaaaggggattaatggccttggaaaaaaacaagtgattttcatctgaaactggaagcttccaagctcaactagcagatcaaggtcatggtgaaagaatcttgcaaataagggacaaatagagatatgattatctagattatgcaaccaccaatcaccagaacaagccaagacacctgatcattaccatcttctttctagtgagggcaccacttggggggaaatttagacaactttcctgtcatgagtcgccaatatcatcaagtaattattgcatacaagcttcaatctcagttgctgcaacttgcaaatatggcttttctcaacttaaaacaaatcatcacaaggtcatactgacgactgcaagccacgaatatcaggagaataattactcagaataagtactgagatcacaagtgcagggaacgaagcagggatg

SEQ ID NO: 1802 - DNA, 1501 bp, Oryza sativa
cgctgccgcccactgtcagctagagtccaacacggtcgaaaagatcatcgagccactgatgattatacttgctatttctttaaacttcagtatcttttctgatcaagagtaatttcagttagctttatcatgatcattattgtcgtaacgtttttagctctgcagctaaaagcatgctagtcggtttggttgaggctttttctttcttaatgaaaagccgtggggcggtaattccctagtgcgtcgagttcttgtttttatttcggccaacacttttatgccgtgcggaggattatcccctcgtttattcaaaaatcatctgtatagttatgaaaaaaaaatcgaaaacaaaatggacaacattcatacaacatacatatacaagtccacaaaattttactaaactcaactcacacatcaagaaataaaaagaaaaaaaaaatccaacgtatgaacaatgctggtgatattcacacttaaaatttgtctttctttcccctctcaatttgtaggtcaggtttgaatttatttttttagtagatgcttaccatactctagactattaaaaagatttagaattcttttaaaaccatttgtactgaatttaagagaaaaatgtatcacgagggaatatcctggagggattataattcatctccttattatttagcacttttttttatctacagagttgaaaggacatggcatcacaattactttcatctttcatgctcagcctcagacgtctaattggctagtatactagcttgttaggtgcaaagtcaagcaagagaatttcaactgtggcggtgtttaattctctttaaacttctaaaaattccgtcacatcaaatgtttaaatgtggacaaaaaaaaaataattgcacagtttgtatgtaaattgcgaaacgaatcttgtgagtctaattacgccatgatttgacaatgttgtgctacagtaaacatgtgctaatgatgtattaattagatttaatagattcatctcgcagtttatatgtggaatctatatattttgttattaatctatatttaatacttaatacttttgtccgtgtatgtaaaaaaattttgaccaaacaactgaacacggcctgtatatgtaaccaaagaaagatcaaaggagaggaggtagctactcctacaaagaaagaagaaacgatgagatttgattgcctactactccagctagctagtatacagtactcatacgtgtctatccatattcctgctcccaatgcaaaaatgcaatggcgagattgcaaggttgtgtgggtggtggaccctggatcgatcacctccattctttctccgcatctcgccacagtacgcttcgctgctctcccgcctatatataccacctcctcctcgatcatcagttcatcagcaaccaaagcaagaagcaattcttgagctcaatcagcaacaacatctatctccttcttgcttagttaagtccttcgccctcccaagaagaagaaga

SEQ ID NO: 1803 - DNA, 1501 bp, Oryza sativa
tgtgagtcagctagctgtggagagtttttcttttgttacgatacaatgtactagttacacacacatatactatcagtataaatgattcaaaatatttaaattggtttgttgtttgacttaaatagaatgtaatataaaattgaatgaggtaaaattgtcttttagtcctaccacatgaagggcgattcgattgcatgcggatgatcaatattcatatcggggtatatatatgtgaacatgtgatggatgcttgacatgcatatatgtgcagcagttgatactactccagttatctcgatctactaattgatcaatcaattattgttccgcttacacatacacgtatatatgtgtgtgtacaacgtgtttgttcactgatagtgtcgtgtgaggatcaaaaggaccacgtaaccaacacgtggccggccggccagtagcaatatatatatatagagtagaacttaaagagttgaaaatatcatgtacaatcatcgatcatgcgtatatattcctgcatgcatatagagttggatcgatcgaattcgatcagcacatgaactactctcttgttatacatccactcatatttttatactcaatcactcctgtatgtacctgctgcctgctgcaggttccatcgtgtcctagaagtagatgagatggatgttcctgtcaacaaacaagcccaataagagacaagatgggctggtcatcgcatccagtgttctatgggccgtatcttggaatcgggtcggctatgcggattgggccggcccatttacatggaatatcatataagcgtgcatgtgatcgtacaaagcaaaagttttggcctggccctcaaaaaagagagaagaaaaacagagaggttaggttagtttggagaaagttcctagccaggaacaggaaggaagaaggcacatgcagcagttcaaaattattagaggctgcacatcgcactctatcttgtgcaagactcgtgaccatcaaatcccaatctaacaattgtgattcaacgtatgtgtggacaacatatatacatagcaaaagaaattaaagaaaatgtgtgtgaccacacatacatcttgttcaattatttttctcgtgaaaaacaaaatcaatggacggccatgggaaaaagagataccagatctgaatcctggaggtacatgtgattggctcacaaattattttttttaaaaaaaaaagctcaaaagaagttaaggtgtgaagaagaaaacaaaaaagaaaagcgaggcgaccacacgcaagacggccggacagcatcggcgatgtgcatcgtgtggtggtcgttgccccatccactcccccgcagataagccaaccagtcgccgctcgccacgtggcaccctccacctcccttcttattgcctcagcctccttcaacctcacgctcacattcttgctagctcactcctctcctcctcgtctaccttacctagcagcagcagctagctagcttaattagctatagcagcca

SEQ ID NO: 1804 - DNA, 1501 bp, Oryza sativa
aaaatttgtctcaaaatataagaacttctaaagtagtaatttatctcaccttatctagtgcgtactctcccaagccactcgcccatcaccacccgaatatggattagaccaaaaccaaccggcaattaatgaatcgggactagccacctatttaattatgagtattgtgaacttttgtcttgctactcatttaatttgttctaaaattactagaagtccttttaggacggagagataaaatattaaatgtgtaaatactttggtcatatactctctccatcataaaaagaatgcaaacttgcatctaaattttgttagaaaaatataattatatagagagtagtacaactttttcttgcaacccctagtttgaattaatttcttattatcttacccctaaaatcacccttcatttatattaaggccggcaattcatgttatttaatttctctttcctattaatttttctttcgaagttagaattgttctttttctttggattattgtatcattccagcagtcaagaggaaaaaaaatgatgttgcattgtgtacatgtacagtgcccctggttgcacaacagctggccataaagcgcaaaatgcatctatataatcgatcgagtgaggaacagtaactcacgtctgacattttgatacaataatcctcaaagattcggtgaaattttctttctgatccctcgagcactacgcgcactgtgtttcagtctcctcacatatcatgtacatactacatatacgcatgcatactgcatgcagtatacacacaacaataaaatatatgaataatgtgttttcgtattgatctgcaggtgtgtactgcatattgtgttacatgtgtgcgcatcacaaagcaatatatatactacaaaattaatgctttgacgatatcatcagatcttcaatttcttatcgcatgcatttcataagtgtatttccaaaggaatccaaacaataatttcacttcatatatacttatgcatttcataagtatatatagagagagagagcatttaatcatataaaccaaacatgtgcatatgcgcgcgatttcagcaaaatagttaatcgatcatatattagatactttatggtgcaaaattgcataaagcaaagtggtaaaatacatggttagtcgtgtgcctcacaacagaggcaagagatgtaaaccattatcgctattaaatataaagaaatggtaatatgtatgtgctagctaatttggcctgattaattgcacatgtgtttaattcgaaaccttggtaatatatagctaacatgattatattgggcacatgcaaagtgtgcacatgatcatgtgatcgatcaggacaagatttgtataggtccttgtctattagatttgttaggttagcagcagatgcacgccaaaagcaaaaggctctgccctatatttgtacatgctcaatcattaaaatttaatttgttgagcaaaactagctagccaccaggacagtgtca

SEQ ID NO: 1805 - DNA, 1501 bp, Oryza sativa
actcgtaccacagaaaagacagtttgggatggttaaaaatccggttgggtctcaattgggagaataaccgtcacgccattagaggttgtgtattacatttgctattttgatcgaattcaatccccaaaagcaaccacaaagtatactagtgcaaattagaacaacaaaggctagctatgctgattcaacggtttcttagcggtgcaaacatgatcatgcatttatgctaagctttggagctgtggggtgtgaatgatactgatcattatcttctattctgtggataattcagtgcactcctgtattagtatactatcatttgaagatttctgcaatcaatgtactaatattaattgtgcaataacaaagtttaagctgcctttgcccatactcttgtatgattgagttgaatgcttcatctcatgaattgcactaactggaaaatagccgtctttaactggtgctgggaacatccttaatgcatttcttattgtgatagtgtttttttctcatcaatttactccagttttcagaagctctgaagtcctgccaatggtacactacgtacgatacgtacatatggcacttctctgcttctaaaatgagcatgctccatgcattaggtggccttccatggaagatttggcattagattatttgccggatgcaagtagttctatgtaactggaaagacgctaagctttattagctcaataaacttgagttcgacaattatcaggagtaagcacgtgtcaaaataattggtttgccatggagcacttacccttctaactgcacattactaaatggtaagaggctactccatctgggagttgaggggcaatacggaattatttgatcgtgtagtagtagtagtgcaatcaaaagagctatttaccccccaaattcttgtgcgttttggagtgaattgaataattcctgtcatgagtcttactggttggcctggccatataatctggtgcttattaattttatcccatgttattagttccttaaattacatgtcatagccagaacttgctatattttgggacataagtagtatgcatgacgtgcaggagcaaagcatttatttgcggaagagggcatatatcgcttggtacaagttaagtatgcacggcctgctatatatagcttgctaaaatgctaataatacaaattcaagagcacaactttggttccgaagcactaccttaaacattaagcataacaccatgtgcacaaaattaaagatgatttgattctggggagtttgagatagattcaaaacaggactctttgaatcaccgaacaccggcccatgccctgatgcattttattggcctggagctctgaaatcttcccatcggtgaacttgtttattccaagtcgtctgcgggacagaccatctctgatagcttccttgttagctcgatctgtccacaaggagcacacgtcgatctcttgaagatttcgaagcgctcaaccatctcagccagca

SEQ ID NO: 1806 - DNA, 1501 bp, Oryza sativa
tagcatccattctcattgcaaccattccttttttgtacccacatttctttaaaatctagtagtaacatgtttcttcttatcttagatattaactctgttccagaaggcatacatcgaagaagcaacaaatcatatattatgagtctgttcttgaaatctttaaaagacacaataattataatatggctctaatagttaaatataaccaacattgcaaattttttaatgaatataatgtctattttagcaaaatctaaaatcaagagtaaattgcagtgccggtacacgaacttgtcaggtgggtgcaatttagtgcacgaacttgcaaaatgctcgttttggtgcatgaacttgtctggtgcatgtggaagaagacgaaaaggacactacatgtctaatcttagatttagaagcagattaggatactatatagacatatatatatatatatgagaaggttgctattagatatacacatcttcaataaaaaatagaatagtatatagtgataggagaaaaggattaaaaaaaattcaagaaatgatataagggttagaaatatatgaaattcatcatttccatgatgaaggataaagtagagaccaaatttataaatatagcatttcttgtgtatactcactaaacgtacgcacgttagatcctaatcaacgtcagcttcataaaattaatatttccaagttattctggtcctcgttcgcataaactagacaagttcgtgtactgaaacgaacattttataaatttatgtactaaattgcacccacctaacaagtttgtgtaccgccaatacaatttactctaaaatcaaaatcaagtctagatcaggcaaaaccgtgcaggcagtgtttaatgatatcgaatgacaccatgtctagataaatcttagcgatggtaaaatttataaataactaatatgttgtttggattctctacataaaaataataatccatctgttcaagtaaggtatctaaggaaagccaatatttttttaaaaaaattgagtgttacttatgtggatcgttatccgcatctctcctccacgatgcatgtggaagaattagggaggatggaggcaccctgaaccctcactatagtttccatgctttcttcatggtttgtttttggtagctatggaaccacgggtacaatgtggtcttaagaaacgaattcgcatcgatacaaggtattatgctctacatatctgtgttgaggatgcatccttgacttctcgtgcgctaaacaaatgcaactaacgaacaccatgtgttgtgtcgtgctagtaacaacaattctctctcttgctcacatttcccttatcaaatgagacaattcgtatggtgaatctctcccacattgacctttctaaagaataagcaatattatctatgtttttattaataacattttgtagaacacactgatggaggggtataatactttttaagagagacataaacacaaataaaaatttactcatat

SEQ ID NO: 1807 - DNA, 1501 bp, Oryza sativa
  unsure (1)..(1501): unsure at all n locations
taaggaaggcgggtggaaaagaagaacaggagagaagcacagagaaaccgccgcccttttaattttccccccatcttgccgttttaaagacgataaagaatttttgccaatttaattgcaccgattttttaaaaaccctgtgccgacttaaaaacttaattattttttggggcagagttaaggactattgtttccataggaagtgtggaagcccctatataatgttccgtaaaaaaaaaggtgaagatgttttagaattgctgcggaatgagttgaggtttttgggattatccagagggggtttaaatgtttataaaaagcgaagggngccaaacatttcgaaacggagggagtatattgttttactgtaatcattatgaattactccctccatccataatatgagggattatgccattttttttgtaaaaattaagaaagtagtggtagatgaaataataaaatagtataaaagttggtaggtggagaataaaatactatcttggaaacctaaaatctcttttcagaacaatttacagatgaaaataccttatattatgggacggagggagtaagttgttacagtaccactatctatatatagcaagagatgcatttatgatgggtgagacatgaaaaaaaatgtcaattcaaaaatatgcaatagtgatatttgactacaatctaagtttgcctttttaatatgcaatcatgtaaacatataatatatgtatataattcgattcttaatcgatactatgataaagcctaagtagtaaaattggcattttccttgtaattaattagtcctatatatgcttgtgcgttacaatgggatatgaagaaatacagaaggatggttttatgaggttcaattttctttgactggtttttctagtggatcatgaaaacactagtttttttagtaggtctttttttaggtagggtggttttcctttttatggggtgtatgatggtggaagaagagaagaaagacgacttccctttatagtagtagagacaattaagcaaaggataaaagctttcaatatcacatgatagtaatttttcattaattaattcaaaaataaaactattatgctacataaaaaaatgtgatgttttaagattgtgaaagtccaatattttaaaaattcttctaacatctctcctatatggatagctgtattagattcaatgaaacatcgatcatgcgtgcaagtttttctctaaaaaaatacgtctcaatgtcacttttgcacaatatatagctttatagaaactaagggtgaaagttgaattttggggaacatgcatgtcaatgtccaagaaaaaaatgtcatgtttgcgagggaacagagagcacgaggggcggatataagagaggtaggtgaggggtgacaaacggaacaaaaactcctatacagaagaataacaaataatagcttaagcgtaaaatttggtacctctatcggtatcttaaggaccataaaaattctca

SEQ ID NO: 1808 - DNA, 1501 bp, Oryza sativa
tggtggacaagaatgaccgatttgtgaccggtctgacactgatcatgtcgtcggcagacagccacgttcccacgacgcgcctgcccccggcagaagtggaggtaggtatgtgccgtcccgtcagaaggacgttcggagggcaaccgtgcaaatctccgtccatttatgaagagaagaaaagtccagtttggaaagggagggtgcatgtggtatccccttgaaatataaaaggaggacctcgcccatggagaagggggattttttggattctttcctgattcggaacctagaacaaagggggaggttggctcacactttgtagctccttgatacacagatccaccaaaaacacaggagtagggtattacgcttctcagcggcccgaacctgtatacatcgcttgtgtctcatgctctttcgataggtcgcgatctttccacgtacagagagagcttgggatctcaccctgagcccccggccgaaccggcaaaggggggcctgtgcggtctcccggtgaggagccccacgctccgtcatatatatatatatatatatatatatatatatatatatatatatatatatattatcagaatataatcatgtaagatcttgttgtaaagatttaattgtaacgatcataacggtatatacagattataaattagataagtattttaagagaaacttctctaaaaatatatatatatagatattgagtgtactagtagcttcttttggaaagaagagtgtctctctttaacactatctaaaaagaacaccatgtcacatccaactaggccctcctcctctttgatcatctcataacaatgcggctatgacgtctcctgagggaatccccacccgatcggaatcacaagagagattattgacttatcaccgatcagcagaaaagagacggcgaaaagcaatgaagaaaaatataaaaacttcaagataagaaaaggaaagataaaaaataaaaaaggaagaaagattcttccaagccgcccatggcgtggttcgaacgcgaggtgatgccctccctccgcagccgtacacgtgtcccgatccccagaccgaatcgacggctgcgactctcgtaacacgccaccaccgcctcgctcacagacaggtggggacgggtcgttccgggacccaccgtcagtgtcacaggtggtgtctccgcgggtgagagggtgaggcggaaacgttgttagcagcgtataaatgtaaccaaaccctaggattccaacgcgagcttatcacttatcatcaatcggcgcctccctctctctcgctcaccgcctccttctcctcgcgatctatccaaacaaggtaatttggggtggaaatccattcggatttggttcgtagtccaattgcttccgtaccacacttgctcggtttcttggtttgggaatttcgtttttttgtgcaatcttgtttgatttgatgtttgggatttgattttgttatcaggggctcgctaagatcggca

SEQ ID NO: 1809 - DNA, 1501 bp, Oryza sativa
taataccctactcctgtgtttttggtggatctgtgtatcaaggagctacaaagtgtgagccaacctccccctttgttctaggttccgaatcaggaaagaatccaaaaaatcccccttctccatgggcgaggtcctccttttatatttcaaggggataccacatgcaccctccctttccaaactggacttttcttctcttcataaatggacggagatttgcacggttgccctccgaacgtccttctgacgggacggcacatacctacctccacttctgccgggggcaggcgcgtcgtgggaacgtggctgtctgccgacgacatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgcctcctaacccgcgatctgaccggtctgtgactggtcacagaccggataaacgagtgcactgcactgtatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgaccccccctcggggagaccaagaggtgggcgcacacatcaccctcgggcccgacgtcccccgagggtgccaggccacgtgggcgattgtgtctgcctcaagcctctagtcgtgatactcccggtcccatgtcaccgacagtagcccccggcgttatgccagggcgatcacctttttcaagggaagcggtcgggcgtgacgccatccctaaagcctggtgacaagtgggaccggtctctacaaataggcagaaacccaacggtcacaaactacgcacatcggcaatggtaactcggctgtcagtaatgagcggtctcttccagactgccacattactcgagtagcacacgaatctggacatggcgattcgtttcatctgaagatatggtaacgtcgcttcggttggcgagcgtaattaacgcgcgcacgatatgatctacctcgaccgccacaaccacatatccacctcatgcgccgcaagcgggcgaatgggattagtggaagcgtgggcgcgagaaacgagggggcgaaatagtgggcgcgagaaacgaggagccgggcacagcattggcaagggtataaaggcactgggaagggatttgtttccttcctttcgccattattccccttgtctttaccgcttgcgccctaactccttcttccctgcgcccttctttcgccacacgcgctcgctctccatcttctcttcgtccggcgcca

SEQ ID NO: 1810 - DNA, 756 bp, Oryza sativa
gatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggcttt

SEQ ID NO: 1811 - DNA, 511 bp, Oryza sativa
gagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 1812 - DNA, 1501 bp, Oryza sativa
aagtcaaaccatttcaagtttatagaaaaatatagtaatattatcaaattagtttcattataaatatataattgaatatattttcataaatgtatttgttttggattgaaatttttactagtttctctacaaatttgattaaatttgaaactgcttgactttgactaaaatcaaaacgacttataatataaaatggatgaagtatttacttgcatttgactttccatgttaccgagactgtaactgccacctcttgtttgcttgtggtatctgcatccaactcgtcccgtaaccatgtaactggcacgttcccgctgaactggacacatgttcttcacgaaaatataatgtttaacagtttagaaagcgtgtctacaaataataagaaagtagctcagccgtgtagctagaagaatattgtttacacgtagccctgctaaaagtaactagaagaatattatttacacgtagggattaacagaatcatctaaacacaaaatgacaaataaaaacgtctatagtcaagaaaaaaaacattttctcacgtgcctctaccttacttttgattttaaatttttttttcttttacaagacacaaacgtagacgcttatatatacacatacgcagtcacctctataaatatgcacacacatccctacccctataaacacatataaagactgagccggcacatgcatatcgagattgatacacatgaacgtatcacacacctttacccatatgagcacatttaaagactgagccgacatgcatattgagagattgatacacatgaatatgttgcacacccctacttatatgaatactgagccagcacatgcatcttgagattgatgaaggtgtatatattataattgacgaactcaccgaaagtgtataactcgagattgacaaaggtcttatcttattgttaaagagtacatcggttatttatgaaaaaaaaaccgtaaatacgagcaacagtactaatctagaatttaaactcacgtcaactcgttccaccacaggaaaacctatggcgcccatagaatttttgcatcatgacatttgctacacgccaacaaagtgccgacatactggtcaactccacgcaatattccatgtctcctatacatgcgcaataacaatatattaatggctcatataatccacagatatactttgtaaaatatcagtgtttgcctctctgtttagtcttaacggagacggtatagaaagcttacgtacatagcagagaaagcctacacatctgaacggaagacagcagacaaacgcctacacatctatatagatatgcatttctttttacccttcttataaaattttctctaaaattacttatccgatatacaatccgattacaccattgtgttcgttacaattaaatctttacaacaagatcttacatgattatattgcgacgaaaaaatatttatgtttgtaaattacttttattatatacgtaagttacttttatca

SEQ ID NO: 1813 - DNA, 1501 bp, Oryza sativa
gtagaatactccgtacgatatcgaaattgctatacgtccgacctatacgtccgactagtgtatgtataagcatatatgctgtttgtctgggcccacatggtagtaaacaagttcagtgattggttgcatgactcggtcggacacaaatcgtacggctcggacgtacgtataccaagattcatacgatatgtatcgtacattggtacgtgtacgacggccgacgggagtatgacgagggaaaaaaaatgaaaaaggaaaaaatcaaaattaccttacagatcgctatgcctcaaaattgataaggacactttcgataaatcctgaccgaattttgatcaaatttaatgcttgacatttaaatttgatcaaaatttatcataaaacattaaattttgcaaaattataatggcatggttccaattttcccttaaatttatcataaaacattgaaaagtccaaccaaatactctctccgtcccggaatataaggtattatgcctaaaataacaaaattttaaggaagagtaagtagtacattctctgaaaagatatcctaggcacaataaacaaattagtagtaccagtacgttttctgaaattatttttagtttctgccaagaacagtgtggagtagtagtgctagtacgttttctttatctttttaatcctgacagaaaccggttgattttggatggctgacattccttggttgtcttgaaaaagagaaatccactgtatttatggacaaactaatgaaacaaagtcccctatatttctggatagagggagtattaatttcgagccacgttgaaacatggaaaaaccacgaaaaccgatcggctgtcatctgctctgtgaaccctgcctgttactagtatctagcatgatgccgcgcgcacggtggggtttggagctccgcccccagagaattttttttatttaatagtgatagaacgaacaatgttgttcgaccacagagatgtattctaatagctcgagtggacgtccacccgtttattgcatgtcaactagatggttacgaaaaattttcaaaaaaattgacaagatagatcaatatgtaatattgaatattccaacccaaaaataatttcaagccacatcaaaacatcgaaaaccgtgaaaaccgatcggctatcatcggccttgcgaccctgcctagagtggaaatttttttatttaacagtgatagaacgaacaatgctgctcgaccaccggttgttggcactctacttccctgcttagacgttcttgtttcctgctaattaaccggtgtggcggtgaccaacaaagcattgcatacgttctcgtacctgtcccttgtacacaggatctgcgcggcgctctcgccaacccgactagcttctttctcaaccaaatcatagacaaaaacacacagaaaccaaccactactaagaatttaagtaagaacacttgcagatcaaccactactccatcaacgcgcgtgtgtttgcgctttccg

SEQ ID NO: 1814 - DNA, 1501 bp, Oryza sativa
gatcagtttgcctctatttctgtcctgagatgttttgcaatgtgaattgacaaatgcgtggtgtaattaatttataggccgcggaaagcgcaaacacacgcgcgttgatggagtagtggttgatctgcaagtgttcttacttaaattcttagtagtggttggtttctgtgtgtttttgtctatgatttggttgagaaagaagctagtcgggttggcgagagcgccgcgcagatcctgtgtacaagggacaggtacgagaacgtatgcaatgctttgttggtcaccgccacaccggttaattagcaggaaacaagaacgtctaagcagggaagtagagtgccaacaaccggtggtcgagcagcattgttcgttctatcactgttaaataaaaaaatttccactctaggcagggtcgcaaggccgatgatagccgatcggttttcacggttttcgatgttttgatgtggcttgaaattatttttgggttggaatattcaatattacatattgatctatcttgtcaatttttttgaaaatttttcgtaaccatctagttgacatgcaataaacgggtggacgtccactcgagctattagaatacatctctgtggtcgaacaacattgttcgttctatcactattaaataaaaaaaattctctgggggcggagctccaaaccccaccgtgcgcgcggcatcatgctagatactagtaacaggcagggttcacagagcagatgacagccgatcggttttcgtggtttttccatgtttcaacgtggctcgaaattaatactccctctatccagaaatataggggactttgtttcattagtttgtccataaatacagtggatttctctttttcaagacaaccaaggaatgtcagccatccaaaatcaaccggtttctgtcaggattaaaaagataaagaaaacgtactagcactactactccacactgttcttggcagaaactaaaaataatttcagaaaacgtactggtactactaatttgtttattgtgcctaggatatcttttcagagaatgtactacttactcttccttaaaattttgttattttaggcataataccttatattccgggacggagagagtatttggttggacttttcaatgttttatgataaatttaagggaaaattggaaccatgccattataattttgcaaaatttaatgttttatgataaattttgatcaaatttaaatgtcaagcattaaatttgatcaaaattcggtcaggatttatcgaaagtgtccttatcaattttgaggcatagcgatctgtaaggtaattttgattttttcctttttcattttttttccctcgtcatactcccgtcggccgtcgtacacgtaccaatgtacgatacatatcgtatgaatcttggtatacgtacgtccgagccgtacgatttgtgtccgaccgagtcatgcaaccaatcactgaacttgtttactaccatgtgggcccagacaaa

SEQ ID NO: 1815 - DNA, 284 bp, Oryza sativa
ccgcaaaaaaatgaaaaaaaaaacgcagtctggcctatgccgccccgccccccctctcctgcgtgcgacacgtgcccagtcgtgtgcgcgaattagggatcgctccatggcgaaaagttcaggacacacgcatgggtttttgctatataagaatctagatagatacctcccctgtgatgtgcaggaagccactcgagagctttctctttctgtgtgtagtgtgtgcaactaggaggcttgttccatactagtttgctaggtcatggaaaagagcgagattttcg

SEQ ID NO: 1816 - DNA, 1501 bp, Oryza sativa
cgaagcagtcaatgccacagtggtcgttgccaatgaagtgacagctggcctggtagaagctgttgacttggcttgtatagctgcttcgtacgcctggtgttgctcctgcattcggcgtagtgtgtcttgccgcatggttttcatctcccctccttaggcatgtagcctagtggttgcagtgacctgggtagcaccataaggttctgagttcaaatcttcataagagcaaatttcagattgggttatttgagggttaagttccctatttgataggctaagttctaaattgaaaaatactgcatttatccggtaggatatagaggccgggtaaaaaatatccttctctaaaaaaatctccgctccttgggctgccgaagcgtcgatttctggactaacgaaagtagtcgccgcagctatggttggggctgctgaagcgtcgacttctggactaacgaaagtagtcaccgcagctatggttgaagcagtcacttgagttgtggtcgcttcgactcgagcttcgccctctgctctggcaggctgaatcccagctttgactcttcatgactcggcttcagcttcggcccctgcggccaatttgcccttgctcgcctcgacttctccttcgctctcacacctcatccgcaccactttctcactcacagacttatttggtggcatcagtgatttcggctagggttccccatgatcgtcaccagctgttgtcgaataacaactgtgtttactaaatggcagggttcacatagtggaaaagcaaaagcagtttattaagattgaaaattttgggatttccctaatacatgcccctttgggcctatttatagattacatgccctagggttacatattatagaggaatttacatggttagtcttatgatagcgatatttagggcatctgtagtatttggttcgactgatctgatccaagagccgaataaaatttcagtttgatagctgtagcgttaaaattgctttgtgggacccgcaaaaaatgaatcaaccaatcactagtctacctttcacgcacgtatgcatagtaaaataggtttgtactagttcctttcgactccaatctggagttcgatttgttatccgacacatacagttcgatagctacaacgtgcatggttcagttcttttgctgtaaaatcgattttatgtttatgctgcagacgctcttaattaaaaacaaattggtcatgggcccctagttgggctgctaagtgggccgtccttgacggttcggcccattcttggcaccgtatatcttcggcacggtggtggcgatggcaaagagctttgtctttgccttctccttggtgcttcgccatcttgtttcaccaaaatggctctgccttgttcgccagtgttgtttcggcaggttcagtcaaaggccctcgtgacatgctttcaacgtataacttgaatgaaactaccagtactttatcacgatctgacttagaacaatgaaaagtgatata

SEQ ID NO: 1817 - DNA, 1189 bp, Oryza sativa
aaaccatggataaatttgttacttatggtgttgggcctattaaagtcattagacaaaatttaaaggcgagaagtccatgtatttttggtattttgggacgagggagtatatagtctaattattacacaaaacttttataaaatcattattaccttcaacccaaaatataagacacaaccttttcttttctaatgtttcataatataatgcgcacatacatgcatgtaattaattagcatctttcttctaaattcattttatttaaaatcatccacctttaagatctctaatcctattaggtgtaaacattatatttattgaagtggtaccagaatgtgataatagtattgtatttatagagggagtacaacacaaacttaaaccaacaaaattaatgacaagcataaattactaccctacctgattggtcttaattttcactggacacaaaattaaaatccattaggaggtccatttcaattcatgatttctacataaaatcaaactagctcatggccttccaaaatttatatactgtagatgagctctaattatgcactgtctataaactaaagcgcgccaaatggcgcgcctattttctagtatatttcttttttttatttcctatatctggtggttgtgtcatgcaggcttcggacatgagcaagttaaggtactctcaattgcattataagctcaatttgtgccatttagttctattgatgtaatctctaaaattttgttagtggagcacttcaagttgcttatgaggaagaccaggtagatggtagttgtaattctactttcacctaaaatcactttttaatgcttttattgatgaggatctcctcttttaataccactaagtgtatagctatttggtagaggttttggtaaaaaaaaaaagttggtccctccaatcaacaattttcgatgttgggagtttttagttcagtactctagaattctaaagttggatacacatatccatgcatactgctttagagatcatagcctctgcttggtagtatgccacaattttttccctaatgtttgttttagttcaaacgttaagtggacatgctcttatttgcagtggttttcacggatgcagagctattggaatttggaacaaactcctttgattatatgttatggacaacaataagaacttcaaaagtaggttttg

SEQ ID NO: 1818 - DNA, 1501 bp, Oryza sativa
cttcgctcccatcccatacgcacgtacggatcaaacatgccccttgaactagatatcaaatccgatccaaataaatcacaaaatcacaaatccattgaattacaaaatcgcaaatccaacaacaatgaatcaaaatcttccaataaaaattatatcaccggtgccattgttcatcggagccgaggacgccgctgccccgaggccgtggtggcttggcggcgcgccgccgtgcgccccgaggagggtgccgccgtgaagagggtgccacttctgtgccagagaagaggattcctcggacgccacccgccagggaaagggcaccgctggctgggggggcgccgaccgccaaggggagggcgccgcccctcgggggaaaggcgccgctggcctggtggaggatgccacgtctgaggcaccgggcgccgtcggccgggaggtcgccctggctgaggggtaggaagagcggtgccgccggtggggggaggaggagggggactgggggagagggtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgccaggcagggcaggcggcgcgcgtgcacgacgtacgtgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaaccgacccttctctatataaaccgacttgccgtcttcacgcaacacttgcgaaatcaatctagggtttgtctcctactctgtactgcgccggcgctcgtagactactccatcccgctcgccggcgtgcaccggcgattgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgacctagcaaccggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttacta

SEQ ID NO: 1819 - DNA, 1501 bp, Oryza sativa
aaacaagttcttaaatatgtagttttgtgatagattgtgctaagtatatgtagttttatgaaatttactcaaaatttaaccaaataaaacatgtgcacaatcaattagttgcctttgacccaaactagcacatttactatttaggttggcaaaaaaatgataaggcatatttagtatagtggtatcaatccaaaattaccctatatataaaaattttacttatataagtcacgggttaaattggccattaaaaaaccgccaagctgcatgaagaacagtaaccaaggaaacgttcactcattgcagaggtgttgccgctggcatagcaaagctctgttgcttctatttcctaataaggtaaaatggtttattggaagataaaaaatattttatagctgaaatttttatatacgtgttattagcaatttaaatatcaatgctaaaatatatgttgaaaatatcttaaaaccaaattcaaaattaagtttaaaaattcaaattttaagacacctttgaatcacatcaataaaaaatagaggaataggacaaacatagaattataatataaatataagtacaaaatagaggattgcaaaatagaggaaaaacacgagaatacgatgatagagatagacttaaaggaaaatttacaagagattaaaattattgctaaatttcctccaaaatctctacagtatggtttatttcatagaaatttcaaaggatactctaggatccaatcctttgttttaaatgtcttcacagaaaatttttcaatagaattaaaacccttcaaaaattttaacgttttctgtccaaatcaaagataggagtacacatgttagggcaaccaatagagctactcagtgggtgtttaggctgtgtatagttcagcgtaaagtttggattttgattaaaattagagataatgtgactgaaaaaattatgtgtatatgtcaggttaatgtaatgaaaaaatactgaagtttaaagtttggatccatacacagattgtgtatgatttagatcagtatcaccaggccctcataggctgtgacctcaaatttacgagctctgctccagcagccgcattcacatttcacactcacggcgccaccccgccattgtgcgtgcagcacgacatgctgtgctgctccactgctcacacctctgtcaacctgcatcccatcacattcaaatccccatcccttctcacgcaaggaaaacccccctacttcttcctcctctgaccagcatggccccaccccacacactctccacacccgggcccacccccacccgcttccccagaaatattgctacgcctcctcacgacacctcctcaaaagtcgcgcccccgctccggcccactggaccaagctcaccgcgctcggcccatggctggacccctccctcccggctatataaacctctccaccaccccgcccctaccaccacggtgtggcgaaggtgtcactgacagccatggcccacaagcgcg

SEQ ID NO: 1820 - DNA, 1501 bp, Oryza sativa
ggttcaaccaaacagtttcagctctatctaaactaggagagaggtggaactagatttaggctgtttcacagcttcactccagatccaacttttagagttaaatttagtagttaaagttctatcaaatatgaccctagtcttctacttagtggaaccaaaaacgtctagaggttttccggttagctccacaagactagcctggattcaaagccccacctcttttatttatttgatatttgattttccctaatattcatctttttttctacttagtggaacgaaagtacggctgtgaatagtcacactcgagcgaattcctagcatgcggattagctgggaccggtattggaaggacatattcgtaaaaatcatacttaaattgtttataaattaatgaaaacatattagagataaatataaacactacgataaaatcgcaagttcacactcaactttatttagtcataaaaaaagatgaattttgggtgaatggtaacacgacaatatttatgtaaaatctattatttttgcttctctcaagtgaagttgagtttaaacttaagattcggcgagaatgtacgtatctacacccgtctctaataactttttcgtgactaaaaaaaactttcgggttgattttcacgagctttcaactcgttgttacacgatatttacccggtatcggagctgagacctgcatggcttcttctccgccagattctctgaaacgacacgaaacattgctggacctaaggatggtggtacgtacgaccagtactcccagtctcccaccgtggtacgtacccccacgcacgcgggtcctactaccctcccactagggtgcgtgcgtgcgcgcgccgagccgcgcgcaacagcgagcgagcattccaacccccgtcgtcacgcggcgcccccaccaacagacgcgccgtgcacacaccggggcggggagcgcatctgcgcatgtgaaccgcgtgtagtaggagtgtaggagcagtgcgtgcgtgcgtacgtacggctcgtcgcgcgatgccgccgcagtgtcacgcgcgcgcagacgagagcgattagcggccgagagcaccgcggagagggaggagaggagagcagtgcgcggcaggggccgacgccgaaccgagccgagccagctgtatcccaccattgcctacctcccccgctgcggcgctgccccctctactggcacacctgcaatagggatactgctatagtgctatgccctctcgagaaaccgagaggccgagtgccacctttttcctggcatcgcctgaaccacagggcgagtcctcgacttgcctctgcaacagcttctctatcttatttagccacttaaactaaaaactcactccaacagaggctgtgtttagatttaaagtttggatccaaacttcagtccttttttatcacacatcatcttcaattttaatcaaaatgtaaactttgcgctgaactaaacacaacaagactctctattaattctctc

SEQ ID NO: 1821 - DNA, 438 bp, Oryza sativa
ataattgaatattatttgtccatattatgagcctacatacatatatatatatatatatatatatatatatatatatatatatataccccctctataaaaaaagtccaaggcatatttctttttgccaccaagactaagaagaaattaaccatgtaacaaagactaagaaactatatacatgtatgtaaccaattagtattaagatagttgctcgggtttcgattaacaatttaatctagcattgcaaaatataaatgcaatatctccatttaagttttggatgcacgaagagactacaaatatgtgaccatcttatttataaaaaaaaacagaaaatatttatgacttttggatggataaagtattgctagatacaaattagtaaaaatattatccatcatctagaataatagcatgtgtaatttaggaatactaaca

SEQ ID NO: 1822 - DNA, 1501 bp, Oryza sativa
aaattgtatgaaaaatagcatagagaatgttgcgactgattactttgatgatttggtgaggaaggcattcatacaaccatcccacatcccagggctgtacaaagtggatgacatgctaagagacatagctctgtacataggtccaatgcctgttccaaaaacaagaatacatttagcgaatttgattggggaaggattttccatccacgaagacttttggttgatgagactagcagagtagggttatagatcagagcctagttgaaataaagttataaggtttgatatttgtttcatttcccatttgtcctttgtccagcttgctgtgtcaaacaatggagcaatgtctgattagtactagactggtgctttcatatgcttgcacaaaattcaggaagctcagtaccatcttcatgaataagcagcattcataatttgcagaacatttttttaaacagtgaagcgcagaaattataaataccttggaaaaatgaatccaagcctccaatcctgtcagctatttctcagtgtcacggtatttcgataattaatgtatgatgcgcaaataaaatggttatatcattacaaaatcacaacaaatttaagaggcgccaaccagcatataccttgcattgttattgaatatttggtttatgctttactgattcagtagtttggctctatccaggttccagcaccatcagctgacaaagtgtacaagaaaattaaagtattaaacaaccatggtgaatattgatcatttgtcacaaatcacaataaagtaacagcaaatgaggatcgggcataccatcataattaacagtactgcatccaatagattgaaggtatcaatcaaatctactaagctttgtttgatgagatcgcacaaaatcaatccaagcatcattgcaaatttgcaactacaataaaaaaaagaagatctccatagaatttctggtgaccacacaatagaatctgcactggtcaaaaccaactcaacaaatagataagataatatcataaggttctgcatttccactgtgcaattcggccatccttgatcacataaacacaagaaaaacagtcaaattggtaacttttttgacctaatccgcaccataatcacatctccagctcaatcatacagccaaatcccaaattaaactgcccagaaatataaagcctcgcatcaggattagggtcaaaagcatacataggcgtccctaaattcctttccatgcgaaaacaaatcgagatatggagcatgaaacggcgagaaagaaggcacgattttatgcagataagtcctaggatttgtttaaaactttattaagacactaccaaaccagggacctatttgtaaatactacaatatatcaaacccttcaaggaaaatttgacacatacctctccatctgagcggagagctcgcacgcggtgtgggagaaaaggcggctgcgtgcgccgtctagggctctgcggctgcgcacaacgtgttcga

SEQ ID NO: 1823 - DNA, 1501 bp, Oryza sativa
tccatatcaagtactccattcgtttcacaatgtaagtcattctaacatttatcacgttcatattgatactaatgaatctagacatataaatctacatggattcattagcatcaatatgaatgtgggaaatgttagaatgacttatatggtaaaacggaggaagtacaaaactaatagaatcagagtaatgagtggtagaataaaagatgacaaagatgtggaaaaagaaatgcacatatcttttgatgtaatggtaataaagtgaatatgtatatgtcgtaccatgttgttttcgtcaacaatgcaagctcaagcactgcaaattaaatatcatactccataataaacaattaatcacatacatcagcagtaaacttccagcattgaagcaacatattataaaaacagtttacccactcgatttttccaacctctttgggtacattcttttctcccccttgttgacaaagtctctaaccctcatctagtaaacctgaaattgacagacattaatttctactatcaaataaatacgcactcaagctccagctctcctgaagctgccatccaatcaaacaattttaactctatataaaatgagagtgaaactaggtgaaacgctatcacaaaataaactaaaaagatagagctagatttagactgctcacctacttcataactctactctaaaactcaacttatcaagttaaatttagaaactggacctccatcaatcaccattagcgcactcccattaattaatacgaaaagccacgtgtcaccatcaccaaaaatttaaggccgttttggattgaagccaaaacgcgccctaccaaaattttggtaacttcaaatagtaaacatgctagtttcgattgaagccaaacaatcagtagtgtctatacttaatttatttggtcacattctagaaacttcttcactttactactcaactttggctttatattggtatcaaaccaaacatgggctagcctactttaccctaccaaaaaatattgctagtgccaaaatttacctacattctgatactaccaatgaattggtataggctcttacacccaccacccgttaaccactaccctacccgacacgccgccggtgcaatacccccacgtcagcgcacgtcccggccccacctgtcagccaccatcggagcatgggccccaccacccccaccaccccgggtaaggttgccagcccggacagcgggatagctacgtgtagtgtaccgcgtgacgtatcacactcgcagtatatatttttgctacgtgtacccgagaagggcgggagggtgggggccccactgacaggtgggccccgcaacggcgaccttggtcgttactactacaaagaagtcgtttccctctccttttctctctctctctcatcatcatcgtcttcttcgttgtgggcgtagccaatttcgttcgccattttctccttccattttctcggcgaggaggagggggaagagctagga

SEQ ID NO: 1824 - DNA, 670 bp, Oryza sativa
aagataaagccaaacaatttttgtttcaccaaaaagggagtggagtagagctgtatcacaaaatgaactagaggagctgtatcacaaaataaactagaaataaactaaacaattttaagctctaccaaaaatgggagcagagttatctcacaaaataaactaaaaaagtggagctggatttaaacagctctaccccagactcaactcctgtacctaaatttagaagttttagctctaccaaacaaacccttgattttagccaaaaggccgagagttgttttgaacaagcccacctgcttatatacatagcgaagcgccctcctccgccttccgttaccgaggtggtactaaaaccaagaaaaaaggcgcaaacatggcatgagtttttgttttagggccgaaatccaagccatatttctcgtgttagtggaaaaaggaccaaaattataactgtctctatctgtcaccacggcacacgatggtaatgggtcggcattgtgagcattaacaacaattcttttgatttttcttttgcctatccaaggtgtttgttagttgcacaaccttaagctctgtgtttggtggatttgatgaaccattcaatactcatagttgcatatcattgttctctatagcctatgcagtttcctgcttttcattactgcccaca

SEQ ID NO: 1825 - DNA, 1501 bp, Oryza sativa
tagaggtaaattctactactctgtctaaaaaaataaactctagctatgaatatagacatgtatgtgtttagattcgtagctaggattgattttttttttctttggaccgagggggtatatcttagtgtgaaaaacataaggaaaaaattattcactcgcacttgttctttgcatgatccaggtgcgcaggggtttgtactgagctacaagaataaaaaatgccattgccggacgaaccgggagcttcgccaatcgccatggattgaatgttcgtcagtttgctcgacgtgtgatggattcaggatcatgaactgtacattctgtgtaggttattctgtgttgtggtgactgtaacataccaggaatacatactgctaagtgaaagcgaaatgtaataagcaatccactgcaatttcttccaaattccagtgtttgttccaatttcttccaagttttttgtgggcctactcgaggttactgggctgtacttgcacacatcccacgagaaaataggccgaaaagaaagcccatatacctgttcatgggctaactgggccggcagctcatctaccaatcagaagaagggccatcgttcttaacttctcgtagagcacaccacacgctttttcgccgaataagcgaaacgacatatttgcaaaggaatagtaatttgtgaataaaatttttatatatgtgttcttagtgatctaaaagtaaatgctgaaaaataaactttcataaaaatatctcaaaatgagctttaaattgaagattaaaaatttaaattttggctaataaatataagtataaacgaaaagatgagacctcatctcactctcatcagccatcatacaggtttcatggcctggttgcttcctacagatggcgaaacaaccgaagccgttgtgttgctttcgatggcggaatcatggctcagagacgcgcttagcatggccaaatttgacatcaactgatgaggaattgaggataagcgtcgtgaatggctgaaatcgacaggtattcgggttgtttcttcagcatcacaacatgtcaggcagggacacgacgcacttgtccagaaattttttattttcttcctgggtcggcgaagaagatcgaccaaatttcgttaagattaggcttgtacagacatcttattgctcgtgatctggtttgctgacgaagcaaaaggaataagcccttttttgatggacacgagggtaagagaagaaaatggtcggtttgtgagatcgaactgtcaaagaagtcacattcaggttgaaggataactgatcaattttttgaaagaacatacatcatcctcgatcctaaaatatatgactttgttgtcttttcgcataatatttaattattcatcttattaaaaaatatataatttaattttattaaaaaaatatcatttattttgttgtgtttttatcatcaaataaattataatcttaatttatatttttatatatttatactattttttaaaaaa

SEQ ID NO: 1826 - DNA, 1501 bp, Oryza sativa
taaaaaagaagaagaagaaaagaaagaaatgcggaggggccttgaataataattgcaccctgataaattggagcatcgccacattactccatagccttttggtgtcgtgagctcaatccttttttagggttcttgtacctcctctggccaccgtcatagtaggctttaaaaaatgttcagggacagggctcgttgtcaatcactgacaagagctagtattcccaggaaataatcacacaacagctgtaaccagaaaattactggaacaaaaaataaacaagaccgcgtaggtgtagtatcgagaaaaaggataatatgccatttcattcattcggtgagtttcgacgaaataccacccaatacgatgcaaagaataaaatgccactccatagattatctttaggatattttgtcactttaagaggtttcaagaccaaaataccctggagagagaggaagagaagagaaggggagggggggcgaacgttgaaggtggcggcatccgtgctcatcgcctatgagcggtaagcgagcgcgggcagcgccggaggcagcgagcggtgcgcacacatgggcagcgcatgaggcggagagcgcacgcgggcggcgtcggaggcgagcgcatgcacgttggggagccctccacgtcgtcgtcgtcgcctcctccctcctatcagtgctgccctcttccctcatcgccgccgccgtcctccctgatcagcaccgtcgtcttcctgcccatcgcagtcgtcgtcttcctccctcgttgtctccaccgtctcccccccccaccatcaccacggtccgcccgtcgcaggctgcccccatgcactcgccgcccatcgccgccgagcatgagccccatccggctcaacctccccctctctttcctcttcctctctatccacagccataggtattttggtcttaaaatcccccaaagtggcaaagtatcctaaaagtaacctattaagtggcattttatcctttacaatacatgtattgggtggcatttcgtcgaaaccccccaatggagtggcatatcgtcctttttctcgtgtagtatgccctatctgctgagaaaataatggattatctgtttttttatactagctatgtgaggatataaacaaataaattaactactataaaattttaaaaaaagtttttggcaaaaatcttatatagataaaaacttccgtacgttaaacttataatttgatagcttgggaactgtgcaaacagtaatctactcgctccgttctaaaataaatttattttccatatatctcacacataataatcagaaccaaaaactaaaatatcattgctttattaaattccaatgtaattactgcctatcttatctactcccagtacatttatccattatactcataaactccgaagcaatgagtatttgaaatgaacttattttaagataaaaacttattttaagataaactaataaaagctaaaaataagcttattctaagataga

SEQ ID NO: 1827 - DNA, 1501 bp, Oryza sativa
ttcgatcacatcaaaactttcctacacataaacttttaacttttccgttacatcgttctaatttcaatcaaacatttaactttggggtgaactaaaccagccaaagtaaaagtatttgtcaaggtgtcactcatgtcatgctcttttgggtttttgcataggggcatatgcatctccaacgcctgcaaactctctagcgtacaatccaacacgcagtgatagaccctggctcaggagtagtggcgtagcgtagcgagcggcagtgcagtagtagtacgggaaaggcgcaatggggtatccggttgagggggaaaagggctgtgtgaccgtgtgggtgggggagcaggagagggtgggttggctacacactcccgtgaaaagggaggacggccacacgtgcaaacccacacgggagctctgtctctcgcagccttgacagtactgctccttggaccattccatacattggcagtgtttagttgttttagcgattttttttttacatatacgaagacacatttaaagtattaaacgtagactaataacaaaataaattacatattccgactgtaaactgcgagacgaatctattaaacctaatttatccatcattagcaaatgtttattgtagcaccacattgtcaaatcatggcgtaattaggctcaaaagattcgtctcgcaatttacatgcaaactgtgcaattagttttttttttccacatttaatgctctataaatatgtctaaacatttgatgcgacggaaaagttaaaagtttaaaggtaactaaacacaaccattgttttctaccccatcgccaactactcctattggttgattactgtcgcttgtagtaccatgattgtattcacaccgtagtgtagttgtacacttgtactcctacgtagtactggcgcagtagtacctgtctggctgtctcgagcgttcactgtattgtactccatctattttataacgtaagattttttagcattatccatattcatatatataaaaagttttatattattaaacagagaaaatacttagcatagtattgtattattgtattagcaggggattgataattgattccagtgttcacactggtggagaaaccatctttggtcagtcgaccaaaatccacaatagttccggttccactaaaaacagggactaaaaatcatctttagtcccggttggtggctacagtgggtatatttgatcttaccaaccgggactaaagatcatttttagtcccggttcatatgttgttaggggctgtcaggccctcccgtaatctttagtcccggttggtaacaccaatcgagactaaacatcttaactttagtcccaaccgggactaaagttatgatttttagtcccagttgttaaacaaccggtaaaacaaagcctctatccacgtgcgcatgaaagtctcctattaattccatccttatctcatcctctcccatccagtcatcctctccatcttatctcc

SEQ ID NO: 1828 - DNA, 1501 bp, Oryza sativa
cccagtcatcagcattcaggcgccagcttaatattcctaactctggtgtatcaattgtgcaccacattaacatctggcaagttttttggcaatttggcactagttctactaagagttagttacaaaagctaaacatattgtttgagcaatagatgcacaaacctgaaagtttgctaagaggaatgaattctttgggctcacgatgatgaggaagcctctggtcctcttcactgtcatccatgtaccaagcttcgatgacctcctccttgccatcctaaattagcaatggacaacatacttcagaacaagtagaaacaggtataacccactatctgaggtctagtttaaacatctaacataatttacgttgtatcaggtcatctcattcataagactaaggaatgcaaaaacaaacagaagtgatgaaatccatgcaattctagtaatgctccaggactggttgacaggacacagatatccttaggaaaagaacctcccaacaaatgctccaaagcaagtggatgcaaaaaaaatggaaaaaccattataaatgaagtaattagttatataataagactgcatcaggtcaaccaagtgacagcaagcttgaagcctttaaggggcctcaatacttctagagttctagtatcaacagagcaacggtattgaagtgggggtgatctagacatgatggtgatagtggaaacatttcttcaataaataaggacctctaaactctatgttgtaccatttaaaatatcagatatcccgtactgtttaactccaacctttagattattctcaaacaggactagaacaccatgttgaggactggatagcaagttccatgctacatataccaaagctcccaactttggggtgctctcgagtaccaaacccaccagcaaatcgaataattgaccgcctaatctgatctgagattttacaagcacagtttcacccccaaagccaatcatccaaagcagctaaatcaattttccggaggagattcgcaatcccataataccgcctccaatttcgcatgtacaacttccgcctattcaacacgaaccctaaacaagatcaagaaaacctagacgaaacatgcccgggaaagaaaggaagcttttcttggcgcaacatgtcctcggcatcccaggtcggtcaggacacaaacaagagcaggagaaaaggattagggtacagagatctcacctggaactggttctccatctctgaaacctctcagacgccgctcctgagtcctgagttgctttcctattgggaaaccctcccgattccggatagcctggaaggtgtagaagagtcacacgaacagcttcagctcaacgcaatctgagatttttgctggtacggtcccccaattttttgctatttatattgacacccctggaacaaggcgtcgtgtttgagtttgacaaaagtttgctgagatctggtgtacttcgcacacgctgcatgaatcacgctgtcgataaat

SEQ ID NO: 1829 - DNA, 1501 bp, Oryza sativa
cctctgggaccgcgcgacgcgacgagtcttctcgcgtctgcagcggaaactccgtggtctccgcatgattcgtgtcttcgtgagtcgtgacacgggaggggaggcggcatggacttcttcaggccggcgccagcgcacatgtaagaaccgaacgattcgctcatcgcttttgtcatcatctaaccaacgatcgatgaaaagcaatgtttatcctgatggcgctgaaacggacaatgttgccatcagatcatgcttgatttctttttaatttttatttatcgacagcgtgattcatgcagcgtgtgcgaagtacaccagatctcagcaaacttttgtcaaactcaaacacgacgccttgttccaggggtgtcaatataaatagcaaaaaattgggggaccgtaccagcaaaaatctcagattgcgttgagctgaagctgttcgtgtgactcttctacaccttccaggctatccggaatcgggagggtttcccaataggaaagcaactcaggactcaggagcggcgtctgagaggtttcagagatggagaaccagttccaggtgagatctctgtaccctaatccttttctcctgctcttgtttgtgtcctgaccgacctgggatgccgaggacatgttgcgccaagaaaagcttcctttctttcccgggcatgtttcgtctaggttttcttgatcttgtttagggttcgtgttgaataggcggaagttgtacatgcgaaattggaggcggtattatgggattgcgaatctcctccggaaaattgatttagctgctttggatgattggctttgggggtgaaactgtgcttgtaaaatctcagatcagattaggcggtcaattattcgatttgctggtgggtttggtactcgagagcaccccaaagttgggagctttggtatatgtagcatggaacttgctatccagtcctcaacatggtgttctagtcctgtttgagaataatctaaaggttggagttaaacagtacgggatatctgatattttaaatggtacaacatagagtttagaggtccttatttattgaagaaatgtttccactatcaccatcatgtctagatcacccccacttcaataccgttgctctgttgatactagaactctagaagtattgaggccccttaaaggcttcaagcttgctgtcacttggttgacctgatgcagtcttattatataactaattacttcatttataatggtttttccattttttttgcatccacttgctttggagcatttgttgggaggttcttttcctaaggatatctgtgtcctgtcaaccagtcctggagcattactagaattgcatggatttcatcacttctgtttgtttttgcattccttagtcttatgaatgagatgacctgatacaacgtaaattatgttagatgtttaaactagacctcagatagtgggttatacctgtttctacttgttctgaagtatgttgtccattgctaatttagg

SEQ ID NO: 1830 - DNA, 1501 bp, Oryza sativa
gcctgcgccgcgcagccgcccggttgccgccgcgtcaagccctggcgtcgcctgcgtcgtgcgctgccgctctgccgctccacgccgctagcttccaaagccgagagaggcagcccctctctcactccctctccctccttcaacttttcccgaaacagcaaggagcagagctccctttctccccctcctttttccttttccctaccaccatcggcgtcaccgcctgccaccgcctggaccacgggcgcgaccgccagctcctccccttgaccgcgcgtagacgccgccccaaggaccgccgccacccggcatggccccgccgccattgccgcccacccccggaggccgcctctcatcgccggaccttcacggcgccgctcagacccatccgaccccggaaatgagctccttgaacaccgaagatgctcccgccgcctttaattgagtcttcgtcgcccctcggtgatttcccctttctctcgccgccggacgccgctgtcgaattccaccgccgtcgaactccctccggcgaatccgagccgttggctcgctccttctcgacgccctcgttactccggtgtgcccccccgaagaccaaatccgtcgcgcttgctccggtgaacacggccgccgtccgccatccatctcagcctccccttcttcctcctcccgccggcctgcgtggctgccacgtaggcgccacgtcggcgccacctcggctttgaccgagcagagccggtcagccgcctcctcccccccccccgcgcgcggtccacggtgcgccaaccggctgcgcgtgggcccgccgcatccctggtccatccggtgcacgcgcgtgaaccgcgctcacccgaaaccctagcgccgccctcatgcgccgctcccacagtgagccgcgccaccgacaagcgggccccactcgggaccccgcaaggtagacttggcccaccggccctctctctctccctcactctccccgcgcccccttgggccgcctctccgggccggccggcccattagttcggccgagccgtgccttccctcttgggccgcacccaagccacccgaggaagtctaaatcatatccctccttcaatttctttgcagaaagggtttaataaattattaaatcctttttctttagacagaaattccttaatccttagaaaatccatatcttctcaaccgctcatccgattgactccgttcaacttccaataattccgtaaaattgagatctatctaatggtactattatctagtctaaataggatctttattttgggtcttgtgtaggtttttaattgtttgcgtatagttgtggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcg

SEQ ID NO: 1831 - DNA, 1501 bp, Oryza sativa
ttccactcgggaagcctagtctatgatgcccacagacatcccgaatcacacagattcgtttctgaccactcaggtcatccatctgccacataggctgattctggttacgattcccataccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcattcttgcattaccaggaacccggtttggctccaaccgaccccgccccggcgttcccaactattggcatgcgaggtttccctgaaccgactagttacttagccagggtgtctcattccaccttgtggttgcattttgattatgttcgatgagttttccacaggaatcggtccttatatgcgaatacgggacagtgccacataggcacaacccccgcatcgcgagttttcataattcattttattttcaaacacacctacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccacaactatacgcaaacaattaaaaacctacacaagacccaaaataaagatcctatttagactagataatagtaccattagatagatctcaattttacggaattattggaagttgaacggagtcaatcggatgagcggttgagaagatatggattttctaaggattaaggaatttctgtctaaagaaaaaggatttaataatttattaaaccctttctgcaaagaaattgaaggagggatatgatttagacttcctcgggtggcttgggtgcggcccaagagggaaggcacggctcggccgaactaatgggccggccggcccggagaggcggcccaagggggcgcggggagagtgagggagagagagagggccggtgggccaagtctaccttgcggggtcccgagtggggcccgcttgtcggtggcgcggctcactg

SEQ ID NO: 1832 - DNA, 1501 bp, Oryza sativa
acaaatcttgagtcgaaagttttcaaatctgggttgaaagttttcaaaagttgacttaaaaggtttaaaaatttgagttgaaagtttttaaatatgaattgggagtttcaaatttaaaggcgaatgtttaaaaattgagttagaaagttttaaattatagatgtactcaaacatgcactaatcacgtcgttaatcacacgctaattatgaggctaattacgtgaaggatgacgggcgtgtgcatgggcagtgggcctgcgcgtccaaaacgcgcgcgagttggctcgccagcgcgtacatgcgcaatagcaatctctgtagtagtggccattcaagatgttgtaccgtacctagctgttggtattatccgatgatatatatactccctatttaaaaaatttatgagaaaattagtcacgtataaagtattatttgtattttatgatctaataaaagatactaatcgtagaaaattttttgataaaacaaagagttagggtgtgtttagttcatatcaaaattgaaagtttggttgaaattggaatgatgtgatggaaaagttggaaagtttgtgtgtaggaaagtttttatgtgatgaaaaagttgaaagtttgaagaaaaaatttgaaacgtttgtgtttaattcacatcaaaattaaaagtttggttgaaattagaacgatgtgacggaaaagttgaaaatttgtgttgtaggaaaattttgatgcgatggaaaagttataagtttgaaactaaacccggccctaaacgttgtatccaaatgaaatgaaattttggtagtacggagggagtaggagcgtgacggcggggcggggcctggatggaaaaaaacgcggagatcgcaagtagcgcattgaaggcctggggaagaggattcatgtgaccctgcaccggagaaatttgattccattatcgtcccatcagcctgagcaagatactgtgtgcggtccaagcttcggcaatgggggccctagcttcgctgatggtcgccgcggtttcggcgtcgacgacccctgctaatggtgaactttaatggtgaactttgccgagcaccaccactgcagtttcacaactgttgatcacctattcatctgcatgcgtatggctggcatgtgcctaaagaatcgaacatccatatgaacattgtgaaaccgggggggccatgcatagcggtcttgtgtttggacgccaaaaactgttgagcatatgaccggttttccggtgaagctacaataatctgctagctgttctacgagtgtgacgtagtatacgttttcacttacagctaccatattaaatcctgcaaatcttgacaggtgcgcaacagttcaattaaaactggtgaacaataatcctatcaacacaaaacactaaaaataaacccctcaaatcgttggtgatttttttttagacatgtacaaatatctatatacaaaggcatgtacttccacatttccataaaaaacaacctagtgttaga

SEQ ID NO: 1833 - DNA, 815 bp, Oryza sativa
taaagtttaaatttaacatttacaaagtttgtaacggatcaatttatagaggttgaatttaaacctgcatgttttagtgtgatatgatataacccatattattatcttaccttttcttttaaaaaaatgataattattaagttcatatgtaagaactagctaggattgtcttctggagagatgaaaagtcatcttccctaccaaggtggagtatatggaaagtgatttcatccctcaaggggatatcctcctgtttttggtaagataaattaatatgaaatatatcagtacacaaacacgcaagttaaaattcaacttctgccagttgtaacaaagataacaaatatagatgcgaaagtacgataattattttcggtttaatttgttctttttgttgtaacttatagatgtcgaatttggtcttgtatgtttgtggattcatattaatctatgttgtcaatttttttataactatttaactgatatgaatgacgaagaaatatcccctcaaggaatgaaaatccattcctgaagtatatataattatgtacactgcattgcaggggtggggtttaggagtaaggtagctagggttgcacccctactcttgaatctaaatatacattagaactgtaaaaacttcaaaaagtagagaattaaaggcaaaactatgtcaattacattagttgagccttagacttggaagaatcctggttctgctacacgtactgtatagtagtcacactgctccactcgatctctgtagccggccttaccgtatacgtacgtaggcataagtatgacatgtacaggga

SEQ ID NO: 1834 - DNA, 1501 bp, Oryza sativa
ttaattgttggattagtgggtgtttaggccacgtcgatccgtgccgtctcctgggaagatactctaattaaatggtcttttggtagttattagttaattgattttgttgtgtggattgcattggcctagctttcagaaagagtatctagattagtgctcttttctttggctcgatctggccgcaggatcgctacatgacgtatacatatatatacaccttgtctttcattttttttaaaaaaaaataaattcagcacgcaacaaacagtatagtttacatatgtatgagattacgtcatcacacaagtgctctctctgttccaaatggcaacataaaccacgtggcatgccacgttggcctgatacgatgttctatatatatccacatgctctttggttattttagtcaaattactggtcatatttatgagttaggacacgagagatggacgagttaaacccggtttgtatctgtggaatgatatcccagcaaatctggaaaatcacgtacgaacgtgccaacaaaacacggcactataatcacacggatgcaggtggcccatctcatcatcaatcatcatctctgcagcgtgacagtaacatgaacacacgtctcagccagacacatatttacgagtaatatctaaaaaaaaaaaaaagacaaaccctggatttcagtgtccaacgtttaaccgtccatcttatttgaaaaaattataaaaaaattttaaaaagacaagtcacgcataaagtattaatcatgttttatcatctaataacaatgaaaatactaattataaaaaaattatataaaacggatagtcaaatattggacacggaaaatcagagtttgtcttttttttgaacggatggagtatgtagcggctaatagtcagaatatactgaatttgtgcctaacaaaaattcgtctgaaaattgtgtttcacatgcgtcatttctctactcccccctcaaaaattatttttttgaacccgtttgtttacccgattaatcgacgaaccgagcatgcaaaaaccgggagatttgcgtagccgagccacatacgggtcgggtcgggtcaggctcggtcgcacacgagccagacaccccgtgccaacctgcaccaacagcgaccggtgacgtgtcccgtgtgcccaacttatcattccccccgcgtggccgcgtgccacacgtacgcgcgcgtgccgggggctccgggacacgtctcactgacaggtgggacccacggcgcagcgtcacgcgatcgcgacccacacgcggcggggtggtgggccccgccgccatagtaatcgctcgagctcgagctcgagctcgagctcgccgcgccgtggccgctatatatatccctcgccgtaacaacgctcatctcaaactcactcgctcacacatacaagcgcagttaagattagttaatccaagctctagctcgatcgcgcggtcgccggagctgaggtagacgaaggagtgcgacgagctaaga

SEQ ID NO: 1835 - DNA, 1501 bp, Oryza sativa
ctttaacattaaattttacaccaaagaacatatgggatgaatctttttttttccttatggttatatgcgatgaatctcaatgaataaaataggcgtacctttcaaagacaaaaaaaaataacacttattcgtggcatgtaatgtttatataaggacaaagtaggctatggtttgccttttctccaaaaaaccgtaggctatggaactaatatcgcaatgggagtaccaacaaattatcaaagtgcaaatgaaaaggtaatgctaaattgctaagtggggaaaaaaaacctaacttgaacaaacactgaagatctgtaggttttcaataacaaaaaaagatgaagatccacaacatcagataaatgaaatatatattgttgcacattaaaccctctagaaacgacattatgcttataaaaaagaagagttctttttgacaaaagaaaaggaactgtacacctcacttgtccagatcttaaccacatagttaaacgagcatttctaatcaagtaacaacgaaacaccacattaattaaactgatcagtctaacatcaatcaaacaagacaaactatgcacttgcactccgaacacgcccatccaccacattgcaccacgacaaacacggcattaacccagatccaccatggaatagcccaacatgatcccaataagtcgagttgaagggacaaatggtgcaaatgcatgcattgttgaagaaatccgatcgattaaacagatacgacacaacgatccagccaatgccaaatcctaaagcatatccatgaccatgagcagcgaaatggagaaggaaatagaatcgcatccttcaaaacgacgctaatcacatactgtcgatttaaccaagtgatagtcatggaatttttaatatacgagaatcgagaaggggatggatttttttttttttggggggggggggggggggccattactgaatccgtcgtggacatggtagttgaaggtgtggccgtcgcagttgtagctgtggcggttgttggtggaggggagcttctggaggcactgcgcggcgacggaggcgaagttgccggagacctcggcgtggtcggccagcacgacggcgccgcgcgccacgaagctgtagaccagcgtcgtcctcttctgcggcgccatgtccccccctccggccccggccgccgccgcctaggctacgctacgctacgcgcgcgcgcgatcggggaactcctcggcggcagatggagggagggaggcgggcggtgggaatgcgcgggagcgatgtgtgggaggcgaggaggtggggggtgctgcatggagagaggaaggtggtggtggggaatggaggtgggggaggcaagccacatgctaattttggctgatggttgattttctgattttttttcccctcattgaatgatttgctaaatttaggtgttattaatatttgttgtttagaaaatgttataatctagaaagtttttatcgccctcgccttatcccgcatc

SEQ ID NO: 1836 - DNA, 1501 bp, Oryza sativa
tcgagcccccacttcggcgacggaggataatgatggatggtcggagacgacgagatgattttgtggggccgcttcgtcagtgagagtgagagcgagagggtgtttataaacgtgggacccatgtgtcgagtgtgacgtcgacgcgtgtttcggaagattcgaaatggcggcgccgggtaggacggtaggagcgtacggtacatgacgctggttgggccttggtttttggttgagctgggggcactggcccgcgtgggccagtgggcctagcggaccgaacagttgatgggctttgagtttatcgtttgagaacggagtaagttcactctgggtccctttgtcgcccagtccaacctcgcctatgtgattgtcattcttctatttgtttcattgtgcaaatgttaatgtactaacctagttatttgtatttttaaataaaacaccttcgaaggtcgatggatgatggtgttatttataagaatggattatggtttagatattaatacatattatattataaatacaacaaatagcaacttggaataagtagtataaacaatgttgtcatataaagttcgttttctgagtaatcatatttttaaattcgtggtaaggatggtccgcgaatgatactatccaaaaataataaatagtttgccacggataatattttatggcaatacccttaatgccacatgcgagttatattcaatgtaagtaaccaatgagaacatcagttggcaacttggcataagagaaatatatgaatgcacatgctatttttcaatgaaaaggtgacctaatctattgaaaacctaaaaaaacttatttacacgggagctttaaagaaaaggagaaattccatatttccattgaagcactatcagtcaataaagcatcaaccggatgccaaaacgtgtcctgaaaaaggcaattctcgatttaacactaatcatcattatcctaataaccatagagaagcataacaatattccaaagccaaacaaagcgagacttaggctgcgttagaacaaaagggagtttgtttgtttcgttttccgcgcgtacgcttttcaaactactaaatggtgtgttttttataaaaattttctatataaaagttgttttaaaaatcatattaatccatttttgaagtttaaaatagttaatacccaattaatcatacgctaatggctcaactcgttttgtgtatattcccaatcttctcaatcacctctctctctctcaaaaacagccttatagtactaaaagaaaattaaaaaaaataaaagtacgaatctcgaggcagccgggtgatccctctccatccgttgcggctgccacccgcggatgccgttaaaccctaactccctccactcccccctatttctagggttttaagcctcacccaaaccgcctcagccgctcccctctccccttcgacaacagcagcgccgccgccgccgcaggagccgcatcgccgggggttcgccggagggag

SEQ ID NO: 1837 - DNA, 1394 bp, Oryza sativa
attcctgcagccccgtcgtccttcttatccttttcattttcattttcgctgaatttctgtacagtatgaactctgaagacgaaaaaaaatatttgcacagaaaaaaaaaagagaacccaatccgcttgatccactgatcacacacaaaaaatatttgtgtgttcagcgctggccccctcatccctcccccacactgcttcgagactccactgcttttttcgtcaagtcaaaacgccttcgcttcgcttgccactctcgctcaactgcttcggtccttccgcccgcgccgcgcgagcacctcgccgccggtggagcagcgagagaggtggaggagggagggatgagatcgcagctcgacgccgccgccgtctcgtcgccgccgcgggcgcccgccgcccggcggtgcctccgccccgcgctgccactggccctcaggtacacactgttactacatgtgtacaagggtttttttgatcttctgctgatctgaatccgcgtctctgattttttttctttttcctcctaggtttcatgcgttccccgggcaggttcgcgtttatcgcggtggtggaatcggagtcggagtccgctccgcgggccatctcccaagcaagcgaggttcgtgggcggcaaatgcagcacgcgtttcctgtctgctatttggatttctaacgttttctctctttatttaaacgaaattggtgaccgaaccatgttctgattttatcaatttaatttttacgcatgcctttatttctatgcttgcgttggccaggactagtaagagtgttcgactcagcaatggggatgaatgagaaggtgactaatggtaatctagaacaaccaaccacttccacatccggaaataacccaagctttcctgctgaggtgattttttttttccggtacatcattcattttctttttctttttgaattgtgatgtgatgatgatagacaccagggccagcatgtgaattttatgatggcaatgcaaaaatttgattggtagattaaggtggcatgtgttttttagaatacatgctttataggtcaatggtggtgaagtcgggttgtttgacagagcatctaattaagtggttctgcactggcagtgccacaagaatgattttattatacacataaatgcataatcagaccccaataaccaaatcccgcccttatgattgacgaataacagttgtgagctactgctttctggaccaaccaggtttagattggtccatgcttcctttgttggaatatggattagagactgctaaatgacgtgttcatctaactcctcgttatgagaataatcgataattagaaataatgcagttgatttgtgccttttgaagcaacgatttcaattgaaatatattccatatgtat

SEQ ID NO: 1838 - DNA, 274 bp, Oryza sativa
agcctaattacgccatgatttgtcaatgtggtgctacatggagtaattaggtttaatagattcgtctcgcaatttataggcggaatctgtaatttgttttgttattagtctacatttaatatttcaaatgtatgtctatatacgttaaattttttttgccaaaataactaaacacggccttccttagtatacgtgtaatacttcaaattagtattagtgtccatatatctaatataacacgccaaaacttttcatccctggatctaaacacagc

SEQ ID NO: 1839 - DNA, 355 bp, Oryza sativa
tggcaaggcctgagggctccattgcagaggcatatgtcgcaaatgagtgcttgactgcttgctcaaggtattttgctgatgttgacactaggcacaatcgtgagggtaggaacaaagagcgtgttcctatgagtagatgtggtttatctattttccagcatggagcaaatctgttgggggcaccaaggcttacatatgagtagaaggagtatgataggatggtttggtatgtcctcaacaatactaaggaggtcgagccatttatagagtatgtccttgaatagcgcacctgtttttatttgtgtatcatataaaattttagctcttacatgggagttgtgcacctgtttgtagg

SEQ ID NO: 1840 - DNA, 409 bp, Oryza sativa
gtaactaagaatgccttttggaatagtgttattaaaaatgttagataaacatttggtttggtgaaaaatgatatggttttatccaaatgagtggagaggttcagctgcaaatccatatgcacatcctaaatttgctttgtttataaatgccagcctgttcaatgcaactccttacaaatttatggccctagtgcacatatgtgctcatcacaataactgggttcaaagtgataattaacttggttttgcctatagcccaggtgtttgacatggacttacagcaaacacatttaactctctacagttggtgattaaccaataaaaagagctccattcatcaaatatattcaaccaatatattacagtattggctccacaaactagcttactataataagatatgcaagca

SEQ ID NO: 1841 - DNA, 1501 bp, Oryza sativa
aaataaaagaaaaatgataggaattgcagaggattttatcctatgagaaataattctagggagacttttgaaacaaaggattgatttctacccattcctttttaaattcttgtgaaatagactattctaaagcaattttgaaggaaaataaacacttatcatgtatctaaaattcatgtgcttttcctgtgttaatcaaatgacagttttagaactactatgtttcaaaatcctctatgaatcaaatgaatataacaatctattactggcttttcatattactgtgttttcccccatcctcgtttcaaatggccttaccattttagtaccatcattgatcgtgcgtaaatcccaaagcaaaatgaaagaaaagaacactagtctagaattttctaaagcatttccttctaagaattgtaagtactcctacatacttcatatacttcatatgttccatattacaagtcgtttgactaagtttatataaaatataatactcccttcgtcctagaatacaacaacctacaaccgaataggacgtatcctaggactattgtttaaattcgtagtattagtatatgtcccatcctagtactttattataggacgaagggagcagtattttcaacacaaaacaaacatatatcaaaatatatgtaattttagatttaataaaactaacttgaccttttagatgttgctaaatctttttataaatttagtcaaacttaataaagtttgattatggaaaaaaaataaactacgaagggagtattaaagaaaaatggagtagttggtagttcccctcaattgcaggttccttaaaacctagtaaaatattggggtagtttaaaaatgagaagtaggaatcttttctagttaggcgagcaattgacaagtaaaagaaaaaacccgcaagtcaaccgtccctccatctccaaatccaaaccaagggaagaaggaagaggcagctgcacttgtacgaccaaaagacggaccgcctctcccactccctcctcatcttcatcatcttcttcttcttgtgaattgtcaagaagagaaggggaagaagttgcggtctccgttgctgaccgagagacccgcgtgaaacctgaaaagaggggaggggcggagcttcctaagaaattgagaagaagcccactgcccggccatatgtataggaacaaaccatccctcccttgtagtagtagtagtagaagtagtaggagtagtacatattggaagcagctgctgaggcctgagggtaggataggctgcccttgagcctggttttccctcgatttcttcgtcctctgcggcagcggcttcttcttcttcttcttcttgggttgctacctagctcgtactggagtattaaggaaggaatagccggccggcaagaaaagaagctcaacatcatctagctcgtcgctactagtaagtaggagtagttggcaaaatccatccatatatatgatggcaactggcggcggcgatggtc

SEQ ID NO: 1842 - DNA, 1501 bp, Oryza sativa
ctgaaaaggcggattttgtgaaagcttatgctgtaaaagtacagcgattccatagatttctatcaaggccctagggttaagcggcgaaattctggtaatcttttagctttattagattgtcattatgagcttcatgtttagtaaccttcacatgcatctttatattgtagtcagtcatcatatctggtaaagttacttatatgctgcttttgatcagttatacacgccgctgtctcatctatactctatatgtaggttgcacttagtttgctcccatcaaacgtgagcatcttgaaacttaactagcatcagtcaccactgcacaccatgcatcttgatttttgccaacaataaaagaaaaagacccttgaatctgagcatctacatccacgtttactgaatgcaatgtctctacaggcatgactgctgttaatttaaaacgatatttgtgatgtttctggtttgcagccgctgtatcaaatccgagatgctgacgtgcttcgaaaactgccatgtgaaccttaatattccaaaatttcagacaactgtacctttggaataatagatgggatactctggtaaatgctgaagtgtgtggcaaccgtgagttctcttaatggcctaaaattgtgtacatatgtatcatgagaatgcatttattcaggttaattgtactggctacactaacttgtcactcctgttaatatagttttgcatgttatcctatttttcttgggtgctatctgatacgcgcatgttcatgatgttgcacttgtgagattgagcattgccttgcacttgtgagatgtgctaagaagctggtcttgacagcccatggtataatatcatgtcatatctatgctgtgttgcagctgctgcaaatgtcaccggtgccgcgctttataaaagttttcctgtgttgacgtagtatgtggttttgctcccgatccgtatgtctgccgcctcgggcaccctactgcctcctttgtccgggccgcgaaaccctattatctccaaagttcactctacaatccacactgatatttaaaacaatttttcttttaaattactagaaataatgttagtgcgttgcaacaaagtgatttacatatcataagccaattaccagcctaaccattccttatttacatatcatcagccaattaccagcctaaccattccttttttctccgtttttcgaattttttttggctatctcgttgctttacacgttgactgctcgtaagctgtaaccggtcaaacgaaattttgggcgttgtgggggtcttgcaaaaaactcgtgtttacacataatatcacatatacctgacatcacgttgtatttattacgtataacctcttgtattccatgaaaaatacaaaaattccgcttccagaggtagcgttgtaaacgtaaaagccatagggggttttctgcaaaacgtcctacactaaaccccccttcccatcccacctctcatctctcggcgcggattcgacc

SEQ ID NO: 1843 - DNA, 1501 bp, Oryza sativa
tcttggaagttgagaagccgaaaagtgtttttgtagcattcaaattaaaaaagagcaacccccataccgtaaaccgctcgtgcgccttccgccgccgccgcgcgcgccgtttcccccgccccccccacccacccaccccacacgccccgccggagctgtgccaaacggggcctttgtctcctctgctccttgcgccgccaagacgagtcgtggctgaacagaacactagaataggggaggggcggcgatctccatctggcgaggagagcagagcaggggaggggatcttggtgagcatccacatcctctttctgattcatctctctcccatcgggactacttttttctggaatttgcttgcgttcgttcgttaaccctagcttctcttctagatctggatattgtcaagaatcagctttcccttgcggatggcattgaagtttctagcttctcaaagttccaagaccttggtgctaattcattagatactgtcagtcaactggataatatgtgttctcttttgaagtttttaatagccaaattcaactatttccgataaggtccaagttaacactcatttatgaatcttttcagagttacctgatactgctacataatgtactgctgtttacagggttcaaagttggtgttgagaagcacagcacagaggtcattgtgaaaaaaaaaatctggaagcctgcttataaattctggaatccaaggatactcgctactaaagacaactcaggtatttcttcaacttgcttctgtgattctcaggccatcggttacatgagtgctacagcatgtttatggtgaactttttgtcgtctctggttgagtttgcatggttttgtatggactactgttgtaatgcaccgtagtgacctagttgcaatgtaccagtataacatggaatgctgtggctgtttgtgttgaagctgagtgcctatctcttttccagattagatgctgtgaaaatgggttggttgggtggcgtcctcatattttggtgctcagattgacttttcttgtttgtgggtattatgtttgggatactggccaagggaaatggacagaaatatgctagctttagtggacagggcctgtcatcgtatttgtttattctattgttaccttaagtccttaacatatatgttcttctgttaaaaaatgctagcctctgattatgccttcagccctccatggccttgaagtgcctgttgtcctgttggattctgtacatttcttgtggtgtagtctggcagcatttcttttgtaatcaactcagatgcagagcctggcagcctgcacggcagcatatatatgcttctgcctctaaagaataaaactaacgcttaaacctggttaggcagtatgcttcttttcatactgtctttgttttatgctgtgtgcttcttttcttattcagtttggcagtgatcattgaactgtgtcgtttctgtacttaagcaccctcccttgccgccgtccgctacca

SEQ ID NO: 1844 - DNA, 453 bp, Oryza sativa
caccgtgtcgcccattctcccgcgtccccgcgtcacctgtcaccgccgccgcccagctcctcccccgctggcgccgcccagtttttccgcaccagccatccgccgcgccagccgaaccgtacccagctgctttcgtgggaggagagagaggaagagaggtggagatgggaggggaagtagaggctgacacgtgggacctatgtgggtcccacgctgagtcagctgcacgtcggtcaaaactggagttaaaaccgctgagggatctagtttgcactggttttgtaagttatgggatgcgttgtatccggttttgcggttcggggacgatttgtaactcgatgacaagttaagggatcttcggtgtactttttccaaatagcagccggacttctgaacgggctactcgcgagcgtgtgggccggaatgtcagctggacgtaaatgggcctctcga

SEQ ID NO: 1845 - DNA, 1501 bp, Oryza sativa
caaacaacctagtatggtcgcatccccaccaatgatgcaaaccatacccctgcacacaagcaaacaacacacgatcttgctaacgaaactacccttcagggaaggattgggtttaggtgaacttcgggaaaactcttcttgatcttcgcggaacgacgactctgaactgaccttctcgctctttgctgcacgaagcttgatgcttgacttgacttccgaacagacacgaagctgacagtttgtcctccacggtttaacaactataagaattggagggacaaggaggagaattttgaaaaaccgtttcgcaaagaaaagccgaagggcgaggggagacattttgcaaatagggttttcagaaagcttgtccttagggtttgaccatttggctcaacctacagtcgagttggctctgataccactttgtcacgcccagaaatttagcccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggtgatcctagcggggcttcagctccactccacaggcaaaactcaactggggtctgagccttggtcctctaactccatcttcagctcagaagcgctacacttctgaaaagggggaataatagcaaggctgagtacaaccaccgtactcagcaagccacaccaacgatgcagacgtgcaaggggatacaaggacggtttgtggctatttgcataaaggcggttgtaaaacattttatttaacaaacagtaaaattgttgaataattaaagtaacattaaaatctccactgatcaacgctacaccacgttgaacaggcccaaccaacccacctggactacagtgtattgggtcgatttattaagatgggactaatcacggtgaatctggtcgatcgcccataaccgcgggcacggctatttgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaaca

SEQ ID NO: 1846 - DNA, 1501 bp, Oryza sativa
tcaagagcaagctcgcgttgagctagtcgccggcgctgggctgcaggtcgcggccgccagacccgacctcacgcccgccgccagtaccgcctttgggcgcaggacgttgctgccgtacccaacctcacgctcgccggccgcgccgctgctgcttctaggagctccgcatcgacgggataaggggatcgatttggctattgtggttggattaatttgaggggtattttggtccgcgtgaaaatacagtatagaaaaaaaattcaaaacgtgtatcaggtgtatagcatggcatggattcaattttcgcaatgttgtagtggcatagttccaattatacaaatagtagtggtatttttcaaaaccggtaattttataatggcatggatccaattaaccctatatagtatggtgcacacaaaatctggaaaatttcgtatacgatgttccaaataaaagcgggttgttttcaattcagtcattttttttagtctgacataacatcgctgcatatgagaagaatgcattgctgcaaggtgagataaccaatgtacgcataccgtatgcaaacgatattgcagatgaaggggcacaggcctgaaattcagattcttacaacaaggcctgactggtattggcatgattttatctgaatcagctctataccaattctgaatcagattggtatatattggcatgatttgaagaactttatgaagcttagtttgatttgaggatctgaaaaaaaatatcttggtttttatatttcaacaagttgtatcttgatggattaattatccctgaaacgagttcaaggaagtgattttagactattagtatatatgctttattttaattttgactaggtgattttagaaacatcgtacattaccgtcggactgaagaatctgtcaagaacattatcacatgataataggtaagcattccatgtatgtagtatatgtatgtaatgcagtctaccaagaagataaaacataatcgcacacacacacagacacacacttttgaacataaaggctggagttctgccatttaaaaatcgacgatcgaggggatgacagttttgatttaagatattcatctgtttattatctaactaaatccttatctttgaaggattaatggttcaactgaagagaaagaatctatataaagttataaacagtactatataatgctagtttggaaatccatgagattgaatcattgtcattcagtacaacagaaacaagaagctcaaggaaattaaaacacaatccagcagtacaaagcgttgcacactgcctcgccagtaccatttattaataccacaggatagaatttaactggtacacacacatgataaaatttccagatgtcacatatttattcgctatataactaccttgagcaacctttgcagactgtgtgacattctgaagcacaaaatgtatatatagtacgaagatgatcaaagcacagagacatcgatcttcaacggcag

SEQ ID NO: 1847 - DNA, 1501 bp, Oryza sativa
attaataaatattgagttgtccttagtgtgaaacttcaattataatataattgtaatttaataatttggaaatctaaattagtaaattccaagaagatattgattgtttaaaatatgtagtgcctgggaatgtacaaattaatggcttgcaaacataattaaaagcatattcctagaattcctttaatttattcaataactaaaatacccaatggatggtccatctatagcaattaatattcttaattcatgtgaagaattaaagaaattagctgatcgattgatcgaactattggtaaccgctattgtcagtacgacaaaaagatgataatggcaagctagggcaaggcgagattaggggagcgaaatttgaacgcctacgtgggagaaaatatctcataattgagagtgatcggaagcggattggcttaaagtaaatgttgatggctcttattgcgcattctctgttgaggcggacattgccattgccatgagagactcagcatggcaagttcttatatcttcttcgtgagtaatctgggatggtgtggcaggagagaaagttgaagctatggcatgccgagaaaggctagctctcgccgcagagtgggttcgcaaacccattaccttgagtcatattgtgtggcaatgacatgtttccttacatcaaatatagttgattggtcatcaatgaagccaaacgtataatataatgtggttgtttccgaaggtgaaggttaggcatatatatattagaagagagtgtaaaagcatagcgcatgagttagcacagtttgccatggattaagcatagtgcacgatgttccctacttatatccatttttatataatggaagttttattgaattcagtacattacattgaggtgataaagttgtcttaaaaaatacttatatccatgatcttataatcctcaaggatgattaattaatataacacccttttttcttgtaaaaaaaagtaatgcatgagatcctactacagagtagagacatgtaaacaatcaggaaaaagtaggggactgaaaacagacctcccacacacacacgaaagagtacacgagggatgtgactgctggctcacatccagtcattggcttagctagctgccaaatgggccccaacaacgtacacacaaccctctcccctctccctagctcatgcgctccaaccttgcaccacaaccacactgcatgcgctccgtccagccgcagctaacaaactgatgagccgtgtagcaatcagcaactggcaaacgggccccacgcagccacgcctcctatatccacgctgcccagcggcgcccacctcgattcccccttctcctccacaccaccgcgcctcactagcctcgtgccctcgtagctgccctcgcgcgccaccaccatgccgtccgccatgaacatgatcaccgccgccttccgccgatacctcggctgcttctccgccggatcaacccaccgccgccgccgcggcgccgc

SEQ ID NO: 1848 - DNA, 1501 bp, Oryza sativa
tgctttgttggttatatttatttaaattttcaccaaaatttctttgttgcattcaaaattatattacagaggggattccaaattaacatatgtcattgccttgttttttttttttctctttgctctctccgatgtttacatctatttactgtagcctgggataacggctagccccgatgaagtggctgttccaagcgtcaagatattgggtttacaagttcgatttggagttgctgcggaagcaacgatggtgtcctgcatgctcagatgttttcctaacgttgaaacgctgcatatcatggtaaggcataaaattcaatttgtcttgcttgaatttgcctcaatcagatcgaacaaaaattcagcgctcttgatatattataatctgaacactggttaatttggcagcctatcgaagatcctcagtctacccagcttgatgactttgagttctgggaggagatcaattcagttgaatgtgtcagatccagcatcaagaaggtagtgttccatgggttctcctggaagaattctgagatagcgttcatcaattccatcgccgaaggaggactggtgctcgagaagatctgtatcttccagagtcgacatggtgctgccccagatgatgatgaactgaatgctaagctgagcatggtagcttctctgaacatcggccttggccgtacagagatcatattttcaggtgaagatccaacctggtgctatagggcggcggctgatctttctcgtgctgatccttttgattgctgccgttgaagatcgatgtctctgtgctttgatcatcttcgtactatatatacattttgtgcttcagaatgtcacacagtctgcaaaggttgctcaaggtagttatatagcgaataaatatgtgacatctggaaattttatcatgtgtgtgtaccagttaaattctatcctgtggtattaataaatggtactggcgaggcagtgtgcaacgctttgtactgctggattgtgttttaatttccttgagcttcttgtttctgttgtactgaatgacaatgattcaatctcatggatttccaaactagcattatatagtactgtttataactttatatagattctttctcttcagttgaaccattaatccttcaaagataaggatttagttagataataaacagatgaatatcttaaatcaaaactgtcatcccctcgatcgtcgatttttaaatggcagaactccagcctttatgttcaaaagtgtgtgtctgtgtgtgtgtgcgattatgttttatcttcttggtagactgcattacatacatatactacatacatggaatgcttacctattatcatgtgataatgttcttgacagattcttcagtccgacggtaatgtacgatgtttctaaaatcacctagtcaaaattaaaataaagcatatatactaatagtctaaaatcacttccttgaactcgtttcagggataattaatccatcaagatacaacttgt

SEQ ID NO: 1849 - DNA, 1501 bp, Oryza sativa
  unsure (1)..(1501): unsure at all n locations
cgtgtcattttctttttttttctttcctttttccttttcctttttgttttctgatctcattcttctttttgtttcctttcttctgctcggctcacagagaaaggagaagaaagggaaaaaaaagagaagaaaagaaggaaaaagaaaaagaaaaaattttaaatgggttccatttgtcacatcatgttcgtgtggcatgcgacatcagcgtcatgtaggatctcaaaggggctgtggcgatttgggatttagatgacatactataataatttctgagacttgaatatacattttaagagtttatagacttagatgacacaatattacaaatttaagaaccactcgtgtactttactcttatcataagttagtagtcttcagtcaacggccggtaacctcatagaacagaataaagacagggaacaaactccagattcttcccgtcagctgacaaagcgggaagaattctagttttagtgaagcggtagaagtaactattttcaaccaaagtgtttgagccccaaatcctcgcttttgttgaaaacaaaaacagtggtagatgtaattataacatgtactccctccgttttaaaatgtttgacaccgttgactttttantacatgtttaaccgttcgtcttatttaaaaaaatttataaaatatgtaaaattatatgtgtacatgaaagtatatttaataatgaatnaaatgatatgaaaagaataaataattacttaaattttttgaataagacgaatggtcaaacatgtactaaaaagtcaacggtgtcgaacattttgaaacggagggagtattatcaatatgttttgatttgcctctcaaaataatacgtccgcatctcggcagtgcgcgtccccccttcgcccgtcacagtcggcgcgcgtgacggccttggagccagacgaaaagcaggtcgagaccgctccaccgcgcatatccacgcaacgcaactggtacgtgctgccttgacgcgcccagaaaagcggcacggcttccacatttttcggccaaatattatatccggccgtgtaccggagcacgtgccgagaacacgtcgccgtcgtcacgtctcccgccgtgatctagcgccaaccggggacgaccaatcacgtatagccggagaggtcaatagccgagtaggcgaccactcgtttggtctattggccagttagaatcgctgcaggttttaagcaagggggataaattaagagtcctggacgcgttggcgggacagggacgtgtgtttcgtcttcgagagctcgacttcactcgcaccgtgtccgtgtgttgcgtgtgtatatatagctgggcagccacgctctggtttccatcaaactagaactgaactgagcgagctagctgcttctacaactgtgcaggtagctaattaatctagcaatcctcccgtagattggaataatggcagatcagaaggtgattctcgccgagccgctgcttccggggaaggaagctgacttcg

SEQ ID NO: 1850 - DNA, 1400 bp, Oryza sativa
gccgaagccggtcattgctcttattcaccataatcacaccaatacaatgtttggggtagcctatctatctattgtcgacatggcggccatgaaaccatcccgtagtcgacaacagggtagtcttcctcctcgagttcttgcccggcgagatcagagacagcactagattcctctctttggttcccgtaggtaccatatggggttttcctaggcttatctctgatgtcgatatctagcagcttgtcttggcgtatgtatgcttgtattggcttgtggctttgtggtgtctatgttgtccgtgtcctctctcctcataaggtgttttgtatttatactcataggtgtccccttgtacaagtaaaactaggaaaactaatatggatacaatccgagtagtccttgtcttttccatgtaaaactctattcatccttccttatacggaactcatcctatatccgaaggttgtttctgtataagacatggtatgtggtgggtcctgccgagatttagtcaactactattaggtatgtggtatccataacctgacagaagcgaccacacaattcaaccagtcatggatggagtatgaatgccgggtacaatttgctagcttagactgaaagaacaatccattaggtttacctaaatggtccgagcattcaaagtacggttgtagaggtcgctgccagatagctacctcctttgcagaagaaacatgtggaaggagatattttgtctgccccaacgtaaataacagcttcgtcgtacgtcgaagccttacatttttttcaatttcgctaacatttgcataatattactaccttactgactaactttatttatttcttaggtcaatccaaggatgtgcggattcactttgtagatcgacaatgtcaatccaacatatcatggtgaaaaaataactgagtctaataaaacataagtagattatcaactattaaaggagcacagaaatgcaatacgcattgaatgacgtagaaggggtcggtggataagctcaagctcaattcgtcgagacggacaaattcgtatcgtttatccatgggacttcttaactatcttatcataataatgcaaattctattggtgtgcatgtgcatacgtcccgaatagaaaaataatggcattctattgttttgatttataaattccctttgttgtcccactgcgttgtcttccttataaattaagtacataattatatttttgtaaatatttttataaattctatcttcaactgtgtatatgattcaacctatgcacaattgtacaatgattcaaatgtttccctaacttaaattcaaatgattctatatggattatcatgaacacgttttcggagctactaccacgatttttgtagaaactttcgacgagt

SEQ ID NO: 1851 - DNA, 1501 bp, Oryza sativa
ccgcgcccctgtgcctgaagcccagcacgaacccacttgggcgcaaaggcaaggcagggtatgcaggctgcggctgctggttgttcagggcgcacacgtgagatcgaccgatccgtcgagaccgagaccgagctcagcacgagcacgcgcgcgttcgcacgtacgtgtcgcgtcgcacacggttggcaccaactcgatcgccgtggtgcgctagctgctgtgcggtgcagtgcagtgctgtgctgtgctgtgctggctggccatgttacggccgctgtcccctctgctagctcgcgacaacgcagtccacgtccaaactcaaaaccgaagtgccaaaccatgtgagagccttcaggtgtacacggtgagcatcgcatgcatatatacctcctgtagaacgaaagggcactgcgtagttgttgtacgttgatttcaggaagctgcgtgcacgaaaccatcaggtgcgcggctcaattggtttttagcgcgcggcagcagagaaattccaccgttttcctgtcctcgctcgccatcatggccgtataaaaatgtttttgcgtgcttccagcttatcatgaacctcgtcacaacgaaacaaatgaagggcaattttgtgtgttgtcttggagcgcttgtcgacgtgacgggaatgtctatttaattaatcctagagtatctgtaaggtaccttggaatcacgaatggttgtgatgtcgaacttccattggccgtagcctcgacttgcatggcgatcgaccggccaaatcgtgatgcaatctcgtacggagtaatatacatcgtagaaatgctgcctgtcaagcagacaattactcatgcgtcgtctctggcgaattaattggccaggtcaccagggtcatggatgcagtaaaaataggtgccacacggtagtgataacctatctttaggtgcatgcatgcaacggaatcaacacaggtcacctttttgctgtgttttgtaaccattttcccttttccaaattagacatcacgcatttatcgagtggttcccctggagacgaagaaaattaagctagagattagctggtaaaacagttagccagttaagctctttgccctgcaagtattaagcctgcctcccaacggcctctcacctccgcccgacctctgcccctcctccgagagtccgaggtcgatcgccgtcgtcgctcggtcgctcgctcgcctgcctgatccggatccggcaggccggactgcgtaggtgtgccgcggcgagacgtgcgcgcggcggcgccgatcgacgacccgatcgatggacttcacctcgtcctacttccacgccttcggcaaccccgacttcgccgcggtcttctccggcggcggcagcgcgcaggccatccggccgggcaccaccaccagcagcagcggcggcgcgaaggcggtgaacgttggcaggggcggcgcggcgaggcagggcgccccgtccgtgttctgcgtccaggacgcggaggtggaggaggcgca

SEQ ID NO: 1852 - DNA, 1501 bp, Oryza sativa
ggctcggaggcgttggcatacatgagtggagagctatggagcgacaggctcacatcgcgccacgacgccaggttacgcaccgttgctagttgctaccatcgccatcctccgtacgtacaacacggctcgttttaatttcgtaatctgcttgctgttcctgagctagcttccgcttcgttcgggttagccggtggccgcctcaaacgtaagcggagcgatcagatccattggcagcgcccggttaacaccgctcgacagaacgagagggagccaaacgcatggaggagcctctgcgcgttgcttctgacttcttcagctgttggggtcagcgtctaagcgagcacttgtccacgtgatatcgcacacctgggagggtcttgtaccacgcgcgcgcgggccacaggtcgcatacttgcatgccagcgaagcgagagattctttgctctgtttcgtcaacccgtggacaggtcacaggtggacgtgtgatgctgcggacgttgttctcagaaccaaaaagaggaacaccgaaacgaaacaaaagtatcaacaatagatgaacagtggaaatatgctaagtttgtttagttcgcgaaaagaaaatctttaggtgtcacatcagacatttgattggatgtctgatgaaattttcggacacgaatgaaaaaactaatttaatagctcgcctgaaaatcacgagacgaatttattaagtctaattaatccatcattagcacatgtggtttactgcagcacttatgactaatcatgaactaattggtctcaaaagattcgtattgtgattttcattcaaattgtgcaattagttttttattttatctatatttaatgctctatgcatgtgtcaaagatttgatgtgatgttttgaaaaaaaaattagaaggcctaatggaactcaccaatcacaagatcaaagcgacattttccacatacagccgccgtcgggcaccggggcagtacagcgagagaaaaaaaatccgtcgtatttttttcacgaaataaataacttgaggggaacaagttaaattgagtataccagagttgaaattaagagcggcacaaggaaattagaaaatcacgagaattaggatgtcatcggtcgcccacccatgtgctgcacaggcttatatatttgtactttaaaaggtttaatcatgccgtaaatatgttaggtgttttttttataacactcagttaaattataaaaaaatctagtacaacttgctaattactatatcacaaaagaaaaaagtacgaactacccccgaactagcgcggtcgtccgaattaccccctgaaccacaagaccggacattcttcaccccaactatgtaaaccggacgaattaccctcctcggctcaatccacggtggtttttatctacgtgtgtacgcgtggcagtccagtcagcattctatttataaaaaaaaaaagtgggacccacatgtcatactcttcctctctcttctctctctcaatctg

SEQ ID NO: 1853 - DNA, 1501 bp, Oryza sativa
tgccatgactttacctcaatcaaatcaagactttctttacggagtgtagctggtcggcatcgatctgcatagctagctaggagtacttaacacaaagggacctggtatgcgtatatatctacagcctatactgctatatacagtctatagaaagtcacagcctgaggagaatatatcacgtacacctgccatgttgcgcaaaacctgccctgaaaatgtgggatttggcccttcccgtcacatacgtacctcagctagccaaccagctggtacgtatgagtacatgcgctagctgccagtagagctagctgcatgaacatcttccactaccaaaagcaaggatgcttatgtccatgatgaccctgcaagtaagtcacctgtacgtgtaacacctatcctgaggtccatacgacgtactacctctgtcccataaaaaataaatttctaaagaattaaggacatactaggaggataggcaaatgactacaataaccttatttaataaatacaatacatgcacatattccatatataaacttgattaaaagaaatgttgagataatgggttagagatgggatagaaggaaggaagattacaagaaaatgtaattagtttactgggtcccatattagtagaaatacaatttttatggtacagaagttaaaaggtagaaattcaatttttatgagacggaggtggtatgtatatacgagacatacggataggacgaccaacttaaattgcctctggggctcaaggccagttcgatctacagattaaattgccccagcttgctagatcttgcatgtataatcgccgatcattttggatactttttatctgataacaccatcagacgatcgacgctgtgagatgtcactactacacccagcaaattaatggcaaccgatcgttgggcgatctctccctctctctctctctgcgatctagcctttcccagtttgtgcaacgatctaatgtctgatctctccttccctccgtggcgtagccaccacaaagcttttcttgctagcatggccggcaatggaaacgtacgactggagcatgctctccctgcgtttcgagaaggaatattgacactttcggggtggtgatcgaacctgtgccgtgggtcggtttgtgtatggtggcgtggcgtggctagccagccaagccggcccagtcagtggtggatgtgtgagtgatgcaggggagatctaagcgaaagatatgcgccgcattgatgccacaggggagggagggctacttgagtagttgagtgtttttcccgttctggcgctggagggaatcgtccgtcgcggccagccagatcgaacgcgctttaattcccttgcctatgtacatcaactgtactacgcgcggacgggcgcgcggcgcggcgcgggccggacgtgacaggagtcaggaggagactgaggcgccggcgcggcggggcggagctagtatagctaggttagcgcgcgggcgcgcggcgtacga

SEQ ID NO: 1854 - DNA, 608 bp, Oryza sativa
tttaacgtttggttatttatcttatttaaaaaaattatcgtattattatttattttgtttgtgatttactttattatcaaaagtatgtcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgc

SEQ ID NO: 1855 - DNA, 1329 bp, Oryza sativa
ttcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatatatatatatatatatatatatatatatatatatatatacatatacatacacatatatatatatatatatatacacatacatacatacatacatatatatatatatatatatatatatacatacatatatatatatatatatatatatatacatatatatatatatatatacatatatatacctatatatatatatatatatatatatatatatatacatatatacacatatatagatatatatacatatatatatatatatatatatatatatacatatatatacctatatacatatatatacatatatatatatatatatatatatatatatatatatatatatacatacatatatatgagttggatttttggcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttc

SEQ ID NO: 1856 - DNA, 1501 bp, Oryza sativa
gtctggagaaacagtaagtcgttattttaacaaagtccttcatgcaattggtgagctacgagatgaacttatcagacccccctcattggacactccaactaaaatagcaggaaatcctagatgggatccttactttaaggtgtgagattcattcctatctcattttatatttatgtgaacattgatgtattgtccctaatttttaatgttgttgaacacaaaataggattgtattggagctattgatggcacacatattagagcctctgttcgtaagaatgtggagtcctcttttcgtggtaggaagtcccatgccactcaaaatgtaatggcggccgtagattttgatcttcggtttacttatgtcctggctggttgggaggggacagcacatgatgctgtagttttaagagatgctttggaacgtgaaaatggccttcatgtcccacaaggtaatagattactatagtttatcaaattctccatgacaaatgttgatatttaggaatgtgaccaacttatcgatcatatgataggaaaattctatctagttgatggtggatatggagccaaacaaggattcttgcctccttttcgtgctgtccggtaccacttgaaagagtgggggaataatccggtgcaaaatgagaaggagttgttcaaccttagacactcatccctccgtataacggttgaacgtgcatttgggtcactaaagaggaggttcaaagttctagatgatgccactccattcttcccatttcgaactcaagtagatattgttgtagcttgttgtattattcataactgggtcataaatgacggaattgatgagcttgtagctccgtctgattggtcaagtgaggacattgatgaatcgccaacttggcaagcgaatgaccatgcattgatggttcagttcaggcagggtttagctgatcagatgtgggctgaccgtaataaccatcatggagtgtaatatgtagctatgcaacttgtatttctaccttatttgctacatttcatttgtattatgaacttctttatttatttatttcgtgtggacagcttgttgtagtccatttgccaaatcttagttgtatggataaatgtattgttgtatgctgaatttctggtttgatgaattgatgaatgttgaatttcttggttaatatgttgctggatgctaatattctgggttgatatgttggtgaaaggtaattttttgggttgatatattgctgaatgctcatattcccggttgatatgttgtgaatgctaattttttgggttgatatgttgctgaatggtcattttctgggttgatatgttggtgaatggtaattttttgggttgatatgttgctgaatggtcatttttttattagatatattgctgaatagttattttctgagttcatatattgttgcatgcataatttattgatatatatattactgaatggacatttttgttttattttatgataggtaggaaatgg

SEQ ID NO: 1857 - DNA, 1501 bp, Oryza sativa
aaaataaatacgatatccttggaatactctcgggtgaaatgctacaatggtatatctgtgcgcttacggatgaactctagagttgcggctttggtatatagccgcctatcgccgctcgggggagggggaggggggcgccgctcgccggtcgttgctccgtgtcgccgcagtcgctcgggggaaggagggtggtgggcgccgccgccgcctccgctcgaggagattgggggcgggggaaaggggaaaaatgaatcctagggttagggttagggtttaggtgtatttatttaggttaggattaatctagaccgtccattcgatcggacggctccagctgctcccgggtcatgccgccggcatattgggccaccgaatggaggacacaaaatggacttcaacggaaaaaggaaacaggccaggcacattgaatagacaaaagggagaaaatataaacttttctatattcggcccaaacctagaatgaaggattttaattctttttccaattaaataattgttaaatgatgtttgtattattaaacattagcaattaagctttgataattccaataaaatttcaaagagcgtaactaatcgtggagaatttagtaaaattaaatttaacaatgtcattttatttctcacactggctttacttgtaaattgatttaattatacacttacctacttaaaaataccaaatattttagcaaatttgtattttaattaattacataatgtaaatttttcttaaatttttcttaattttctagtctgtacactttccgttgcaacccacggacactttttgctagtaatatatttttccggtcgtcgcatcttttcacccgcgtgatttttcgtcacatctttttcacccacgtgatttttcgtccgtcacttcttcgtccgtcattcatcaccgcgtcgttcatcaccgcgcctgcaatgccggtgtccgattcagaaatttcgaagaatcggactctaattcacccaaacaaaatcagtagacggattcatgggagaaaccaggaatcaaattctaatccaccctaataaaatcagcatagggatccatgaggaactccaatccacccaataaaatttgtccgtcacaacacccccaaatcccatcccaatcggaattcaatcaacccccgaaaaaatcccaattggaattcaatcgcacaaataaaattggaatagcggtgcatccacgaatcatgtgcagcaagcaagcccaccaagcccaccagttgcagatcgatgctaaccacttctagatcgaagaagtggcgtggggaaggaggtcttctatctgcccgccaacgtcacgcccttccttcccgagcgccgccgagccgcccgacgccgcccccatcctccttctggctcctggacgccacgcgtgcgtcgagctcgcaccacgccatcgccgaagccgaaccaagctgcgccgccggcccaaagccaccgcggtcctatcgttgccgcgccc

SEQ ID NO: 1858 - DNA, 1501 bp, Oryza sativa
gacccatcgcccaatcaacggctcagatcgtgtttcagtcgataaaaacagtactacctccgtttcataatgtaagtcattctagcattgcccacattcatatagatactaatgaatctaaacatatatgtgtgtctagatttattaacatctatatgaatgtggataatactagaaagtcttacattatgaaacggtgggagtatagaagaaaataatagactgatattttgtttagcacagctctcctaatcggccggcactggcatatagtatatcggcaaaagtaaacaatagtttgacataatcatatctggtcccacacaaaataagcaaatcttaactgaaaagaaaactataactaataagatcgggcattgcacgcgctaaataatcagctgcaaaccgacaccaaatcgccatgcttcacgcggtcttcacgcgcatgcacagaccggttgcatccaaattctcctctctcagcaacgtgaaatccttctgtgcatctcctgcttcttctttttaaatcaccagcaaacctttgactgcatcgatcaatgcatcctcacagtccaagattccaagtacatagctactccctccttccctaaatatttaacaccgttgacttttttaaacatatttgaccgttcgttttattcaaaaacttttgtgatatgtataaaactatatgtatacataaaagtatatttaacaataaatcaaatgatagaaaaagaattaacaattaattaaattttttgaataagacgaacggtcaaacatttttaaaaaaatcaacggcgtcaaacattttgggatggagatagtactaacttctcacataacaccaaatgataaaatgaccctctaacttactatacaaacaaccatccagtacatcacaaattcctatacaaataaattgaggccctctttgtttaggcttataagccaacttataagtcgaaaagtctaagcctaaacaaacaagtagcttttctgtttggcttttttgaagccataagccactctaacactattaagccaaaaactaggttggagaagtgtttttggcttatgtgaggtagatgtgtgattcaactactaaacttaggacattaaatccaccggcttataaatcatataagccaataagctgacttaaaagtctaggccaataagtttaagcctaaacaaaagggcctgagtagattttccaagtaaatcagttgcatcatgcatgtattctaaaataatctcgcctgcacatatacactactcctagctgccaaggctatatatatacatgcacccatggtcatcatattgatcccacgaacagccagcccaggcaacaaccctgtagatatgacactcgacacaatgacgataggcttgccagtaagagaaggtgtgagcagcgcgaagctcaccctcatcgtagcgtgttttctgctaccgtttcttgtcgaggctgaatcgcgggcaccggcgccac

SEQ ID NO: 1859 - DNA, 1501 bp, Oryza sativa
aaggatgtgattttgcctagctgatattgactgcatcattctgggggagaaggagcctacctgcatgtgcgtctaatgagatcggcacttctgtattggatgagaaggcatgcatggacaaatccacccgaacgaagtcaccagccactaccattgtgctcaccaccggtcgatggtgtcagccattgggcaagcagatcagctactactaagcttctgcctggccagatctgccactcctgatgaccgccatctccccacatgtgaagaggatgaacagtggaatcaccagcgtagtaatcaccagaaggtagcattggcaactactgaccttgtcaatctgccatggctagagatcggagcagattaatcgaccgcctccggaacttgccaccatcagatccattattagcaagtccagattccataggaacgactccggcgacctcagtcaaaacaggacattgcacgaagatacgggaaaaagcccaagaatgggtggaacccaacactatactggctaaactactactagtaggaaggggcttgacccctctttcagccatcactggcagtgagctgccggaaccgagtaagagggatcgagagaaggggatttttctgtttgtcgcctttcttattgtttccagagagctccccaacctccctatcttgggagagcgccagaagagcacattgtgatgaggacatcactcctttggatatacacaacaatcatccatcggtcattcaagaaccaatcacaagagctcgcacgcaacaattgaatttagatgtgagctcgttcctatgtttatctttatatgattttgagaacagattgctacctaatgattatattatgattaggaataatggagaggacaaggagacacttagagagggacttagaggtgtggaggatcagcaaggaggtccaagtcaatatggaggcccaaaccaagtcaacttcaagtacgtttcgtagtctaggaccagtctgcactaaaatgggtgcctaggtcgcatacgtgctcggattggggctttctttatatggatggaaagctaagaagataacatttccaatggtttggtcccatatccaaattctttccgagtcattgggaatcgaccaaacaagttgacatctagaatctgtttcggtgttgcgtcgccgtattttggtctttgggctatgtatcgtgttggagcccattagggttgcgtcaaggggtatttgcatgaccctaaactctatatattagtagctgctgccacctttagggtttgggttttgcttagattaatctgtcaagaatagtttcgctgatccttcagtttgtaagaccccaacttgtgagcttaatcattcatatacattttgaatgtattctttcttgttcttgtttgtgttcttcgattcacaaatagggattagccttctcggtgaggtcaaccgggtttcgacacgtacggttgataaccagagtagacgtgg

SEQ ID NO: 1860 - DNA, 1501 bp, Oryza sativa
ccaattacgacataccaacttaccaagggcatgcgcacatagaattgtgctaaacccaccgctgtccgctctcggcttttctcatcttaccgtaggccaattctcttccttatatataatttttacgcgatttgacatcagaggatggagcaatttggcatcaggcttccacggcgaggccaatctgcatcacctgcccgctcgatccctgaaaatcttcttccgtttctctctggagattgctgacagcgaggctgcggaagcaggcgaggggttcagggctggtgactggtgagatcgatctctcatctctccgtcttgctatctttctccctatctctaagtcgatcattcctgtaaattgtattgctggtaggcttttcttgttacctttgctgttaaagccatttaggatttttctattgcctgtgacctgtttgtggaaatgcctcaaaaagatatcacagctcacaggggcaggattctaggttcccaggtgaaaagcaacatggaagagggaggaggatgaatctgagtttttttagagtatttctttttttgtatttgtaattggagaatttagattatttaccacctaattctcttgtaattgaggcattcattttctaaatcatatttcttttggctaactgcactatgagcacctgcaaacaccaaaaggtatactattagagcatgattttcatacatatataacagaagtttcagtaaagctctactgtaatcagattctgctttattgaattgcaatttctggtttagtgatacaggattttaggtgactatgcaataaggaaattcgtgcccttgtgtgcgtttgggggctgatgtttacaaaataataatcactatgttgaggatgttaaatggaacttgtttgctctttatatttagcattgtcttgcactatgtctcttaagggttatattatacgagttacatcatccagaattggactagaagtagaacttcatatttggaagtggaattaccagtctaattcggatcataatataacagtcatcatcccctaacaaattttgaccactagcagctacatggcacaggtaacaggtaatttagttcatagtatatatttgccataaggcatgcagatagggactaagcccagatcaattggtgagaggtgtggatgtacaccaccatcaccaaagttcagaaacctcttggactcaacttgggtctctatttcttctctattaatttgataccaagttcctttttagtatttgtttttgtgtcaatcaattaatcttcacaaatataacgcaagtgttcttgaatcttatataatatctttttctatgaaatcacccatttctaacaaaagttcactatttagccttaaaagtcatgtgctgattcattttccttccttatcgagtggcctatattgtatggcatccacaggtctgtcacatattttactttttttcagaaggctcagttcttacaacta

SEQ ID NO: 1861 - DNA, 1501 bp, Oryza sativa
ttgaagcctaggtccagtgcagcaagttatgggtgttcagaaattttattttcgattaaagtatataagaaattaggatcaggatagtgctaacagttgcatttaccatttatcttggatgctgttggtatttcttaactttacaaataaaatccgcaagcgcacggaaaatactgatgtagcacttcagccaggagtattctcaggtattgatttccacagggaacgtgtgtgtcagctctttaccaggtttgtccaaggacacgaagctaatgataggcaaaggatagagaggattcaccggtgagaaacaatgtctacggaaagcttaacttaatcctaacgcgatacttcgggcactggccagcttgctgctcccagatatcgctctattacgtacccggacagggaggacttacacccacctctacacccaccttacacctactgtgggatacggagcaaacaccataaatcaactacttagacaccgcatctaagcaattaatagctactgtagtgtttataactcactaaagtaatctatattataatagactatagtgaacgatgatcccgcacgctaattaggaactaaccaagagataattctcacagagtaaattttaattacttataatgatattcaattaatgcagagtaattaacaagataaaaaaggtaagaagagaattaatttgcatcgacaacttcttctacattactctctctctattctaatatacaataaagtacactagagcctcttgtaattcagctcatgcttcaagtgtgtgtgaatgagggagaggacaggggtatttatagtgtggaggtgagttgagagagtggagatactgtgaaatattcaacatagaatcctaagagcatcttcttaacttctccttttgccatgtgtcctcttgatgacggtttccaccagtattaacgctcctaaccgtcataggatgaggataactatcagttggtaaaatattgtgctggttgggctagctgctggttcagccgaaccctggctggcccatccagcctagctccttctctggtgttctgacatgtgggtcccactatatgttctactgaagtttggctcaagataaatgtatcttattgggtttgtgggctcaaaactctatggcttggatatggaagttatattctcatccttcatgtacatttcatctcaactttggtgggttgcatcctgcatacaaatatacactaacactcgtggaaatggttagaaataaatcctaccactatattggatgttttacttttatggttttatgcaggtattgacagcgagaattttgtacttaatagccgtccacagatgccacttggtttaccatgctagacttgccatttttctatatatcctagcatgctagtgacgaattatgatgacaagcacaatgtggatactttactgtgattaccaatagagcattattatcaatgatacaatggcatttta

SEQ ID NO: 1862 - DNA, 1501 bp, Oryza sativa
ctcgttttacctttgcgaggagaagaccatcgggatcacggagtgtgcagaccccgccccagatatgtgcgtcgtagccgcgcgcgtcgagacggccgacactgatgatgttcttgcgcagcttcgggatgtagtacaccgtgtcgagagaccgatgatcactattcttgcatcggaacaccacggtcccgcgcccctggatttcaatcacagagccgtcgccaaacttcaccgtcccaacaacgccggtgtcgagctcggcgaacgccgaacgcactccagtcatgtggttggtggcgccggtatccagaaaccaatctcttgtcacctcctcctcaccaccatcctcgtggtccaggatcaccttcttctccgtgaggtgtacctcctgtccaccaggtgttcgtccgagtgtcgcctcgccagcaagtgacacccctacgacatgtgccataagcaacgtcggttcttcctcggcggcttgcaccaggttcgcctctccccggcgttggcgtcgtggcttgcggcactgccttgcatagtgaccaaattcatcacaattgaagcactttaccctcgagatgtcgcggctgctgttcgcaccagtggccgcctctttgccctttggcgacccaccgggcttgcctcggtgattctgcgtgccgggcgcgccgcggcccttattgccgctgttgccggagccctcctgctcccgctgcttcacacgtgcctgccattgttcctccgtgaggtacaattttccgccatcgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtccgcgacgacggcagtgagccgcatcgcaaactcctccggcgtctccctctccttgaatcgcatcgactcaaattgacgacggaagcccttctccttcgcctcacgcacacggtcaacgccgacccgcatggtcttgatggcgtcccacgccgccttcgccgtgtcatgctttgccagcccgcgcaacatctcacgcggcaccgcctgaaggattgccgagagagccgcccgatcttcacgaaactccgcgtagccgggatcgatcgccgtccacagcccctgcgcctgcaggttgacgcgcatcaggagcgcccaatccgggtagtttgtcctcgagaggactgggaggcgagcggtgtgcgatgcgtctctcccctgagacacgagcggaagtaatgcgccgtctgctccattccccccgccgctgccgcttgcgccgccgcggccgttgccgctccccccgccgccaccgccaccacgacggccaggcggtgtgtatgacatcgccggatcgttccagtactgctctgataccaattg

SEQ ID NO: 1863 - DNA, 1501 bp, Oryza sativa
tctgcaaaactagcaaagtcttcaaatacctttgttctatgggccttgacatgcatctcgacaggtcaatttgacaactaggtagtttcttaagagcaaatggatgagcatagatgctctcacatgattagtaggtggaattttattccctcttgttttcaattgaccaataattcatgttttacaagacaccacctctaacatatatttactatgcatcatatcaagctaattgttgaatatgacttgatatacaagtatacaactcttacctcctgtttctatatatatgcaattatattctatatacaatataaatactaaaagtagaattgggcttaatatataactcttatattgtgtttccatagatataattgtaaatttatacaactgttcctatcattctacaccgttataatttggttatatcatgatgtaatgttttatattttatttttttctccaagtaatgttgtaatttctaggccttcacatcgaacatggtgttttcttttagagctatctttataatataaaagatatgtcttcaaaatttccttttttttcaggtgtaagtagtaactaatgactttagttctactggatgtttcttaagttcaaatggatgacagcaggtgctctcacatggttatttagatgctaataaggtatctagagtactgtagtgttatagttacctgtgaaccatattttaagtggctgatcattggggacacatcacaacaagcacactcccatctatttcctctgaagcgctcgtccatatttttctagtgcaccccaaagtcttcactgctgcagtgtttccttgtgttcttgtcagttgtgagcgcaacaatggctgaggttgttatcggaccactagtttccatggtgaaggagaaggtttccagctaccttctagaccagtacaaggttatggaaggcatggagcagcagcgcgagatcctggagcgcaagctgcctgccatcctggatgtcattgaagatgcggaggagaagggagcttttcgacctggagtaagcgcttggctcagagcactcaagaaggtggcctatgaggcaaatgatgtctttgatgaattcaagtacgaagccctccggcgcgacgcaaggaagaaggggcagttcaacatgctcggcatggacgttgtaagcctctttccttcttataaccctatcatgtttcgtaataagatgggtaagaagctacaaaagattgtggggagcattgaggtccttgtctcagagatgaactcctttgggttcatacaccggcagcaagctccaccatccaatcaatggcgtcaaacagattctataatggctgactctgagaaggatattataagaagatccagagatgaggagaaaaagaagattgtgaagatattgcataatcatgctagcagcaatagggatctgttggtccttccaattgttggaatggctgggctgggaaaaaccacctttgttc

SEQ ID NO: 1864 - DNA, 1376 bp, Oryza sativa
ggccaccgccgcgctcgcctcatctccgcgccaccgccgctacgagccgctgttgccgactagggtggaaaaaaatcttgggctcatgagctcagctcgggcttggctcgagctcgcttagctcagcttggcttgaatgccaaacgagccaagcccaagcttcattttcagctcggttctgaaacgagccgagcccgagctggctcgtgagccgcttgatttggctcgtgagccttagccatcatgtatttatatggatgattttattttctagtggagttattatttgtcaatatgtaatttatcatctatattttgatgaatttaatatataaagttattttaattttacatgttgataatttgttatcgcttttcttaatgattataaattatatagcttcaacggaaggctcgcaagccagctcgagctggcttgagccaggaaacgagccgagccaagctcatgtcttagctcgcttccctaaccgagccgagccaagccaagcctagcttgttgcaagccattacaagccgagccgagccaggcttggcttggctcgtttccacccctatcgccgatcgccggtccctacgctcgtcctcaccgtgcgcgctgcgcgagagagaaaagaaagagagagaatagagaaagagagagtaagaagtgtatgacatgcgggtcccacaattttttaattaaaaacgctgactggactgccacgtagaccaaaaccaccgtggattgggtcgaggggggtaattcgtccagtttgcatacttgggggtgtcagggttatggataccacatacctaatagtagttgactaaatctcggcaggacccaccacataccatgtcttatacggaaacaaccttcagatataggaggagttccgcataaggaaggatgaatagagttctacatggaaacgacaaggactacttggattgtatccatatttatttccctagttctacttggacaaggggacacctatgggtataaatataaggcctcctagaaggagaggggacacggaacaatagatcaagatacaagatcaacatacaagccaacatgcgccaagacaagacgccggatatcgacttcagagataagcatgactagtcccctacggtgtctacggatactgtcaggagagatatagcactgtctttgatctcgccggatgtggattcgaggaggaagggtaccctgttgtcgattacgagtcagcacttcggactgccaagtcgataacagttagataggctaccccaaatattgtactggtgtgattatggtgaataagagcaacgactggtttcgaccaactggagtaggattattacctgacaattcagggacccga

SEQ ID NO: 1865 - DNA, 1501 bp, Oryza sativa
ggcgccgacgagcacattactccccttgacgtcgccgtgcacgacgagcttcccgtggaggtagtcgagccctctaagcacgtcggccgcgtacgtcctgacggcgccctcgtcgaggcgacccccgtttctcgccaccacgtcggcgagcgatccgccgggcgcgtactccaggaacagctggtgctcgccgccgccgcagccgccggaggcctggacaaagccaaggcacttgagcacgtgcggcgaggacagcccggacatgacgctccactctcgccggagctgctgcctcgcggcgccctcgccggccgacttgatgacgaagagctccccggagacgtcgttcgctgccagcgacaccacggcgccggaagcgccccggccaacgctgcggaggcgcgtccatccgccgccgccgatgatcgccgcggccattggggaatcggaggcgagagctgggttgagttgttggtgtttccggattagggttgcgaatgctgctgctcgagtcgatcgaggagagtatttatttaatgcgtgaggctggcatgtgggacccgtagcgccgcgcattgcagtgtgaactgtgaaatgcactagagaagcgagggggccgacaagattattgctatagctggaaatttaccagtgtgctctgttaaggaaaggtgtgtttattatcctcttttttatttttaatccatgtggattaagaaggaaacgagaggtaaaaacaaaaggatagacgtgtttagtgtatttctttctatttttttccctgtgtaaaccatggggtggaaaacgtggagtgagaaatagtacgcttgtgagcaaattttgcgtttttgcatgatccattgtaaaaaaatgaaatgttaaaataaattattaagaactactctctctctcgtcgttatatatggaaattttgtgggtccaagactagtcaatgtggtcatcgagctaagaaattaagatctatggtgcaaaatgtgcctcatatctttagaagtgattaaatggttgattaatcatcatccagtaaagtccctgaaacatgcaataagggacggttaaaggtatgtttgtgctactttatattccattcactactacagaaccaagataaccggtcaaagtgatccgtctcagataacatgagctctaacatgtaaaaaaaaaataccattcgagatatgacaaaagggaactacctgtatatgatgtcatctatgatgagtcaaaattataaaccgtcaaagatcatatatgatgaccccacatatatggcaggtccaatcatatggcccaccagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctct

SEQ ID NO: 1866 - DNA, 1501 bp, Oryza sativa
tcattccggatctttgaaaatcaatatatttatagacaaccagcgcttaccaacctctgcgggatgtacgtcatgtggtacatgctatgttttgtagagtctgggcaccttcttccccgtaatgctgaggtatgacatgtttcagggacttacgtaataaattagactattctattgaagtacgaaagtaaatttctatgccttccacccttgtgttgcagaagttgggtcttgaaacaagcgaaatgctgccacacgtcttcacagctctcaccgactagttttgcgggcctgtccatactcatgtcatagatccaaatggcacttacaatgtcaacaagctcccacaacaaagtgcaatcctctgctcctacccctcaggaccaaaaagtgaagaaatcaactactaagaagagaaaaaccaggtaggtagatttgtgtgaaaaattgtagttacttagtgcttatgcatgaattatggatgtgacacgtcctagtacaatgaatctggacagaccgtgtgtccagattcattatactaggatttgttacatccacccaaaatcccttatgttatgggacagagggagtatgtacaaatgttttggatttggacttacaatatatatgtaaatgtttagagcatctgagatgttgtagagctctagcgatttagtcaagtttcctgggatgtgtaacacatctggtcgccaccttcgtgtggtttgatgagcacatctcaggctgaagttgactggcacgctgagtcccaacaatatctcatttgctctttactcgaggatatgaatgtgaattatatgcaaatgtctagaatttacacttataattttctggacttacgaattttagacttgtgaatttctgacctaaggatatatgtgcaaatgttcataatttagacttaggaatttttggacttaaaaattttaaactaggaatattttgagttaggatatatatgcaaatgtttaagatttaaagataggaacttttggacctacggatttttagacttggcaaattttaacttaggcttgtaggtttttatttgttgtgatgaatgtgaaagtgaatgaatgtgctgtatggatctggggctgtagggatggatttgggtttgtatggaattggggttgtatggatgaatttactgcaatatttttattacccaacaaataggtgccggattttaggtttgaaccggcacctattaggaccatataggtgccggttttaacctaaaaaccgacacctattaagaccatataggtgccggttaagacctattagcggcactattacctaatatgtgctggttctaaaaccaacactgatggcaagtattatcagtgctcctttgtgccggttgggaaaaccggcacctattatggttttcaaaccggcaccttttacccttcctgtagtagtgtcctaattatacagtcaattgaacaatgcagctagatggtgtctaagaaaa

SEQ ID NO: 1867 - DNA, 1501 bp, Oryza sativa
ggtgatggtacttcttcttggtagcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcagagacgggcggggcgtggacacattgcgcgaggagggaggagcattggcccggggccacgacgtaggagggataccgcgattctgccatcagccacagctacacatactccatcgctttcatccccatcccccagtggctgcacatccatgtagaagtgggcagggaagtaggacatatgtcgtggtttgggggcagatccgctaaaaagtggatatccgcgcgcccttcccctgcgtggatagacgcgtgggacgcggggcgcgcccctccccctgcgtggatgaacgcgtggcacgcggagagggggggcagtcgctcgcgcgtgggaagcccacgtgggtgggtttttttggttggttttctttttaaaaaaaatagttttctctggttttctttttctttttttttggttttttggttttttatacgtgtggatacaaactttatatacatacatgtatataaactttatatgctcatatacaaactttatatgcgtgtgtataaagtttgtatatgtatatacaaagtttgtatacatgatatattttttagtattttaaattttttaatacgtagtatataaactttgcgcgcgcgcatatatatatatatatatatatatatatatatatatatatatatatatatatataattatagtagtagtactagtattaatagaactactattactactattactggtagtggtaatgtggtagtattagtagtagttgtagtatttgtagcagcagtagttatactaatggactaaggcgggcaaaactgaccgtgcgggtgcagccccgcgcggctggtcaccgaccaatcacacccgggggaggggggtctggtccggcaccacgcggtggagagaatggagtggggttcggcaggcggccgttctctccctcaaatttttattttattttttgaactttttaaatttttaattttaaaacaaactctttcaaaacttattttcaagatatgaaccttttggctacaccagttagattggcgtggtaaaataatactatcacattggtctggctagtatggcagcgttatttggtcacgtcggtctggctggcgtggcaacgttatttggtcacactattctcgctagtgtagtaggacaaaattattatgctcgctatgtgtggggtgtcagtattgttttgccacgccagactagttgatatggccaaaggtttagattctgtaataagttttagaatggtctgtttttataatttaaaaataaaa

SEQ ID NO: 1868 - DNA, 1501 bp, Oryza sativa
ttctttgatgattccctgcatcatgcctctattccggtatgacttgctgagtacagtgggtagtactcagtcttgctctacttttcccaaccccagagtacgagtatgtgtcagatgaaggtttctccgaggaataggctttgcccgtgccgtcgaggatgcctgtggagtggtgttcccgctgcagttctagtcaaggcttagctcctgttgtctttctttctttccgctgcatttatgtaagacttttatgatatttgtaagacgtggatctgaatgtcaacattgtcgtttgtgtacccccgccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaagatcagggagccatcagctgggttgagcgttccaccgtgagcatagtaccagaacttcgatcattccggccaattagcggtggccggttcgatacccctctcaagcaagctagcctctatctcctcccacttcggcatcgtgacgctatagccgcctgaccccaagtggtgatggtacttcttcttggtagcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcagagacgggcggggcgtggacacattgcgcgaggagggaggagcattggcccggggccacgacgtaggagggataccgcgattctgccatcagccacagctacacatactccatcgctttcatccccatcccccagtggctgcacatccatgtagaagtgggcagggaagtaggacatatgtcgtggtttgggggcagatccgctaaaaagtggatatccgcgcgcccttcccctgcgtggatagacgcgtgggacgcggggcgcgcccctccccctgcgtggatgaacgcgtggcacgcggagagggggggcagtcgctcgcgcgtgggaagcccacgtgggtgggtttttttggttggttttctttttaaaaaaaatagttttctctggttttctttttctttttttttggttttttggttttt

SEQ ID NO: 1869 - DNA, 1501 bp, Oryza sativa
tttaaaacagccttgaaaggaggcaacacgttcactgtagaggctagaaattccaacattaatcggagaaaaagaaaaaaaaatacacgccattagattatagtgggtccaaattataacggtcgagatgtttcttgacagatatagaaagatatatcttgctctttgtttccgactctagttgtcataccgaagcaaatagattgttattaataccactggtcatatgccagccaaaaaaagagctttattaaggtacgttccggccggtcaacgactattggctggcaaaaaaaaaccacccatcgtccggtaatccataaaacacagctcttaatctttaaggatgcatatgactaaaactattaaaaaaatccatataaattagtagtaatataatttaaaaataactgaaattcaaaaattagaataagtaatattgaaagagaagtccatataagacccaatacgagatcaattaaaattcaaaataaaaaataaaataaaataaaaagagttcaagtaggaatacaattttgaaacaactgaagttggaaaaagaataaaaaatattaaaagaatagtgcatatagaacacaatacgagattaattaaaattcaaaataaaaataaaataaattttgaaattagaaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaatgccaataaaaaggggaagcaacaggcgagccgtagagaagtccagtggtaaacccgtcacccctgacggtttggcgggacttctagaaagtaaaaaatgaacccaaatgccaattatgtttgatttttgaaattccgatgacaataaagagaaagtagcgaccgggccgtagagtagtatagtggtagcgtttgatgggacttataagcaacatgtctgaaaaagagtagagtggtgacagttgatggggcatctaaaaactattaaaaaaacccccaaatagaatttcaacgacgattaaaagcaggaatgatggacaacatggtcgcaacggttggcgggacttctaaaaattaaaaaaaaaaaaaccccaatggtaatcatgttcaattttaaaatctcaa

SEQ ID NO: 1870 - DNA, 1501 bp, Oryza sativa
ataatcggacaaaattgcaacttggcctctttttcttagcaagattttatttatttttattatgcagacaaatctggcacttaatttagggtgtgtttagataatgggaaatggggggtggggttgtgatttggaaatgaatgaagggttagtattaaatggaaaagggagaatgaatggttacgatttaaagcggcgcatcgagcttgtcaacgacggaccgacctcggagttgcggatgaagctcccgtaccaaacgatggcgccgctgagctctcgccatatccgtcggctctggccttggacggaggtgacatctcggcagcggtggcggcacatcgtcggtggcagcccgaatacggcgtctcggcagcatagcagctcgaccgtcgccatcttcccttccttccttctcatctgacacacacatagcctcagagataacgcaaagctccgacacactaacgagggtgctttgtttggctccgcgttcttcacttggtagcgggcggagcatacgtggcagggaatctggcagggaatctttgatgtggaagcccaacgagattgcgaatgggcgaacagtcgcgcgccccctcccctgcgcgactggacgcgtgtcgcatgcggagagggggcgcgcgggcggcggcacagcgcacggtttttcttctttttttcccacaattccgcacggtttcctctcttttagttttttttgtttttttctttccgcggtttttttgtttgtttttttgccgcacggtttctttttttacttttctttccgtatattttttattgttttattttttaatacgtacatatacatatacaaagtttgtatatgtgtatttttatatgtacatgtataaactttgtatatatacgtatataaagttggcatattttgtatacatacatatacaaactttgtatactacgtatataaacttaatatatgtgtatatattttttataatatacatatgtcggtgatatgggaccgggagtatcatgaccagaggcttgaggcagacgcaattgcccacgtggcctggcaccttcggggacgtcgggcccgagggtgaggtgtccgccctcctcctgatttcccccgagggggggggggggttgcgcttgccccggccccgagggccgaggcaccccgaccccttaaggaagtctgcgacacatatatgggataagtgagcacagctgtgctcacctaacagcatttattgcagtctggtcaagcgtgtcacgctgcatgcgacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 1871 - DNA, 1501 bp, Oryza sativa
tagccatatgttatcccggttgttttgaccattcaaatgtttgctttctaggcctcctttggaggacttcttgtgggatctgtgcaaatttcatatttgctacagcaatcatgtattccaaaaggaagctcaatccatacagtagacatcagaactagaaattttacaggagttccacgtgaagtctaagggcttgtttggcacagctccagctccacccctcctggagctggagctcggtcaaatagtttcagctccaccaaaactaggagtggagtaaactaggagtggagttgggtggagctctctcacaaaataaactagagtcatttccacaactccactccagacccaatttctggaactaaatttaggagttggagctataccaaacagaccctaaattctcacaaaattgcactcgctcctgctccggctctggctccggatctcctccccctcgccgccttcctccaatcgagggcgcttgctgcgcgcgccgtcgtgaccaccagaggagctgcgccatctgctcgtgcggcccttgcccgggatctcaatccctcagatgggccaaccctaaggccctgtttgtttaggcttatgtttagctgggcttttctagttaggacttattttcttcctggctttaaaagtagctgtttggtggatggcttactattgaatggtaaaaaacacccatcaggtttgggtttcttgtttacaagccgaggacattgtaggagtaattttctcacgtaataatattacttttttttcttgatgtatcgcttttaacactttaattgtttccttatttttaatatatacgaattagagatacaaataaatatccgttcctaaatccgattgaggaataatatgggatagatacgagatgagtgacatgttacctggcaccgtccgtaccaggttccaaatttgaagaaaaatatgttaggatatgggaatatcgtgatccgaccgaacccgcccgttttcacccataccattaccttggcagtagtatattagtgaaataatacaatcacaaatatttcatgataatatacaagtaaaataatataagcacatatccttcttctgtaaaaaaaaactggatgtttttaaggtttctcaccaaaattagtaactactaaaaatgatttaccccatgattcaggtgtcattttaataagtgtatatatacactcaggtactggagaatatttactgattgcaaaaggtaatgaatgctttcacagcttgttgccacatggtacatgacttacacattgcgccatggccataaaaattagggataagtccatttttcacccttcaactcttcgctttatcttaaaagggttaattggaatcattccattgcaacttcggctatttggaaatatgccattataattagcgaaaccggctaggtgccatcgcaatttcttccaaattggaaccatgccattatgtacgtctgaatcgccatcca

SEQ ID NO: 1872 - DNA, 1501 bp, Oryza sativa
gcttgttattgggttgaaacctggacaactttgcagaaacaggaaacaagccgaagaaacttgctactgggggccaggctcataaggcgagttgcaagtgaagtttatcaatcaaggtttggctggagacccaacgttaagaggctagagatctgaagatgaagaagaagactgtgctggcgcgtctgaacttttttcatttctgtttcccctctgtgcattgtgatacttgttttgtgctgtttcaacatcatctgcgtaggaaagccaattctctttagattgcaagttgcaacggtgccattgtacggatagcaaattatgtgcaccaataacaaatttacaatcaggaccatcatccctccacatttggaaatgaaaattggaaactcttttaaggcagaacctttcagaagatcttttttttttggccaaaacacacatccacctggagcccacgagagaggtaaaaactggaaagtgtgaaatcactgtcatgattaatatttgtgatgaacaattggctatgcaaatgatttaatcaatgaattggtttgaaaagatgtgtggatgttggtgtgagtgcgtgtgactaatgtgggtcaggttgtgatatctatgcccagaaacggttgttttgtctgattgtgtgcaggtgacttgaggtcagccttggtcaatggtgaggaccaggactatgttcagggaggaacagaggtctagtgcgatcgggataccatgtgagaaggtgactagagtcaggattcttggaggtcaacttcggtcaacggtggggatcggaactaaactcagggaggagttgaggtccagacggtcaaggataccgggtgacgaagttgaatacgagatggcacacggcggatggacatagtgtgggaaagatcttcgcaacgggcttcacgaggtgtgtgtgcaagcgttggtgttcgcgaagaggaatgagagaagatagagatgttcatgtatggtggagtgcatggttgctacagtacttgatgtactgtagcgtgtatgatacatgtacgtgtgttgtacgtgtgtgatcagtacatgcatgtgtgtgtatgtgctgagattggttgggcacgtgtgtgtggccgattggatggaaggctgtcatgcatatgggcttgggtgtgcgcaggtgctgtgcacgtggtccaaaagcagcagcaattggtctggcctgggcgaccgagttgggctcggtggtgacaagccgactcggctcaggcggcaagcagcagcagcagctagggaaggaggagtctgacttgggtgcggctgcggattttggagaaaaaggaaattgaagtatcgagtcatattgtgtataggagttcttcacctactttgaatagagggtttttgtggtataaatagagagggagcgtgaggtttcctgtatcgcttttcagagcatggagttgataatttagttagttttaagtttagtcgagatttttgtaaggagtgatgt

SEQ ID NO: 1873 - DNA, 1501 bp, Oryza sativa
tcgatgcctaagctcaagctgttgtttcttgtgtaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgagttttgtttcagagttgtcatctggctgcctcctgagtcaccattataattctgctgtgatacaatcacagttatatgttgcctgaacttatatggctttttaagtttctggattggatgtgatgggaaaataatactagcagtcagtttttgcttataaatgtcgtaatatcttaatcatgctctttccctaggttcatccaagataagcagatggtgttgcctgattttcttgtggcacataaagctcttagatttgcaagcaacctgctgttctggactttgttggaaaatttactagaactaaccaaatacccgtgctttgctatgtattaaaacaaattaacagtaagatttttagcacaattttgtcatgtagagatgtggagatgaaatatgatagaatcctatatatagagggattattttataacaacatgatagagtaggtgataaataaataaataaaaacttggtgagctgttggtaggttcattatcaccagcattgttctcttttaaaaggagtatagataatgttgaatgcttcaagtttaaaatggcaaaataacacagctgattcttacatgagaaccttatctattcaaatgtacagatgattttgcttagaattggggagaaaatgaatattgcaaatgaagtctggtactctgattggcattgatgagttgattcacaagtttcctgaagaatttctagtcgtgaagtttctgaaatgacaggagagtttcagcctgtctagcaggattgttttttcaattaaaaaaacataaaacagaaccattcttaaaactttcgaaataaatttgaaaactttttctgtgggaaattattttgatgcattgaggggatgttttctcttatttgcatgtcactaaaattgttacgaaaaaaatttaaaaaaaattgagaagatgtattaacatgtgatatattattacacaaacatacaagctcaaaatcaatttctacatcttgcaacgaaaaaacaattaatcgttgcaagatgtagaagttgaatttaaacttacacatgtttgtatagtgatatattaaatgttaatatatattcttaattttttttataaccatatgtaaacaacgagaatccactcacactgtctgctttggtgagtgactctcaaccaggtgcggacgtgtcctgtgcatcatcttcaaggtaagtgtggctcccgatcgtccacctctccaaaccatccatcgcacaaaaaccaccaccacactgtccgcgcatggcgcccagctctcca

SEQ ID NO: 1874 - DNA, 1501 bp, Oryza sativa
gaggttggccgcggcggcggagacgaatggcgaggcgaagcgtgtgctccgtctggatgccgtagtcggccagcgtccgtcgatcatccagctgcctcccggcgtgcatcagccgctggtcgtccgccgggatgcctgccgtacaactcaaaccaaattaacccccaaattcatggtacaaactggtaaatggtaatcaaattggaatgtccagcgatttggcaagaaatacaccaatccccccatacaattcttgctctgaagaaacacaagtggaagcaaactaatccaataaccttatcgatcgttcactacccaatcggataattttttttttaagagaaaggaaagctatgattttcataccctgaaatcctcgaatcgggacggttaaagaaaaggcggagctggactattccgataagcgcgagaggaaatgcagttggctttgccggccaccgacgagcagggcgaaggggaggagctcagctaagcgagttaatcaattatataccgttcttgtcgtggatcttgaccttgacgtcgccgatggtgtcgctgccctcgacctccagcgtgatgcactcgtccagcgtcctcacgaagatctgcatctctcgccgccggtcgtggtgctcgccggggtagagtgcagtgcagtgcagtggcagcgaccgcggcggacgtcgtggtcgggactcgggtctccactagtggcaacgctccttatagggaggcggagccctagttctccagtctctccgcgtcgctggttctgatggaccagatgacatgtgggccgtccgttaaagcccaacccattttcaacccatccgttaaagaccaccccattgcctcgcctctccgccgtcagaaaaaaaaaaaagagtacctatacatctctcgaaagatttttatgattgtatcacacagatttttaatctttgaattaaaatccgatagatataataaaaaacaaaaaacaattaagaaacaccataatggacactaaattaccatatccttaagaaaaagaccaaatccaatacaaaatttaaaatttacatgcgaagattcaaaaattacaatgtaacttacaaaatttacagtgtaagttccataaattacattgtaacttataagaaaatgcactgtaaatttgagtgagaaaatcgagtaagagataagaaaaaatctttcgagtgagatatagcaaaatcgaaaaaaaagtccaatttaatctatactactctctccgtattataagttactccatccgtcttaaaatataagtatttttagctataaatctgatattcatagctaaaaatatttatattttaggacggagggacgagggagtaagtcattttgacaatttttttttctatttaaacttctttacatttgactaattttatcgagtatcatttcatcacaaaacaacacatattatcaaaatatatttcatactatatttcatgaaactaatttggtgttt

SEQ ID NO: 1875 - DNA, 1501 bp, Oryza sativa
ggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccctgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaatgcgtgaatctccattcttccacacaagattggctacatgggcatcgagaaatataaatattaatgaattgttttttttacgaggaataactaatgacatgtttaaatggatgataagtagaattacttacccttgttcattgtgccaagataaaatatgtctatcaaaagtagacggagggagtactagttatttctcgtaaacaaacgattcattaatatttacacgatgcccatgtagccaatcttgcatggaagaatggagagtcacgcattaaatccgagaaagtccttaagagtatatgtggttggattcaaatatgcctatcaaaaataatttttttaatttagaaatatgcatatcaaaagtaaacggagggagtagcatctataggaatggtaatgggtcaaggtccctgagttcttccacaatc

SEQ ID NO: 1876 - DNA, 1501 bp, Oryza sativa
attccgtgttatatttaatgaaactaatttggttgtgtagatgttactaatttttttataaacttgtggattcattgcactaagatgtatctcatccagtcctaggttacaagattttggaccggagggagtataactggtgcacggtaaaaaaaaaaaagcttcttatgcagcatagtaaaatataagtgaatagtaggctatactaatatgcagttttattcatagaacttgagaaggaaagattttctcaaccaaagaaatttacatcaggaacattgacactgaatgttcagacacaaactctagctaatgtagggcaaaggagaggggggcacacggtccgcgcatacctccttgttggcgatctcggacttgtaggggaggacgaagttgacggtgagcttggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcaccctgctgctgcggccggcggcggcggcggcggcggcgcgggtggtggccaggcggcgggcggcgtggcgcagcatttttctttttcttctttttctctctctctcgtttctcctctcctcgctgcggctgcgggtgggtggaatggggttccagaggtgtgggcgatttggagggcgaggtgatgagtgtggttcagggtttacgaccgatatgcccttccgttccgtttcgagcaccggtgaaattcgaaatttcacgaaatcaagtggaaaaccggtaacttctgaagaaatttcataaaccaaaatttgaatacaaattccctgagtttaccgataatttctcaaaaaccggtcggttttggtgaaatttcgatcgaaatcatcgaaatttcgatcagtaattgggcctatttcatgcaatctggcccatgtaagtgtttttttaattttttattctattctttcatgatgtataaatacacacaatacttcattttttaaaaaaatttatatcccaataggttacatgaatatcatagtatttataagattttatttgattttttttcttttttatcaattcaaatttgaatttggatgaaactcctcgaaatctcagatggtttctactttcgagccttgtcgaaacgtcgaaatttcgcgaaatccgaccggaatcgtaaaccctggtgtggtcagtgggagtggaggcgactttgggctgggccgtttctatatttgggctaggtcgcctgccttcttttcgtattatttaggaataagttcagcagaggtccctcaacttaacagcgagattttttgaggtccctcaacctaaaaccagaaatgttcgctcctaaattcattcaaaccattcatcggagatcctttggcagtatatgtgggtggtttcactaacgtggcatcctagtcagaaaaaa

SEQ ID NO: 1877 - DNA, 153 bp, Oryza sativa
tcaccgctgttgccatcagcgccttgagccccgcccgcgccgcgcactgtcgccgttgcgccgcgttgtcccgccgccgcacgtcgccgtcgccccgagccccacgccgccgcgccgtcccgtcgtcgtttaaagccggccacccctccccgc

SEQ ID NO: 1878 - DNA, 1501 bp, Oryza sativa
agtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaa

SEQ ID NO: 1879 - DNA, 1501 bp, Oryza sativa
gaagtcccgccaaccgttgcgaccatgttgtccatcattcctgcttttaatcgtcgttgaaattctatttgggggtttttttaatagtttttagatgccccatcaactgtcaccactctactctttttcagacatgttgcttataagtcccatcaaacgctaccactatactactctacggcccgttcgctactttctctttattgtcatcggaatttcaaaaatcaaacataattgtcatttgtgttcattttttactttctagaagtcccgccaaaccgtcagtggtgacggctttaccactgtactcctctacggctcgcctgttgcttcccctctttattgccattgtgattttaaaattgaatatgattatcattggggtttactttttactttttagatgtctcgccaaccgccgagatcgtgcttcttaactgcctgtccgtcatccatctttttaatcatcattgaattctctttagggttttgttaatagtttttagatgccccttcaaccgtcatcactttacttctttacaggcttatggcttctcccatctttattgtcatttatcatcgttgagtttgaaaatttcatatttttcattccgatgtattttatttataaattatattcctacttaaactcttattattatttttaaattttcataattttaattaatctcatcatgggttctagatggtcccttctttcaatagtctttgttattacaaattttagttatttatacattgtattcctagttgaaattctatttttctttttctaatttcaaaatttattttatttttattttgaattttaattaatctcgtattgtgttctatatgcactattcttttaatattttttattctttttccaacttcagttgtttcaaaattgtattcctacttgaactctttttattttattttattttttattttgaattttaattgatctcgtattgggtcttatatggacttctctttcaatattacttattctaatttttgaatttcagttatttttaaattatattactactaatttatatggatttttttaatagttttagtcatatgcatccttaaagattaagagctgtgttttatggattaccggacgatgggtggtttttttttgccagccaatagtcgttgaccggccggaacgtaccttaataaagctctttttttggctggcatatgaccagtggtattaataacaatctatttgcttcggtatgacaactagagtcggaaacaaagagcaagatatatctttctatatctgtcaagaaacatctcgaccgttataatttggacccactataatctaatggcgtgtatttttttttctttttctccgattaatgttggaatttctagcctctacagtgaacgtgttgcctcctttcaaggctgttttaaaaatataacagacagacagatagatagatagatagatagagagatagagagtgatgaa

SEQ ID NO: 1880 - DNA, 1501 bp, Oryza sativa
ccgctgcagttctagtcaaggcttagctcctgttgtctttctttctttccgctgcatttatgtaagacttttatgatatttgtaagacgtggatctgaatgtcaacattgtcgtttgtgtaccccggccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaagatcagggagccatcagctgggttgagcgttccaccgtgagcatagtaccagaacttcgatcattccggccaattagcggtggccggttcgatacccctctcaagcaagctagcctctatctcctcccacttcggcatcgtgacgctatagccgcctgaccccaagtggtgatggtacttcttcttggtagcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcaagagacgggcggggcgtggacacattgcgcgaggagggaggagcattggcccggggccacgacgtaggagggataccgcgattctgccatcagccacagctacacatactccatcgctttcatccccatcccccagtggctgcacatccatgtagaagtgggcagggaagtaggacatatgtcgtggtttgggggcagatccgctaaaaagtggatatccgcgcgcccttcccctgcgtggatagacgcgtggcacgcggcgcgcgcccctccccctgcgtggatggacgcgtggcacgcggagagggggggcagtcgctcgcgcgtgggaagcccacgtgggtgggtttttttggttggttttctttttaaaaaaaatagttttctctggttttctttttctttttttttggttttttggttttttatacgtgtggatacaaactttatatacatacatgtatataaactttatatgctcatatacaaactttatatgcgtgtgtataaagtttgtatatgtatatacaaagtttgtatacatgatatattttttagtattttaaattttttaatacgtagtatataaactttgcgcgcgc

SEQ ID NO: 1881 - DNA, 1501 bp, Oryza sativa
accttaatcttctagatcttaacaagtgaatggcagaatactgaaaacattgtcaccatatcacatggggatgatatcaacatggcatgaaatggaagagcagataaaagaattcagggaagaaaacataatgacaagggaaagaagcatctacaccaactcattctctcctgaggagaaacagcacaaaagaattgatgaaataaatatgcagtgaataatatgaacaatctttttaatcatgtacttgctaggcttaattgaaggaaataacagaacagtcatgccacacatatgagttcccaaaaccatttagagtgaaatatgcgctcaataggttcgacaaaaaaaaaagagctcaacagctacatatgcagatcaaacgctccaggtttcttgaacaacacaatatgcacttcaccgacttatcattttgagcttaagcgcttctttggaagataagaaaatccattttgagcagtatagcctctgcacaccgatgcacgttatgatcaacatacaaattaaacctaatatattggaaccaaaatatttttttaaaaaaaaatcactttgtgggggttgcacttgcacataacataaaatagttcagtgttgtttcataaaaaagatttatgcttatctataaaatgatgttcagctctcctgaaaaaaaaaagtgatctgcagttcattttccacacttcagtaactaataaaatagcccaactaattagtttattggtttcgcaacctacaaatttacagtgctgatgggcaagacacatgccattgaccaataaaacaaatgggccataatgtcaaataccataaatctccatgcctcaacatttttattgcattttcaacatccaattgccagcagtgatctaattaatatacttgcaatggcagcaagaatacttgattatataccactttgaatcttgaatgttccacttaatcatctttgcataaataattgattgtatgattgctcatatagcataattagcaagatatatgatgaggctttaacagcaaaaaaacaaaaatcttcaaaggatcatttcttaatctcaaatgatccttctgttgaagcatttttttaagaacatgaaaaaaaatcaagaaaaataaaaaatgggcaacctagactcgataccagaaagtggctgtattattcacttgtcacaaagcaacattttgtcctttggagtggcttgatgccatgttgcctaccttgtcccagaacagatttgatacaccattatggtcaagggggactatcaattatctcactgattttctgctaaatagtaggactctagcagtggacatcacatcaggacaggtataacaaattccataccaaaagggaaatttcataccaagatcatttaatcagtaagagaaatttcataccaaaagggtagaacaaattccaatgattgaaatcaacatgtgctccataagaaaaataaatgaagcgtgacaaatt

SEQ ID NO: 1882 - DNA, 1501 bp, Oryza sativa
ctgggagggtgagcagctattggtagagccgtagactcgtagaggttgcgaaccctgcgacgaatggtcgacggtgggtgtgcaggatcaggcggccggcgatgcaagatagcaccaacaccaaactgtcaacttcctccagaaccagatagccagttagccacagggtggttgacagtacttcctccagaagtagatagccacagtatttcctccagaaccagatagcattctcgtttcgtgtaaaatggttaatccggaagtggttatggttagaggaataaacccttataagttagttttactcttgctaaactagcaagttggtactaaacatgcgcacccaactctcatgggccacacatgcctcatcttaattgtgtcaggatgttaccgtggcccaaccggcaaggtgtgctttttcaaactaataaactgtgtgttttgtgtgaaatttttttaataaaaaatgctttaaaaatcaaataaatttatttttcaattttttaatgatcaatatttaattaatcatatgttaattgtgtttctagttttacgtgtagctaatcatccaaattcaatagcccaaaagaacatagcgtaatttctcattttgcatagcaggactttgtcgttacttggtgattgctgaaggttacgaatttgctatattggaaaataccatcattacaattcgtgaaatttgtcacgtgtcaatggaagtttgcaaaattccaaccataacattgccctaaaaaaaatgtttgcacctccatctaaacgtagaaattgtcgaaattaccttttttttttcacattctcctttctctctctgcagttcttctccgacgtggacagctacaccttcttggacgtacgccacctagaccccgccaccgctcgctggcctctgttcggggtcaatatctatacgcggagggagatggccaagtttttccacgccaagagcaggttccacaagagtcaagaccatggaattccactgtagggaaagtttattgatcgctcgagggatatcctcttatttatacatatatctaaatagttataaacaaatttaaaataaattgacaagatagataaggatgaaatatatcacttcacaaacatgcaagttagaatttaatttctacaagttgtaaaaaaaacaaatataattgcgaatgtactataactatttttagttaatttgttctttttattgcaactagtagaaattaaatttggccttgtattttttagagtaatatacactacaacggtcatccacatctcaatcaggcggcaaaccccatatgtgtcgggtatggcgcccgtcacgacgtaaaggttactgatgtgagaagttatctctattgagcatacagccgtcacggatgaagttatctcaatcgggccccaactaaagcctgtcatcgatagctttgacccagacgaccagtcaaataagggctcgtcacggatgaccttatttcaattg

SEQ ID NO: 1883 - DNA, 1501 bp, Oryza sativa
ttggtatgaaatttctcttactgattaaatgatcttggtatgaaatttcccttttggtatggaatttgttatacctgtcctgatgtgatgtccactgctagagtcctactatttagcagaaaatcagtgagataattgatagtcccccttgaccataatggtgtatcaaatctgttctgggacaaggtaggcaacatggcatcaagccactccaaaggacaaaatgttgctttgtgacaagtgaataatacagccactttctggtatcgagtctaggttgcccattttttatttttcttgattttttttcatgttcttaaaaaaatgcttcaacagaaggatcatttgagattaagaaatgatcctttgaagatttttgtttttttgctgttaaagcctcatcatatatcttgctaattatgctatatgagcaatcatacaatcaattatttatgcaaagatgattaagtggaacattcaagattcaaagtggtatataatcaagtattcttgctgccattgcaagtatattaattagatcactgctggcaattggatgttgaaaatgcaataaaaatgttgaggcatggagatttatggtatttgacattatggcccatttgttttattggtcaatggcatgtgtcttgcccatcagcactgtaaatttgtaggttgcgaaaccaataaactaattagttgggctattttattagttactgaagtgtggaaaatgaactgcagatcacttttttttttcaggagagctgaacatcattttatagataagcataaatcttttttatgaaacaacactgaactattttatgttatgtgcaagtgcaacccccacaaagtgatttttttttaaaaaaatattttggttccaatatattaggtttaatttgtatgttgatcataacgtgcatcggtgtgcagaggctatactgctcaaaatggattttcttatcttccaaagaagcgcttaagctcaaaatgataagtcggtgaagtgcatattgtgttgttcaagaaacctggagcgtttgatctgcatatgtagctgttgagctcttttttttttgtcgaacctattgagcgcatatttcactctaaatggttttgggaactcatatgtgtggcatgactgttctgttatttccttcaattaagcctagcaagtacatgattaaaaagattgttcatattattcactgcatatttatttcatcaattcttttgtgctgtttctcctcaggagagaatgagttggtgtagatgcttctttcccttgtcattatgttttcttccctgaattcttttatctgctcttccatttcatgccatgttgatatcatccccatgtgatatggtgacaatgttttcagtattctgccattcacttgttaagatctagaagattaaggtatttttcgaatatctattcattggttgccttgtcccttgaacctcatagatgggaatcattatcaatctatca

SEQ ID NO: 1884 - DNA, 468 bp, Oryza sativa
agaaacatggtacaacaatagcatggctatgacaacaggtaaacaccccatagaaacattataaaacaatgcaatatttgaaagaaaacaatagagcatttgcaatataggatcaacatgttcaagtgacaagcatgacttgccttgctctgctgctggaggaacctcggcgactatttcgaaatacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgtgcaataaatcccagggctgacgtcagcacggaggggggggcggcgccgaca

SEQ ID NO: 1885 - DNA, 1501 bp, Oryza sativa
tgcagtactgcagaggacctgcatccgtgctcgtttgcatgcattacaagtgttagttttttttatctaggaatgaatgcttattatcaatccctagatcccaatttgatcatcctctagtaaaggttaacaagatcaataacatcaaaatacttcctccatcccattttaatcattctctaagggtgtgtttggataatgggaaatgagaggtgggattgggattgggaaatgaatgaagggttaggattaaatgaaagggggagaatgaatggttaggatttaaagatgtcttttagtgggtgggaaatcatttctctatcccatttgtcaaacatggcctaaggttattgaggtttttccaaaatgggcatcatttaataaatgtatcttcgtttatttatgtaaacgaagagtaaattcacatcattaaatatgttgcatgtaaccaactaatattattttttattagagtaacggtatactacaatacttaaaatatgagcatgataaaatcatgggacatgaagccatgaagcaccttgacctcgggatacattgtttcccatggatacagcaccatttcagcccatattacatggacctctcttcgtgatgccttccggaccgaatcacttgggcctcactttgcatacgagcccattccatcctgtatgggccgcacgtagccgaactcccagttccagcccgtcatatttaggcgggaaaagtacaccgaaggtctctcaacttgtcgtcgggataaaaaacgtcatcgaaccacaaaaccggatatcgtgggtcccttatctatagaaaaccggttacaataggtccctcggtggttttgatcccgattttatcctgcgtggctgctaagtcagcgtgggaccttatgtgggtcccacatgtcaggatgccacgtcaacgcctttctctttctcctcttctctcccttctctctctcacttctctacgctgcgcaggctagccgacgggaggggaggaggccggtggggcgcggtcccgcggcgccgcccgccgcgcgctccgcgaggtgggccgcgacggcatcgtcgtcgtcgccggccgcgccgtctccggccagttcgccactgctggcgaggacgcggacccgtcctctggcgccgcagcggcggcagcgtcggcggcgggcaggcgggtgtacgtgaggaggtcggtcaccggtggggcgaggcaggagtgcaggaccgccgccactgggcaatcaaaccgatttgttaccatggtgaacacccagaagcgaggttctcaggctcagcattgatcccgttgttcaatggaggaaccacattggcgaggacgagcatagcttagcttaattaactaatgataagctcgagctagctagcctatatatacacatggcactggctcttgcatctccacacacacacacacattcaattcacatacaaaaactaagctagctaagctagcgagattatcacagtatata

SEQ ID NO: 1886 - DNA, 1501 bp, Oryza sativa
tgggacgcattactattgctcttaatcatgaagagtggtacacatatatatcatgaatataacttgtcacatgcatatactttcaacaactcaacacatctgaattgtggcaaacgttctggttcagtgatagcataattcacacaattatatgcgtaggccaaccaattataatatatgcatgggcggcccaggcccggcggcactctatgcttcgggcagcatcgaaaactcatgagccacaatcagtgacaaagccaggatttggctatatataggatgagcctaaaagtcttgcaggggacctaattatataattattaatacactaattaggttaattacctaattatagataggtgattatatgtgaaactatttttgttggagggggccaggccgctccgccactggccacaatgatttttttatcacatatgggcaggtcattttaagacacccgtagaccggctaatacctgaacgataattgtaagacaatatggggtatctgaccaatagccaccatatctatccttgtgtcctctttcacctttttttttctccaagttgctccaaattcctgccacctaactcctaacaaattcgatcgcgatgtcacaccgttgttgtgtgcgatatatggcctcattcaattcatctcacgcacatattcacagtactcaccggtgatgacgaagataccttaaccgctggtctcttcaagcggttattatcagccagtccccgggttgtgtcgtcttgtgctctgctttagtgcttcttttgcaccatacggcttgtaagacacagaaaaggggaaaacatacaaagatatctcacacatcggggttttttaggatttttaaaacatatgaatttagtggcactttggatacagggacaatccctgtcacatcggatgactggacgctaatttagagtattgaacatagactaattacaaaactaattacatagatggaggctaatgcgagacgaatctattaagcctaattaatccatgattaacacatgtttactgtagcatcacataggctaatcatggattaattaggctcaatagattcatcttgcggattagtccagggttatggaatgggttttgtcattagtctacggttaatacttttaattagtgtcccaacatccgatatgacagtgactaaaattagtccctatgatccaaaaaccacattaaaagatcgcgaatttggttggtccataggaaataaaacacatgaattttagaggaacttgttttgtaggagatatactagagaggaaagacgagaacacatccgacttctcaaagggaaaaaaacatggggtatatataagatcttgtcatatagcttggttgtagccaggacaaagagtctatttaggggagctttaagattctgagaagcagctgatgagaatctggagaagctgggttagttcatttttcagattccacagctacagattctaagaat

SEQ ID NO: 1887 - DNA, 1501 bp, Oryza sativa
ccggtctgaccgccgcaatgccgccggtctgaccgccggtgagttgccagttagaccgccgaaacccggtgaaacacaaatcgaagaactcttaaagtagatgatgactttattgattctctctgtgtttacaaagtgcaccaacaacactccttacaaaaatttcaactaaactcgaaaccctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtacaagaaagaaactttacataaccaatcgtaccaaatttggactccttctaaattcgactccgcatcccatacgcacacaatacctccatcgtatgccatatggaatctctatcaaccacgtgcatcaactctagcctaagtatcccgcatgatctctgaccaccacggatgtcgtcttatccccaagccgactcccggtccatcaccgcaaatactctcccgagacatcaagtcacctacacatgaaataaacaaagaaaccatattccgagaccaagctatctccaacttgactcattagtagcaaacaacagtattacatacgtatagtatccatctagaagtcataatcatgaaataatcacggatatccaaataaacaaccagaaaccgaaaccgacacagcatcggccggtcagaccgcgggctggccggtccgaccgctcgatcaccaccggtctgaccggcacacactgcccggtctgatcggtaacatgaaataacagcagtatcctatagattcacctgtgaaatccaatcatctccaaaaccacttcgtgaataaattctaaataacaaaaccaataatctccaatgcccaattgttcatcacagaataataatcaaaaacacctttgattttacaacctattttgtggacttcaacaccagggatgccattgttgagtacagtgcctatgtcttattttgatattctactgtatctatggattgatatactactacccaattggttcattggctgatactgtacgcttcagcaatccctctcctttgctggcgggtaattgaatatggcttactcaacaatggcattcctggtagtaaaacaaaaggtatttgctttttaatataacctgccatgtttcgcaaaaagaaaagaaaaaaaatcgtatccattaagctagcttttgtgacttggagggcttatattaattttatatactaacagaaagagtaaattgtattggtgatacacaaacttgttaggtgggtacaatttagtacataaacttgtaaaacgctcgtttcattacatgaacttgtctacttcatgcggacaaggaccaaaataacttataaatgttaattttacgaagttgatgttgattaggatgtgacgtgtatacgtgtagtaagcatgcataagac

SEQ ID NO: 1888 - DNA, 1501 bp, Oryza sativa
gcgaggcgcttaagcccgtctgcgaccatggcgtcctctgccacaggcacggaccgcacatcaagccatttgacgagattgaagaagaaaaaagaaaaggcaacgaagaagaagggaaacgggaaagcagctaacaacacaggatcgccccaccggtgcgccgtccgtcgcgctgccctcccgctacttaaagatacttacttcatcctagaataaatcaacctctcgtacaagatatgatatactctctctattctaaattgatctatatataattttttttagattattcctaaatgatctacgtatttgtgttgattcattaaatctattcgttatttatgcattggagtaaatggacattaacgtatgtatccatacacacacgtatttataacccatatgtaatatcttgattttctattggctaggaaatagtggagatggtgcatgcatgaagtttgttgctagagtgaatataacactataaaagagttattagcttttcttggtcttggtatacctataaaatatgtagatcaatttagaatggagagagtatcctgtaactatgaatctaaacatgcatttaagtcttataatgttttcacttcatcaatttttttattacacaacactaacatttactccctctgtccaaaaaaagacaaaccgtgggtttccgtgccaacgtttgactgtccgtcttatatgaatttttttataattagtattttcattattgttagatgataaaacatgattaatactttatacgtgacttatctttttaattcttttatattttttttaaataagatgaacggtcaaacgttgaacacgaaaatcagtgtttgttttttttttacggagggagtagtatataacaacactgttttacgacaatcccattgacttggttcgcggtcaatcacaaattcgcaatcataacagacgctccccaatccccagttccccaccccccacggccccacccacacacaacaaaaccaacaaaaaaaaatcccaaaaattcgaatagtatctgccaatcgtcctcatcgccggccatcgccgccgccgtcgccgccggccgaccaccgcgtccgccattacctcctccgcgaccggatctgctttccccaccccccctctctctctctctctcttcccctctgcacctgcatcgccatcacgattcgtcgattgctcgccaagtcaagtccactttgaaaattccatcccaactgcctccggcctctcccctcacccacctcgcggaagcgcccttatataccacgcgcttcgcccgccacggcgaccccgacgacccgccccgcctcgccccccaccgccaagcgccgccgcgtgctcgaccccgaccctgacccggacgccgccgccgccgcagccacggggaactcgccgctgggcggccgcggccgcggcggcggcggcggcggcggcggcggcccccgccaagccaacacctcggctccac

SEQ ID NO: 1889 - DNA, 1501 bp, Oryza sativa
acctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagagattccatatggcatacgatggaggtattgtgtgcgtatgggatgcggagtcgaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagggtttcgagtttagttgaaatttttgtaaggagt

SEQ ID NO: 1890 - DNA, 1501 bp, Oryza sativa
cgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctg

SEQ ID NO: 1891 - DNA, 1501 bp, Oryza sativa
tacttaccacttgccagaagctcaccaaaacagtccagctttttatccaaattctaagaatttgtggttgtagaatctggaaaatgaactagaagacagaagctgggtttcccagcttctccagattctcactagctagtttctcagttgctgcttctcaaaattttaagctcccccaaacaagccttatgaatctggacaactctctattcatattcatggtattaggatatgttttattcaccaaaatcttctgccttatattttaggatggatggagatacttggtggaaatgcatgctttagttatttaaattttgatgcctcttctacacgtgcctccattgatcggcaggggtataccgctatatatgatatatctgtgggcttgattataacaactcaccttctcatgcatcgtacgtgctgtcgttacttctttttttttgtttttttaaaaagatcaagattttgtttggtttaaaattaagctgccgttgtaatgcttgccaaatagagattattatgtggtgtgtctattccagccaacaactcttgtctcgatcacagatcttcctgtaacagtaatattaagctaggtaaaaaattatctaaattttataaaaccccacttatcatgagccaatttacataaaaccatagattttagcatgtgacacataattatggtccaaaagttttctaaaaccacactattagtgttaactgttaaggataagacatacctcttatatttgggtttgtgctatatgaaagtaccacatacctaataatatacaggaatatatagtcaattaaggtaatacggtgatccgaaaggaaattgttttctagggatagaagatgtcaaagtcatattcagagaaaataaggtcttcttggaccatatctaattcaggttctctgatttctactttgagaaaaagatgatcatccctataaatacagggtcccaataaggggaggatattgaattacaagccataacaagagcaatatcgagatacaattcggaggaagccaaagccctagtcgttgattgtaatctactttttccctgatatacatataaatggaagtagggttattagtcatcttaaggccccgaaccaatataaacacttgtcccttgtctgctagctagatatgatctcaacgtttttcatactctacaaatatcgtaggtgggcaccatagtccatcaacacatggcgttaaccaaatcgacatactcctatatcaaaattcaaaattgtatgtttacatgtatgtaacacttatataaggaataaatagcttataattcaaaatgatcaatagtgtggttttgtaaaacttcatggccataataatcaaggttatgtgttacgtgtcaaaacccacgtggttctgtacaatttagaccataatagtacatggggttagttgaaatttactctaaattaatttgagtcttaattcatgggtaaggtaaagatca

SEQ ID NO: 1892 - DNA, 1501 bp, Oryza sativa
caatttgtttcagtgtcttcgaaaattgatgccatccttcctctttcaccgaatcatcttttatatatttggttcccttccttcgtgtgcaacttaattatttgttttcctgtttagaggtgcaagttagttagtccatctttctcatgaaaacaagatgaattagaacaaattggttgagttgctgaaagatatccactccaagctggctgagctgcttcagaaatgctggcaaagagatcgattgagaggcattggagatccttcaagactcctcaaatgtgccatttcttttttcttttaacacaatatatatgtaggtgcttataacacgcacatactctcatttcaataaatgcacatgcacatattctatctctgtaagcacatttaaagactgggttagtatatcttaaaatcgataaagtcatatgacatatgtctcactgtcgatggtatgttttaatgcatgtgtatcttaatttgttattactccctctagtcatttttacttcatgttgggagagttaagcttagctttccccgcatcaaattaaagtgataggagggagtatctaattatggcaaatatcatcaagattgtcaagagcttcattttttttacagtatgatatttttgcgcttagctccttacctttgcttgctcttgagtatattatgctccagaaatcagaaatgtacattctgttctagcgtccgatgctggcgcttaaaagcttaattcatcacgcaattcgaaatttttttctaggacttcgtttactctctccgggttgataatattagtcgttttggacaagaataaagtcaaactttaaaatctttgactacaaataatttctaaaatatttatcttaaaaatataaaaaccatatgtgtagattagtcttaaaaagtacttcaataaaaccatatatttatattataatagaaaatagttgtcaaagttactttttagagaccgtgtccttgttcaaaacgacaagtattatcaaatcggagggagtaatttagttttctctaggagcacattgttgtgcacaagtgatattgcaccgtggactttgggcgtggttgggcccttgctttcagcaaactacaaggcatcgtccttcggtttggagaactaaaaattaattaaccaactagtttggagattcggggtactttactgaaagtaacacatatatttcttatatgtgcctcaatgttaaccacacttaatcatacacaatctaaatgcaaattaagtaagcattacaatcttttattctagtctttcggttcagtcgatctacaaggacatgtcaactaaaatgtacttccaattggtcatgagcaacaattaatagatagccataattcctccaatcgctgctcgccacgtgtccctcctccaactcatatatagagccctagagctcccatgcctctataaataggatgcgagtgttattcactcaacacaaactctaagatc

SEQ ID NO: 1893 - DNA, 1501 bp, Oryza sativa
ttgcttagaggctttccatgtccatgtaatatttgacgaggaaaacaaatactccctgttttcaatgtttgacgtcgcttattttttaacttacttttgactacctaatcgtcttatttaaaaaattttgtacaaatataaaaatataaaagtataagtcatacctaaagtacaataacaataaaataaaccgtaacaaaataagattaattatatttttttaataggtcgagtctccaaatatatgtataaaagtcaatagtgttaactattaaaagccagacggcatactattactcctatacttaagtaaccaaaccaagtgtatcggagtattttacctatagtcaacactgtatggatcgatgtgcctcaatactgtccacatgtatatacaatctaattgtaggtttatatttaaatatcactcgatcgatctacaatagttacaagtcaactagaaaacttccatctatcatcgtccaaccctctagctcttagagctccccatgcctctataaatagctcatggtcgagttatatcactcagcacaaccactctaagatcaaaaatggcaaagagattagcactaatgcttatgatcttccttgtgctgggagccagttgtaagggccacacacatggtgggcctgggcctagcccctcaggccatggctccgagccgacacacctacacttctacttctacgagaaggtcagctgcccttccccatcggcggtcacgatggtgaacccgccggacaacacgtcaaataccttgttcgggatggttgtggtcctcgacgacctactaactgtggggcccaattcgagatccaagcccgtgggccgagcccagggcatgtacgtctcgtcagaccaaacctggatcgggctcctgatggcaacgaacatcatgctcaccacctgtcacaccccgaagttctcctcccaagccaaaaatttaatttataagcgaccctaagaaaataccagtgcaaagtaagagtaaacccttttaaatcaatgcaaataataatcggaattggcatgtggaatttttcttgagttctacatgtcgaaattcactaacaggatttttagtggaattttcagagccctagaaataattttaaccaattaaaattgagcaagcaatattttaattccaggaaatccttttctcctttttctttttatttttccctccctttttcgaatgggccactggcccattctctccttttctctccctcctccctgctgggccggccgcaggccgaggcccagccaagccgcccctccctctctccccgggacgccgataggtgggccccacctgtcggacccgtcaccttcctccagccggcgctgccgcgcccgcaaccgccgccgcgcccacgcctccgccttctccgggccacgtcagccacgtccgcgcgtgcgctgcatctcccgcgcccactcccctctctctcccgcccgcgcccgcgcccgaga

SEQ ID NO: 1894 - DNA, 1501 bp, Oryza sativa
gtaactacgatataacttatataaaacttgcattcaactatggtttggttagttagtactgaaatcttacgcgtgacacgtgtgaaacattcttttagcaatttttttcttcatgcacaaatctcaaggcgatccgatggttacaatcctaaaagttttgggaacaaaaaacttatagaagttttctagcaaatccgttaactatatgtattgccattcgttcttaaatcgtttatgcaaaaccaattttcttgtattttcctctatgaatcatcatagtattaattaatccaagactaacagttacgtacctgcagatacccagaccccatgctgcctaagcagacgaaaccgaagggcaacagtatacaggtcgtcgtcgctgcctgcaaaatccgcctcctcgcggcggagacgccccagcagcacaccaatctcgtgccggaagtgcccatctagtccgaggcgttcgagcgtgtccaccagcgtcgccgcttcggccacgctcatcgtaactccgccctcgccgtcgccgttgccgccgccggcggcgaacatcctgcggcgcacctccccggcgagccgctccgcccgcgccctcatccgctcctcacaacctgcatcaattaatatatatatgatcgtttaaaacaggcgaaaattgatcaaattttgtctgaaatttgacagaaatcatgtgagccactggatcgatatcacgcccgtgcctgcgagaggggaggggcgtaggtgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatttatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcttcttattcaaaacctcaatcatcacatcccctctctcccacttcacacctcggaacgcactattcttatagagagaaaggggttttcccatcttcttaacccgaaatgaaatggctgaggagagggaggttccttttgagggtaccccgggaagagatccagtggagacggg

SEQ ID NO: 1895 - DNA, 1501 bp, Oryza sativa
tatgagtcctgattagaatctcaatctctagcctgcttcttggttgctgattagggtagtatcggggtttcagccgatcttatctaatttaactacatttatcttatatgctcgattgacatgttaaatctgccctttatgttaagatcttgttgcacttaagtatattaggcccttgtttgatatattctacttgtttcaatatctcaatatagagtggtatcgaagtattagccgatacatgctagatctatctgatcggctatgctataaatatatatagtctcattattaatatatatttcgatctaaatgatttatattgtctcggcatggcgaccgatctatcccaatcacttgatttaagtatatatcgatatacggactatatatcgttaatatctacagccgatcgagtagatttagttctttcttacttatcaacgattgtcgatcgatgcatatatgatatcggctcaaagataaatgatatgtcatcggcatctagccgattggctatcgtttatggatttaaccgcggtttctttgtctttgtttcttgttgattgtagaatcaaatcaactggcacgctagcatacccaaagacaagttttggacctatactggagttaagcagatctctcaggccacgtgttttcacatcaacagtagggtccagtctactcggcccatacggggttaacctaaagtaccattactatttaacaccatgtataagttctatattttggaggctatattaatgtgttaaataataaataaaagaacaaagggcaagtacacatcatgtttttccctctttggtttctattaaatatgcatggtacgtgagtatttcatactaagcttggttaattagggaacacaaagcataccaaactgatattaatgtactaaataataagtaaaagaacatagggagtacacgtcatgtttgttcctccatgatttctattaaataggcaagatatgtagtattccacactaagtttgcttaattagggaacacaaatcatattgtatttatatatgagaattcatgcaataaaataatactataataataatcgatccctaacaaacgtgtactgtagtctatgaagatgaaacattttgaagtgatatatctacacttaaactttggtcttatttctgtttaaattcatttttttcaaagaaaataagaaagcatataaaaaggagagaatataagtaaatagaagtttgtttttaattagatgaaattttcctatttataaaatttttcaacagaaattatcttcaattaatatctcctaaagtccataaagacaaaaaaaaatgttactaagtcagaaactctagaattaagatatgctaaatattcaaaaaaagatatacacataagcacaaatgatagttttatactccctccgtctcaaaatataagtattttttagttccttacatagtatccgagatgctactttaaccaacaat

SEQ ID NO: 1896 - DNA, 1501 bp, Oryza sativa
ctcgatgcgtacgtgcggaaccaatggccgagaacgggtacgtgtgtttcgatctgtaattttctttccccaactcgcggcatgtcggcatgtagtgtaattctcctgcactgacagaatcatgggcaaattaaacatatcaaaatcacaacatctgggaacagccgcacacgcttcacactcgcacgagaatattaaaatcacaacaatagctatatatataggcctctacagctaagctacctcgtcaattaattaattgttttatcgtggaagatgggctcacgtttcagctctataaatacaactcttcagatcagagctaggcacaccacttcacttgtgtagctgtgttctctctccataacttcacttcacgtacttcaactcaaacacagtagagttcgtcgcctccttgtcatcactgaacacacacacgctgctgacatggccgcgagcaaggctgcagcagcgaaccagccgctggagatggacgctgtcgtcaatggcggcgccggctttgaccttagtagcgattcatacaagttaaatcttctaatcaatggtgggccaataatgaattttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccatttcgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatataaagatcatgagctgccccataatgaaaccaccaggagtcgcgaatatctccttcttccctaatccaagattggagaaagaagatccaagagggacccatggagaatgtggtcagaaacctataatagagtccgaccgcaacgacctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctagaaagtgaaatagaatgaaatagagccactctgggcttacctatgaaa

SEQ ID NO: 1897 - DNA, 1501 bp, Oryza sativa
ttagggtaatatggtcattttaggaaaaaaatgatcaactaaaggaaaggaggtgtagaaatcaacatagaagctctgcatataaaagggattcgacaaaactcaaacatataaacgaattagctaaatatttagatacaaaatgataattttctctataatgtactccctccgtcttatataagtcgttttgaatttagtcaaagtcaaactactttaaatttgactatgtttatagaaaaatatagtacaatatcaaattagtttcatcaaatcaatgatcgaatatattttcataataaatttgccttgggttaaaaatgttactttttttttacaaatttggtcaaacttgaagcagtttaactttaaccaaaattaaaacggcttataacctgaaatagagggagtatatttcttgtgtgtgcacatatatattatgttcagtaatactagtattaatttgcatgcctgtggggctgggaggggtgtaggtgacgaagaagtcgccccacacggagggagcacaagttcggccggtggcagctgcggcatcagctagctgcgtggtgccacctttaactgcaagcacctccgtatcgagaacactaatcaccttactcccagacatgagattagctacttttggtcggtgtgctctagtcagttacagaggtcgtgaaactcttgctgcttttggatggtttgaatcgattggtcctactatctctcctctcatctcatggtctctatttatagacaaatatccttcccggtgatgattattaatggaccatctaacctaatttttctgttacaacaaggtgaccttttttaagattttataacattcccttctttctcacatacttatctcattgtttccatgtactattctaactttgatctctaataaccttcaataacaaatgaaacttttttaaggatacaatatactttaatgttacaaaaactttctaaagtatttataaacgcttttgaatagtaaaaagacgagtgatcaatctgagaaccatgcaattaatggagtatccgagggtggtccggtggtcctcggaccagaaaaaaaatcgccaagccaaagcccatttatggtttaaaaaaagagataaaaacaactcctatgtgtgaataaaagtgttggtcaatcggttcagctccagatatatagtagtccctcactcgtctgtgttgtttcctctcccacacgtgtgcgccgtgcggctgctggctaaagatcctagtgagtggcaacggtggagttgcggacagcaagggtgttagggctcccgagtctgcacccgacaggtcaggtccgtcaggagattaactggttgtttaggaatctttttcacccttctcacctcaccatgaatgtaatgtgtattagagattaagtatgaaaaaagatggaaataatatcgcatctctttttccgaaacatgaagcaaataagatgaagattgcttctcaatcacct

SEQ ID NO: 1898 - DNA, 1501 bp, Oryza sativa
cataaactactcttgtgctatcaagttaaagactaggtttaagtaattttttaaagcttttgtggattagagttgagactttatgtttaaacttgaggacacccgcttatctctactattataaaaataaaatatgtttttactagtattttagtacgtcattcttgtttgcggttttaagtttgttcgcttttggaaatacatatccgtgtttgaatcagattttaaattcatttgcttttggaaatacgaaaggagttgtataagaaatcttttttaaaaaaacttgcataactaatttgagttgaaaatcggactcataattgcagctcatgattattaaaaaaaatatccaagcgaattcccataatgaatttcacaatagctaaaccgtatagcaataataagattgaaatagcattaattcacccgttgcaatgcacgggtatcttttctattaaaccataaaaatcaaaaaatcaacttaaaactctatgccaatataatgatctaaacccaaacaaaaatagccaactaattaatttttttaatgaaaagaaaaggagcgtctttatagtccagcacatagtaccgctcggtaccggtacgcatcgagccgttcattccggcatgggtaggatcgggagagaaaaatgtgctcggtatcgttccacagccgcgcgtgcgtggtgcgcccccaatccttcatcccccgacgcgtgcgccctgtccggcatggactccgcctccgccgtttagatcgaagtctcggcgctagaggaagaacatggcaacggcggcagaggaaaacggtagcggcgtaagtgggacatggcggcggtggcagaggaaaacggcgacggcggcagcagcggaagaggaacacgacggcagcggcagaggaagaggaacacggcagcggcggcggcggcggtagaggaaaacgaacacagcggcggcgaaaagcaaccagcgctggtgcaaccaaaattctagggttcgagctagctaaccatcaactcttcccgatccatccctccagaaccatccatcgcacgcaaagttactcttttacccttctaactctcttctctctgcggtgctgtctcagggacaattttgatacctcgtggtaccacgcaataccagctgttggatctgaccagatccaacggctagcatttggtaccgcacggtacagctggaccgtaaaaaaactcaaagaaaaattaaatccgccacatgcatgcatgtatgaggttcgatcgtatgctaggtgacccgtaggccatagctacacgggtcctagaggggtgctcgtctataaatagagaagatgggagaggtactgaccatatccaattagtagcaagctactctaattgacaacttctgtaaactagcggtcgcgaacgagctcgatcaaccaacgataacatgtctgggagcagtgttctcgcgacggaggtgcttgctgttaatggaggctcctcgccgttgg

SEQ ID NO: 1899 - DNA, 1501 bp, Oryza sativa
tgaggtaaagagatctgacgagctcgaagtccagcctcgcgagctctagcaccatgccgtcgtgcgccgcctcctgctcatactcggtgatgtagtgcatcgtctccagcagcttgggcgcccgcgggagagggatgtcgagggcgcgggagacctgcttggccatgggtgacctcagtgcaccttgcagggactggaggctccgtctcgagaacgcgatggcgtcatcgagtgccgcttcaccgggcatggcgaggtgcgctgcattgtataggcttagcaggccccttgcatccgtgcttaggctctctctaaaacaacccgtgctatctttgaacttgtcgaatacatctgcatgcacaaatttctagctgtaagggtgtacatactactatatatgctccagggatttatccaattaaatgaaaggtaatgttatcaccattgaaaatgtattgggaccttcaagtagtaagtataccacaaattttaatgtgtaatttaattacctcaaggtattttttcaaaaaccataaaatttctctcaaatgaatcagagaggtggagagatgtatgtgctcaaataacatttattggttttttttcagcgtattctatttttcaacagctttttgggctgctagcaacccgactaccatgaaaatgccttctaactaattcggcaattatattcattttagatcaacatctacataacaaaatatccttctagaaaacaaagatcagaatataatttaggctacctgcagatacccagaaaccgtgctggcgaagtagacgaaatctaagggattcgaggtagagctggtcaccatcgtcaaagccagcggcagctttctgctgttcatcgtggtgaaatacatgctgtaacgctgtggcaatctcgtcacggaagtggttgtctatatggaggcgttcgagcacgtccactagcatcaccgtgtagggcacatttatggtcttcaaaattttgcagcccacctgcatctttagccgatccacccgttctctcatccactcctccgacctctaaattaaacccatgagagctatagttaaagtatcaatgtattgtcaaactactaattaagctagcaagtactatgttatatatagtcaattggttacatgtctgtgagatttcacgcatccctcctacatctctaagatttgtttgatcccttatgtgccgttgagttattctaatcccttactcgtccactccattagttacatgttagtgtgtgttttttacgaaacgaccttatttccattggcatattactaaaaaatcagtaatgttctatgtaggaattatttgcattgtgaaaaaaagtaagggataaattaccgaatatgtagtttccaaattcaaaaatttgtaaagtaatttcattcagatttcaaaaaaaaatgagtaaaatacacggccggtccttaaagttgagcgcgggtgtcacttaggtccataatcttgtaa

SEQ ID NO: 1900 - DNA, 1501 bp, Oryza sativa
tttggagacaacaaagcaatggggatatatagagtacatacatcgaagttatacgttgtccacaaaaaaaaaagacacgtgtaaacagaagcagcagcaatacagttgtcaaggtctgccggcgatcctcttgcgaaaacaggggtcggagaagaaaactccgccacctcctcaaccgataaaactgaaaaggaaaaaaaaattacatcagattaacgggctcggcccaatgcaaactagacctcccttacatggcctctgccgtccaacggcgtccgacggcatggctcagcgtctacagtagagctgccgcatctctttatatagaagggtatgtttagtatttgttcaaaatatagaatgggttatttagtaatttgaagttgagatttatttgcaccggggggagttaatctggaaaggtttgcttagttggtatttgttttggatctcgtcgtccgttcgacgagcagcggcgcttcttcggaatatatcacgcggggcggcggatcgaaagattcccaaacaccggcacgccatcatccagccagtgtccggttgtgcgactacgatgcttgtatacatgattgatcgaaacgaatatcagcatttgctagcacatacgaagttacgaactctaaaagaccctatgaatcttcgactgctttcagaattaatttgctgacgtttcattgttttgctgcgcgtggcggcccttgatcgccgtggctgctgggggcgagccagggacgcgtgcagcggctgtcaccggcagcgcatgggactagcccctttctcacgatccgatctgactaaagaaggaatcatgaaaatacaaaaataaccttccgcaaaaatatagaaagacaaatataccctacataatttatactgtaaaagaaagatcagataaatccacaccgttagattgtttatactataagtatatattacaagtgtagtgtattagattgtttatactacaagtatatattacaagtgtagtgtaccgtaaaagttctcaaactctgaccacctcctcaacaagtaaaaatgaaggaaaataaaacaaacaagccaatagccaccgatcgatagcatttttgtgaatcgacatgctgcacgaatcgacaagccaaacgtgcagggtttatcttttcattttcgatgtgaaaactagtaaaaaccgatgagtttcggtcaacgcaccaatatctttttgttttgaagtggaaactagtaaaaagtgataactttctatcaacgtcatatgaaatccaataccggtcggctttcaccaacaaacagattgtatgaaaaccaaacagtcgaaaaccaataaatttggtgaaacttgttcacgtgtcttctgtgcgaagcatattgcacactcacttttatttttattgtttgacgtacacttcagtagttgatacgagtagtacttagacagacagataaacaatgacgttttacggtgaaaaaggccaacaggactgag

SEQ ID NO: 1901 - DNA, 1501 bp, Oryza sativa
cgcccacatgggtcccgacgtcgacgtggccttgtgtgtgccgcggtggtgcaggaacgagttggacacaggacacagcccatgctgtcccttggaaagatttgccctcaatcatgtgttttaggcgaaaagttctacaaatccaggagttgtaaaatttacacataggatatgattctactttgcatttcctttttcctttttcttttgtcaaatgttgcattttaaagactattgatgcatttacctcactcgttgttttcttattggcttgtcagccataaccaaaacttttatttcgaaacttaaaatttgaagctggttttaaggttttctttatcgtactttatttttcaatattagttttcaaatcattgaaaacacatatataaaagtcatagatataaagcattttgattatttcattcatttttcacttgattatgggtcatagagcgaacgatgagttaggtaaaacaacagtaaccttttatgactgccctgaataatctcaatgcttcttttttttagataataatctcaatgcttcttgtatttaaaatataagcacttgaagaattaatttttttatcaaaatgtaaacacttataaagtattacttgtccaatcaataatcaccctcattcaatttacttccagtcttatcccctactaaactcctacccccaacaaatgccttatttaacaagaggcatataccttgttcttgggtaaaactcccagaagcacttatattttagaacatagggagtgtttgttactcgaaatttgagcactcggtcttttttccaaagaatttataaaaatttggaaagaaggcgtaccaagtatgttgcatcctaagcataagcttgagttttttaagttcatcattgtataaccatctaaaaaaaatattattggtggtcaaagtcaaaacaatgccgatcaaccgcgaaagtttttaggaatggatggagtactatacatggagagtgctattagagcaggtacaatagcagactattagtcagctataaacatattttaatgagataaaagatgtgagagaagagtagtgggctacagatctgtagctagctgtagcacggactccaagacgcaatgtgtgtatgacatgtgggaccatatattaataatatagtaagtaactattgtatgaattgactattagattggctataaataaattggagctagtagtgggctatactattaaacttgctcttacgccgctccacttaatttatttctacgtgccacgtctccttaaaaccatagtcatcaattaaagcacaaaatcctggataaaaaggcccagcctatatagctaggtacctagtagcagagaaaggagggaagggtgatattgatataccacttgcttccaataccttaattatttatcccttttgtggtgtggaaatcatcaacgtcgattactagcatcattttactctctgaatattatgggtatata

SEQ ID NO: 1902 - DNA, 1501 bp, Oryza sativa
aggaaatattcccttatttgatatggtaattttatcttaaactatttttcctatattttttttatgttttgaactaatcagcatcaaatattaagggataaatgtagtgttataagagttcgtgggtataaaatggagatcttatatgagccatgaaattgactctagctaggtgaatggaaatgtcacattgcttggtcacatgactcggtcacttgaaaggtgactccatgaccaaacggaggaaggttcgaaatataagatgagaaacaatctttagaggaagagttagtaggagtacgtgattattttgtactccgtcgttgacatgcatatatattgttgcgttgctatcaagcgagaaaactgacaggtcagctcaccatggccgtaatatttggaacggcaacgaattgtttccctttcaagaacaacttgaactaattttgaattgtcacttacgtgtgtgagaaatttcgtcatcgtatcacatgaattccctctaaaatactactgctttctgaaggttggcttcaagcgagtgagagagacccctgctttattcttacatatacttgccaaatccttttgcattcttccacagagaaagggtggaagagatgcgcgaggacttggggcttgtttgacattttgattgtgacactagtaaattctgctgctaaggcccttgtttgtgataactgaaatcgatggattatttgatttttatggtaaccatttgaggatatatacagatgaataaattaactgctatagagttgaaaaagttgctttaaaaagtatcccatgaaaaatttgcatactctagtattttatatgaaacgtatcgtttagtagctttagaagcgtgcaaatgaaaatctagaatccagaatcagaaaagaacatggccgaattcatgcacttgcacctggagcatcaaagctagagtataaacaaagaacattgcaaaagtttttggttggcattttttatcaacttccaaaagcaaaggttggattgacaaatataatccgatacctcgtctgtgcacgcgcttataggtcagagcccataaccttgcgctgcacatatcctttgccattaggttggcatatttcggctgcagttggattctcatatcgaatcaacttgttctcactgtttttcatcacaaaaaaaattcttgattagaaccaaatgaggaaaatctgtggcagtatcgagatctatacgaaccccaattatttaggcgatcgaatccctcaaaagccatgcatggcgtcaaaagcgtccgttgattattaaggatcgatggatgcatgcagagacgactgcgtacgacacaagtgggttcacatcctctatcataatatcactgtcactacaactatcactacagacactaacgtgtagatcgaacaataagagagtatgactcacaaccagtgactataatagtagttatacattatagtagagaatcctcaccggacaaaaa

SEQ ID NO: 1903 - DNA, 1501 bp, Oryza sativa
tatttgtctttctatatttttgcggaaggttatttttgtattttcatgattccttctttagtcagatcggatcgtgagaaaggggctagtcccatgcgctgccggtgacagccgctgcacgcgtccctggctcgcccccagcagccacggcgatcaagggccgccacgcgcagcaaaacaatgaaacgtcagcaaattaattctgaaagcagtcgaagattcatagggtcttttagagttcgtaacttcgtatgtgctagcaaatgctgatattcgtttcgatcaatcatgtatacaagcatcgtagtcgcacaaccggacactggctggatgatggcgtgccggtgtttgggaatctttcgatccgccgccccgcgtgatatattccgaagaagcgccgctgctcgtcgaacggacgacgagatccaaaacaaataccaactaagcaaacctttccagattaactccccccggtgcaaataaatctcaacttcaaattactaaataacccattctatattttgaacaaatactaaacatacccttctatataaagagatgcggcagctctactgtagacgctgagccatgccgtcggacgccgttggacggcagaggccatgtaagggaggtctagtttgcattgggccgagcccgttaatctgatgtaatttttttttccttttcagttttatcggttgaggaggtggcggagttttcttctccgacccctgttttcgcaagaggatcgccggcagaccttgacaactgtattgctgctgcttctgtttacacgtgtcttttttttttgtggacaacgtataacttcgatgtatgtactctatatatccccattgctttgttgtctccaaatcgctgttttgttgttcgtaccaacagttctacatcgtcctcggtcctgtggccttctttactgttccacaactgtgtcagtgtttatctgcctatcatactagtagtatatcaactagttcaccaatctgtttcatgtaggagacgcgggagcgattcgtgcagcatgtcggttcataaaaacactattgatcggtggctgaaggtattggcttgcttgttctgttttccactttttctccagtgaggaggaggggttcggagttttcttccccgaccaccagttttcctggtttgacgaggcagcagagcaccagcgcaggcagggtagtagcggctcgaacaccgtcttctcggctcccgtgtggtagagttcctcgccgccatacattccgcttacagcgcaacagatgcggcggctcggctgtcgacgcctcgacggcaagccggccgtcggcgccggtggacgggaggtggggaggagagagcaaccaaccagcagggctgctaattttctagttgggcctggcccgttgatctggatgttatcggcttgtttcttttgttcctttttcttgttttgtttatttgttagcttgatcatttccgtcgcgcggtctctttcgtt

SEQ ID NO: 1904 - DNA, 433 bp, Oryza sativa
cagtgaagatcagcaatttctcccctggtttgcttgccgtccaaaaaaaagatgtcccctagctttgatcagtgcgcatgcatcgactctactacgtgtaaactctacagaggcacgcctcatgagactttccttgatcagctatagcttcatcggtctgaacccactcatgatgaactctctgaaactctccccgttccactaacaccacccactaacatcatcataaaatgttttgctccgctcgtacacgcaaagagacgaacacgtcgccgcgcccgagctcacggtgcgcctcacctactgcaaacctctgcaaatgcctataaatacaccgacgaggcagcgatcactctccattcacagcaacagcacatctcgcagcttaatttcagcttactgatcagtgatcactgagctagctgagacaagt

SEQ ID NO: 1905 - DNA, 1501 bp, Oryza sativa
gtgacacaatatccctccaaatgttcataaatccattgaggaaaatatttgctgctgacatctgcacttgcactgatattctttcttgctccaaccatctcaaggatcatcatcccataactatagacatcagacttgctgcttgcatctccaaattgctttgaaaatacctctggggcaatgtaacctattgtccctcttgcaccatcaatagagatgatactctctttttgtttgcacaattttgccaatccaaaatcagatatcttaggacaaaaatcttggtctagtagaatattgtggggtttaatgtcaaaatgaacaatacgagtattgcaccctcgatgcaaatattcaagtccccgagcaatcccaattgcaatatcaaacaatttctcccaactaagtgaatcttcagtttcagagtttggtctgaaagcaaatctctccagtgatccattaggcatgaactcataaatcagagccctttttgatccctgaatgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagtcacttgaagcatgtgtggtggagagaagaggggaaacacgcgcgcgctcgctcgcctcgccgggccgggccgggccggcggcgcgcgtgcacgacgtacgcgtcgaatggtccgaaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcatgcaatatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcatctcggtacgtgttcaatatgttgcgcatatttgatctgttcatgttatactgtgtagtttacatgtgtagatctaatgatgcgtccatgctagttttcatctgtaatgtcatgatttatttatggaatagattaaatcattatatgtctataatctcaacaatccaaaaaccttattgtaggcactgtgattttacta

SEQ ID NO: 1906 - DNA, 1501 bp, Oryza sativa
agttagaaaaagtgaatgatgaatgatgagggttagtaattggttgcgaaaagaatgtaaattataaatgctaggagttataagcgtgatctctctccaacttttaattgcttgttgtcgaaacaaaacatttttttgcgggtaactttgacagtgttgcatgaatgcattgtggcatcccaaaagccaattgctgttcgtataggtgtggtaggcatccccgcacatctttcttgatagaaaatgaaacctggttttgttgatgcgttctgccatgttggtgacggcactgcttgtgccaaccggtatgacggcagcaaagtatctagaaactcctattttcaccccagaattctcgtttatttggcagaggttatttggtactaggaactgtgaaatccctgtgaggtaggggtggagctggctcgtgctcggttcgtttgagatcgttgtcttaactcggctcgttaatgttaatgagctaaaaagctagttcggctcggttcacgagctagctcgttaggctcgttaacgagatatatctcattaataccatattaataattttaaatttaacattttattatgtattaacataataataaacactaactaatataatactctctaaatatgaatagttttgatgtaattaaaagactaaacactagttcatgaagatatgatgatattttatactaacgagctaaacgagcagttcacgagttagcttgttaagctcacgagctaaaaggctagctcgacttgactcattaagactacgagttcgaatcaatccgagccacgagttttgagctttttatccacccctactgtgagcgcaagtgcaccaccatgcctccgagttgaagatcactggtgatcagtagtcacagttggtgggtaacttctcctggaacaagacgaaggttctgacttttgaccatcgcaaaccatcgcaatcttatttgacgtgagccagacgagagtgcgacgtgccagttcacataaagaacaggtaccaagacgcctcaaatctttgacttgtaccaagtgtttgcccgaaatttccttcgggctgagccgccacggaaggagaaaagaaaaaccataacccataaattcctgaaacctgacgccatgatctgtctcatgaattcttctcggccgtcctctcttgacctatatgaaaacaatcaatgagccgtgcagtgacttaatcgccgtcttaagtagtactagtacactcatctggtattgcatttctcgtccatacatctacccaggcaggcagctagctagtatcctcttcctctccccttttcttgttgctcttcatcaccagttcaccacacctttgagaagatgcatcccctatgttcgttgccattactcatcatcatcctactctcatcggtgccaccttctatgcaagaatccggtgcctacttccggtacacaaattgtaccccagcttcttaccagtgtggatcactcaagt

SEQ ID NO: 1907 - DNA, 1501 bp, Oryza sativa
gctgttctccaagtatttattcccatttgctcatatatttttgacttgtgacaattggtaaaaatatatgaaaaaatccccgcattgattccagtgaggtcgtcaactcaccaataacatacgctttatgtggtggactggtggtatatatctgttagtatgaacttcctagaatcagcctctcagtgcacagtaaacaaaagaactgaacatccaccagtaatctctcatgatcaatgcatgtttttattgactcaaccatagatgtttcatgtttgtagttaaaccctctatgatctggccatatgcactggcactgcaatgcacttctaatccaacaaaatcctgccatttcgtccgtgttctctgcttttatcttgtatctctaccaccaaatcaccaatccatctatgacaatattcaaccaagtgaagacatgttgtaccagatgcttgtcacaacgatttacaaacaagtgatctgtcagattttgaattcattctgaagcatgcatgcatcttgtgcaggtttttgaaaactgttctgattacaaatgaaggtaggagtactatactatctttccgctcaaattcaacgagcacgcgtgcacgccaacgaggcttcccctaattggctgatctgtcgcacttcgcgccaccgattcatccatctctgaatgactgaatctgatctgtcagattgcctgatggttcttgagcaacctcgaagctatgccatttggaccaacataaaagagtgattcatagaggccatctggaccatccctatatggctagacaccatggcttcagtttgcttgcccaatatctgggcttttggctgcagaaaagaaaagggattttactaatcatgtcaactgctgaacagttataaacagcagaagcagactgaacaagatggcaactgcatatatgaacattctatggcatgacgtgaattcgtagcctgcacgtgatgcacagcgtgctgaagattttcctctcttgaataagacatgtaccagcgatgaagcgatcgatctcatgatataactaagttcttatgcgagtatttcaacggaacgcatgcaagtatgtacgtggtcgtttcagtcgtcattgtgaaaatttcgattttttacaagagcagtaagatcactgtaaaaccaacatcgatgaacaaggaagaacagcaaaattcagacaaacactgctctgaacattctttgttattctcttctgtgcctgctctgtccacgcatccagcagcttagtttcagaaactcagagacaaaacacaatccagacatatccataaatcaaaagagcacaattatggtggcgattagctgttctaatctaatcgccatgaagccaagcaaaggtggctttccattcctgccggcgacgggaacatgctgcaattggacatgtgagtgcagcagagtcaatcccctgaccggtctcagcttcatcgtgcatgcgggtattgcaaatcctgc

SEQ ID NO: 1908 - DNA, 1501 bp, Oryza sativa; identical to SEQ ID NO: 1901

SEQ ID NO: 1909 - DNA, 1501 bp, Oryza sativa
ggcatgagcttcctcgacaattcgaggaggtgagcaaatgcagaggccaagaaaggccaggaggaaatagcagctacaagaggaggcttgcaatgggggatttggatatctgaagactgaaacattgggagattgtatagagagaagcaagagatggagtagttgcctgtattattattgcctctttgcttgcttctgagacttctttttttcctgattatgctttagcttctgatatgctttagttgttcatgcagaaagggaaccaaaagcattagagaaatttgacagcaaaaacggaatgatgcttattgactcaagaaagctattcttttcgagcaaaactcaaggaatgaaggcacttgaccacaattgcaggggaaggtttgcatcatcaagtcatactatattgccatttgcctaaggctcaggattaccctctaccaacgcaaacctatcttacaactgcagagttaaaagaataaaaaaaactcgttgattctgatacatctttcggttgcctttctttctgaattttgacatcacttttgcaatgtgatttgctggtttggatagtggagaagttgacaggtgcagatgttcaatggtggattaggcctctctatggcttttaggaatttattattatttacgtatatctaatcccaaaagcgaggattctcttgcagcttctactgctagtatgatttcacagtgtttatctaggtgtattattccacacgtgttgcaccggattgtaattgaagctccagagtgacgtcagacggtcagagtgagaaccccgcaaaaaaaaaaaaaagtttcacggcgaaacatagggctcttcaccaatccggcccaatgagcccaagcagaagaactcattggtccaccaaagtcttcgatatttcggaaagaaaattaagatactgcaagcctgcatcgtatttttcaaatttcaattcacactatctctcacagctcacatccaaattgaacagtcctatcctaaaaaaaaaattgaacggacacagcatcacttgaaattctgagttgaatggtgcaccttgttttcaatgttttcatagtttgatccgcactgtatttttcacagatacttccatcgtcaaaaaaacgaatttaaaattggatgtgacatattctagtaatccattaacacaataaaactatgataaaactactgaaaaaaatatctaaattgaacgggcgcagtataacttattcaacgaaatacccgattatttagagttcataggtcgacgaaagaaaaaaaaagaagacatacactcttggccgttcgatcccatccgacggtcaggatatcccgtccacgtctctagcccagataaaccctacccccccactcctcccgactataaattcctcggcttctcccctccgccgcctcctctcctagccttcccctcctccgccgccgccatctgccgtcgagagccccggttgcccacccccgcggcga

SEQ ID NO: 1910 - DNA, 1501 bp, Oryza sativa
ccgcaggcgagtacagatggaccctcatcgaaacgaaacgaaacccatgccaagaacctgcgtgctctttgatgagccagtcattcctcgaggcatcttttcatcagatcagaattcagagcctcgcgagaaagaaaggctggcccaatcctgcagctgcacagatcccagcagctgcagctgtagctgtagtagtagctgtagtcgatcgacagtgtccgagccaatccatcgccgcaaacaagccaaggggaagaaatatatatagccctggccacgtactacgtactagcctctgccgatctgccatgggcgctagtatagccatgtgaccgtgcgagagtgcaagtgatgggtacagacgttgttagcaccaatctgggaggcttatctccaaacccccaaattctctccattccattgccgtccgtcgtgtggctgccgcacgctggaggggcagcggcaatcgctagatttacgagggtcccacggcgcagtggcacgacgacgcagcaccgtccgggattttcaacggcacccgaacctgggcgtatcaatcgctttgtctcccggaaaagagaacgacatgggatcgtattaccccaagcgtcgccgatgatcgccaaaagtcaaaaaaacgtatcaccgtccaccgaccgaaccgaggtcgctaccacgtactaccagtagtagtagtagtagtacgcggactcgcgaccagccagccgctcgggttgtctcctctttttttttttttcttgccgggatgggagcgtgcaccggtggctgcactcaccgtcaccggccagtagtctaggcgccacacgaagcggcggcctgcgtcgccgaaaggcgggggaaaaccccgaaaatacaggagaattctgcgtttcccgcgggcgcgagagcccgcgaccccgcgcacggtgagacagggaccacgaccccgcgcgaactcccccttcaggtggacgaccaacccagcccagccagccgcgcgccggtttgtggctttgccgaatccaacgcttgcacacaccaccgcggcgccgtatgccgggtcccccacttgcattccacccggtcgtcgcgtcgcgtgatcgcgtcacgtcccggcgcgccaggatacgggtgcttggctccgcctccggcttattatttaagcacgcgacgccgcggccatgtctagtctcctcggctgctactactactgccgttgtgcgcacaatgccaagcgacccactactgccctgcgtctgcgtgtgccgcgtatacgcacaagccaaagagaatttttaggcgggtagaaacaaaaatcagacccagtttcgcgcaaaaaaaaaaacaaagagaagcccgggggtaagagagagagagagaatttgggagatgtgagacggaagcaacaagcacatgagcgttttgtgattaggaacggacaaaacaaggtcataaggcggcctaatcaggattggaggagaggtctagtctccctttctag

SEQ ID NO: 1911 - DNA, 1501 bp, Oryza sativa
ttgctgccgatgagatcggaatgaacgattctcctcatgctgctctgcattcatccaaacttccaaagtaacagtattaaagtaattttactaattctttgtttcatattacatgttattttgactttaattaagatagataaagtttatagaaaattttagcaacatctacaacaccagtttagttttatagaaaccaatatttgatacatttcaataatatgatatgtttgttttgtattaaaaattttgttgtaattttttataaacttgatgaaacttaaaaatatttgaatagtaaaaaagtcaaagtgacttagagcaaccatactgttgcaaaaaagtagccttaaggtctttaaggtgaaccataacaattatggtattgaatatagtctaggccacaacaagaaataaccttggtggattagttcttttattatagtgtgctatctttatacattgtgaaaattgaaataacaagagtccagttgtgtgagttctattttatatgactagttggtccatatatattggtgatgtactaacaacgatggtcaattgctatagggtccaccttaatgctatgttgtggcaataaatattgaccttgcccttataatatgaaacggatgtagtagcgctagagaccatttggttaagtttctcatacaccagaaaccaatattcacaattggaaaacccgacacctgggtcggtgcttgcgaactaaatgaatttccaaaaccgcggaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtttgtcacaccctgaagttctcctcctaagcctaaaattgaattaataagagaccctaagaaaataccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcatgcaatattttaaatcccagggaaattcttttcctccttttctttttttttccttttcccttcttttcctcttcttgggccgtcggcccagtccaccccgccgcgcgcgccctcctccttgtgggccggcccaagccgcccctccctctctccccgggacgccgacaggtgggccccacctgtcgggcccgtctccttcctccagccggcgccaccgcgcccgctaccgccgccgcgcccacgcctccgcctcctccgggccacgtcagccacgcccgcgcgtgcgccgcgtcccccgcgcccactcccctctctctcgcgcccgcgcccgcgcccaaga

SEQ ID NO: 1912 - DNA, 1501 bp, Oryza sativa
ggcagaaagtcagtcaaggcaaatcttgactgcgagaatggcagtgagaattcattcccgcctaaagagaaattgaacctgcctactcgaggggtgttgatgagatgtttctcaatagggtgcccgattagaatattgaaatcctggacttcaaaaacatggaaatccaggataacctcgttgctatcatgaatgactggcatatcttggacaaccccaaatccttcaataatgctcccattgggatgcttgaagaatttgtcagttggtgtaattgtcttatcacttaggtatgcaaacgcaaaggattctgagacaatattgacaccgactattgggctgtagagaatcacaacattattcccctctaagtgacaaggaatgggccgaggagtggaatttatcggaattacttcagaagaaagctcaacctcctttagccattcgtcactcataatagaggtcaactctcgaactgtttccttaagaaactggaattctatcgagtcaggaggtagtgagggaacatatggttttctcttgctaaagtagttcaaggtgtttccgtaatcttcatcaagatcatccctcaacaagagagcacaacccggagtttgaatttcttcggtctcaatgggtcatggctcgggaagaggttctcgggtcgaatcaggagaagtagagacttcaactgatgcctcggggaggggctcattatattcgttcatgaaggaggtgttttttagaattcaatctagaattaccttcctttcaatcggagttttgtgcatgaatgatcctacagcagtgatgtctagatagattgcagactccttttctaaacccgaataaaaatgttgcagcagcacatgatcgggtatagatagggatggcattttcacccgtggggtcaggtccaggggacccgccctataggggtgggggtggggccatttttcaatccgcggggcttcatggccgggggagggcatccacccgtgggtgacccacggggccctggggtggtatgctacatcacaatacacagcccattctaggccgaataagtccgacttgctgaaatagtggcatataaaaggccaaaacctaaccctatcctcactttttcctttcccctcactccatcctcacagctagctgccactccaccatctaggcggcgtcgcaacgaggaccccgccgcaccgcgcactgcctccacacaccagcaggctcgacgcccgcgcatggccctccccatccggtctcatgtcgtcgtcgcatcagccacctgagcccggcgaccaggtaaaccgatgtggcgtgcgggtgggcgatggctagggttcacgcgtgcaagcgccaggcagcgagcagcgcaacgggctgctaggctgtcacaccctaaaaatcctaaatatataaattgttgtttaattggaattattagaatttattttaaaaacctaaaagagaagatctaattttaattaataaattc

SEQ ID NO: 1913 - DNA, 1501 bp, Oryza sativa
atctataaatagtgaaacattgaaaatacactaggtgaaatatcttttgtggaaaaagaggagagagaagtgggtgggccgaataggtacgcacgtggggaggggcgcgcaggggtagcccggcagtgagcattttcgtatttttttttaaaaaaaatataaaaacttttgcttgagctaggacaatgtgagcttaatgggccctcacgttcgcgggccttcgtgagccgtgacgacgagtcgatcgatctcgactccgtcacacctgctgccgtgccgactgcgaagagcagcggcgccgccgtcgtcctgctgcttccgccgccgcgtcttctcgccctcgactccgctctcctgcgctgcccgatttccatccatcccgcttccgcctccggtgagtgaccaccctttctttccaattcgccctaaccttatctttctcttctactagatctggatggaagctaaggcttcttctgtctctctcttaaaccctaatactaatagcagttcctttcccccccaaatctggggggtttcaactgtaccccccgcatgctccaggttacagctccgtcactcttttcttgggggaaaagatgagcaaactcgcgaatatgttctctgttcttaatctggatgctgaggacgatagagaggaaggtgcggaaccaccaacatccagcaaggccgaagctgctgctgttactagcagcacggagattggtaagaagagcgctctattgctgttccatcctttgcattgttgaattgaattgatgctctctgtttgtaccaatgttgatcctgtcgtggtggcggtgtatttcggtgctgggtcaatgaagtgatgtgctgctaaatgttgatcccgtggtggtggcggtgtatttcggtgctgggtcaatgaagtgatgcgctgctgtcaaccatgatgtttcatagtgaaataatctactggttctcatgatatcgattcatcataaccaaatatgatattatgttgccagttttagattggattgaaaaaaaaattgaaacatgaatgtctgatctcatagatcaatagtcctaaatcctgaaatattgtttgtcaaagcataaaatcagaggcttttattccattcaccggtttgtgaagctttctaaatagtcatgcagtcttattcaatgtatagtgggtggcttattgaaaactaaagtcaattcttccaatgcattttttgttatagaagtccaaattacactgtatcagaaagcaataatgtattgttaggggacttgatctaatctcctaggtcagtgatagaatcacgaaagtccataaaaatctatcctctaacaatagatcaatgacctatgcattaacatgctaacttgatttctgcagtgacgaataaatattttattttagttgttttgtcttgtaggcatagcaccaatccttaattgctgtctcctcaggatgagatttaaaattacttttactttgcagataaaa

SEQ ID NO: 1914 - DNA, 1501 bp, Oryza sativa
ttttggtggatctatgtatgaatgagctacaagtgtgagctctcttctcccccgttctaagttcctaatcttgaaaagaatcaatcccctttaccccatgggcaaggtcctccttttatacttcaaggggataccacatgcacccttctctttccaaactggactgttctttttctctagaatgggcggagatcagcacggttgctgttcgaatgacactccgatgggactgcccatacctacctccacttccgccgggggtgagcgcgtcgtgggaacacggctgtgcgctgacgatatgattagtgtcagaccggtcacagatcggtcattcttgtccaccgcgtgtaatcttggcaacgtgcatgtttgcccttcttcacacaacatcttgcctgtaatggttaggatgaagcctggcatatatcgaccggggctaacgtgtcatctctaagagataacacgcttaactccggcttgagacgagtgcatagaggctttcgtcttgacgggacggggcaaggcgtgcgccagaccgccagttgccacctaacccgtgatctgaccggtctgtgactgatcacagaccggataaagggacgcgctgtactgcgctgcatgcagcgtgacgcgcttgaccagactgcaataaatgctgttaggtgagcacagctgtgctcacttatcctatatatatatggcgcagatttccttaaggggtcggggtgcctcggccctcggggccggggcaagcgcaacccgccccccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttgtgccagaacaatttcccttcccaagggaagcggtcaggtgtgacgccaccctgtgacaggtgggaccggtttccgtagttgggcaaaatacccaacggtctcaatccatgcacattggtattggtaactttggttgtccataatgggcggtctattcgagactgccacaccacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgcca

SEQ ID NO: 1915 - DNA, 1501 bp, Oryza sativa
catcttctcccacacctgcgccgcgttgatttcggttaacccctctcttcaccgcccacctcgatcaggcagtcggagccggattgagttactacatgactttgagctacttatatgtgggacctctttactatgagctccacatattaatgacttaaaattatctgatttaggccttgtttagtttaggggtgaaaagatttagcgtgtcacatcagatacacggatatatatttgaattattaaatgtagtctaatgataaaataaattacagattccgcctgtaaactgcgagacgaatttattaaatctaattaatatgttattagcaaatgtttactgtagcaccacataaccacattatcaaatcaaggtgtaattaggcttaaaagaattacacctaatttgtgtaattagtttttttttctatatttaatactccatatatgtgtcaaaatattcgatatgacggggtgaaaattttttgcgtgaaaactaaacatgggctttaatgtagagtatctcaatccgtcggagctaccgtcgtgctcacccgcgtggccgcaggcccgccccaaaaagatcgtcgtcgccgcccgtcgccgtcacacccctctcaccaccaccaccaccaccacccgagcaataatttctgggggagggccgcggagatgccgtcaccggccggggggcgaggtggccgcgccgcggccacagaatcccggcgagacgaccgtgagtcgctcgatcgctcacgggctcgcggattgcattatcctcacctgccgccgctgctgctacgcccgccattctttctgtcgcctacttgcttcctcctcttcctcttcctcttccctcgtctccccggcgccacctgactgattggattggtatcgatccaagcctatcagcctagctagtgacctgagtactctgctgtctgctgcctgaatctgaatcgatcgatcactcgctcgctgcctgaagagaggttgctgattaatttgtctctctctcgtcttacttccctttttatgtggcttctcgttgagttggaagaagtggtagaccagtagcccagataaggaagtggatagggtaatggaacagtgaagagagagagagagagagagagagagaggggtgttttgattggtgtaccattcttctgtcaggttgctgttctttacatttctgaacttgaacagtgaaaaaaatggatgggttttttttatagtactccctagataagcaaaagaatccttctgtttaggtatctttgcctttctcgtggtgtcctagatttgttggagcaagggttggttgcatggttttgtgatgattaatttgttcctttttgggtggatgtgagtgtaatgtatgaattttctgattattattatttttttggtgttgtttgcagcaagaatcgatggttgcacggccaagattgctacaccttcgctgataaatagccgaggacaatctcatcggcatcca

SEQ ID NO: 1916 - DNA, 1501 bp, Oryza sativa
taatgtagaggaaccaagtagtatatatagattgtcgaaacaagatttcggtaatacttaaagggggtggctatcaagctagaaaagtggatgggtttgaaaacaagaaattttatacaggttcaggccttcttattcaagaagtaataccctactcctgtccggggatgattccgccgagtatatattgatcgtatgatctggggaaaaagaagtgtcccgagaggaacccggacccctccttatataggggaaggggtccgtattataaaatacagtccatatcccaaacggaatatatgattacagataaaatacaatcgtaaccgactaagatcccgggtatttccttgacatacaagtttaaaaactaacccgaatcctcgtaaagatattctatctatatttggtgtcgtgtacccaactaaactataactgccatgtagatatgggatatctataatctccacagtagcccccgagacctttgcagtcgacgaaatagctttttcagaacaaaaagcaaaaatccgagtgcttcaattcctcttgctctggcctgccgagtactaaaatcaaagactgtgaagggcgaaaataaaacatggtgcatcgagtagatgcacctaattaggtataacccccgactatgtggttagttgaaaaactaaacgtgtagttaagaaccgagtggttttacaaccaaacatcatatagcaaagcacgcatggtattcagtaaaatacccagccgactgcttctcaacttgaatatatcaagaataaaaatatgaaaagggcccgagtgataaacactcaaaatgtccacaaaaagacatatttgacaagaatccgagtaagaaactcttaaaatgatctaccaaatatgataaaaatcatggtaattaagaagtttaatagcctaggctataaccctcaccataatcaaaataagcatataatatgccaagagaatgactcttaataaactagtcatctcgaatcaacccaaatagcttttgcagcctaataaagcttacaaaaatagtataacacctttctgtcgggcacctttttatttgcatcgtggtaattccaaagaattatcaaactgcgttaaaaaggattttaacagcatcgggtcacatcattgtgagcacaaattgccaaagcaaaaagcgcctaagtccatagggatcacaacgggccacgctggtaataatattgggctgaagtactgtacaggcataggcccattagcactcccgatactctaacaaaacaccgaagtccaagcgacgcttcgtcttccccgccgaaactctcgtcatttccccactccttgttacagtacaaagctgcgccgacgaagctagggttcatcaatccgccccaatccattctcaaaaatccacgaaacttctccacgcgtccaccgcaccgattccccattcccctccagcaacttttcagaccgaatctgactgttcgactcgcaccca

SEQ ID NO: 1917 - DNA, 1501 bp, Oryza sativa
cgacggcggtgacaccgactgcacggtgaagaaccaccggaacagctgaagagaggggcgcaccccaatgaacatctcgcacaggtgcgcgaagatggccagtgtcatcaccgcattgggggtgaggtgcgccatctggagattgtagaactccagaacatccatgaaaaaatgagaaaatggcgggaccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtctcgaatagaccgcccattatggacaaccaaagttaccaataccaatgtgcatggattgagaccgttgggtattttgcccaactacggaaaccggtcccacctgtcacagggtggcgtcacacctgaccgcttcccttgggaagggaaattgttctggcacaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggggggcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaaga

SEQ ID NO: 1918 - DNA, 1501 bp, Oryza sativa
ttgatcggaaaatttggtgtcaagcttttaagtatactttgtttgatgatgagttatatcgccgaaatatagatggggtgttattgaagtgcttagatagtgatcaatgcaaggttgctatgagagaagttgatgaagggatttgtggaactcttcaatcagcccacaaaatgaattggctacttaggagggttgggttctattggccgaagatgttgatgatagtttcaagtactatagagggtttgaaccttatcaatggttcgacaatgttcaattggcgcccaccgccttgttgaaaccaattatcaaaccatagtcgttctgaggttggcgtttggatttcattggtcaaatttaccctttatagtgaaaagaacatcggttcatgctagttgcaacggattatttcaccaactaagctgaagttgtaccgctcaataatataactcacacagagctagttttctttattttcaagcatattatttatagattcggtatacctcaaattttcactacggatcaaggagcttcttttatgtctaagaaagtaaaataactttgccgaatcttagtattaaattgttaaattcttctccttacactacgctcaggctaattgacaagtcgagtcgagtaataagggttttcttgaaattagttaagaaaaagattggggaacatccaaagagatggcattaagtgttctttgaagcattatgggctaatagaatatctaggtaaggtgctaacatgttaacaccttttgagttagtctatggacaagaagttgtttgacttggctctcttagatatatcaagtaagatgatttatcggtgacggagcgtggggctcctcaccgggagaccgcgcaggcccccctttgccggttcggccgggggcactaagtgaggttcttcgccctcgatctgaggaatgtcagcgagagaggaagtgcacaagacacgggcgacgtagacaggttcgggccgctgagaagcgtaacaccctactcctgtgttctggtggatctgtgcatgaaggaatacagagagccggagagcgagagagagagagttcaggctctagaacccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctct

SEQ ID NO: 1919 - DNA, 1501 bp, Oryza sativa
atgtaaatcaacacatctctatatagtattgtgtggcctctgttgtatgcctgcccaccaaacgaattgtgtctctaactcgtgagattgctgtcctcgtttggtcgtattacatttgaattaagctttaaacttgtgatgtaatttttttaagagtttgtgatgtatttggagatgatctatttgaggatttggagatgttatgtgatatgtgatgatttagatttgggatttcttggtatgatttgaggatggtgtgaaatcaatattgaatgttaaaaacaatgaaaaagaaataaagaaaaaagatctttagtgccggctgataacaccaaccggaactaaagatggatgtttagtcccggttatttgaaccaggactaaagatagcgatctttagtcccagattcgtagtcccggtacagggggttacgaaccgggactaaaaagcacttctccaccagtggagattatgctctattggaacctagaaattttggaaatcttgtttattataggattaagggactactccgtagttgtgctactttgttttcgatattaaggtaaccaaaaacaataaatagtgtagactgtgaaagttgttcgatatttggggcttgtttagattgtagccaaaataaaccttaccaaattttgttattaccaaaattttaacaatttggcaatattgctaagttttgtcaggatttattatttattttttagagtttggtaagaaactaaatggatgcacatatttgacaactttgaaaaaaaaaatatggtttgaaatggcattaatctaaacaagtgcttaaacaagtgcttggttttgatttcgtggaatcttccagatgggaaagttgaagggaaacattaccgtttgaccctgtaaaaggcaaggagaaaaatcttgcatggtgttgcacgcatattctgctataaattattcctgaatatgcagtagtatatctctcttaaccactaatgttgatccttttatcttctctatcgatcaataaggcaaatattttgccttaatttcaattttcttaaaaaactaatgttagaaaaaagaaagttgtttgcatccgaatctctacatctatgtttacgcagacataaaggccaatgttgatttgtgtttccataaacattttttagttatttatacatgtatctagattatagataatttaaattagtagttgaatacaagtgctttgctacagataataaaacaactttatctgtctaaaaacacaactacctatgcccttgtctttaacaaaagactaaatttgggatgataaatgtttgtggttgattgagatgagaacataggtggagaaatggttgtattttttagacaaatttaaattctagaagtagttatattctaaaatagatggagtatattataatattacctaaataaattataaatatattttctataaaatatattatctatcatgcttgtcagtgtcaagcgtaa

SEQ ID NO: 1920 - DNA, 1501 bp, Oryza sativa
aaatgaaggaaaatgtaacgacataggcatgaaaaagatcaagttaaaatttcaggggtataaaataaatcgggtaaatattaggggtgtcaaaagggatcggttgaattttcaagggtacacatggaatttactcatctatctattgctccctctgtccatgaatttagtggattatggaatgtaaaggatttttgttaagaagtacaacagcaataaaaaattgagtactcccttccgttcccatcagaaaaaaaatatagagaaaagtacatgtagtattactctatagctctgaatctaggccctgtttagttcccaaaataaaaattttcacgctgtcacatcgaatgtttggacacatgtatagagtattaatgtaggcgaaaaaaaccaattacacagattgcgcgtaaattacgagacaaaacttttaagcctaattgcgccatgatttgataatgtggggctacagtaaacagtaaacatttgctgatgacaaattaattaggcttaataaattcgtctcgcagtttcctggcagaatatgtgatttgttttgttattggactatatttaatactccaaatatgtgtccgtatatctgatgcgataaccaaacccaaattttttccccaactaaacaaggccttatgtttatttctaagtctaagggccagcttagttcacgaacgaaaatttttggcgtgtcacatcagatatacggacacagaaaaattcgtctcgcaatttacacgcaatctgtataactagtttttttctatatttaatactccatacattatccaaacattcgatgtggcatggtgaaaattttttatttgggaactaaagagggcctaaatgtatactttctacacttctttcattctaaagatgagtgtcttttcacactaccaaatggctcagatgcatttcttcctcttccttaatttgggctatattgggcataataccctataatcttcgacagagggagtatatactaaaaatacattaaacttcttaaaaaggctctcaagcttacatgtggcattaaaaaatgctctcaagtttacatgtggcgctttaataaattagataaaatgctaagaaaaaacaaaacatatcacttgattttcacttaaattggtgggtctaatattatgaactattatgttatattcgcagcaagccggcatctcgtctactccgagcaccagctgcgaatcggcctcatcggccgccgctgccgagcacctgctgctccaccaccacgagctcgacaacagagaacttggcggtgagcctcaccttcgcgtcccggatgatgcgcaccatgtcaacgatgtcggcccccggtcacctcgcctctgctccccgtcgctgccaccgggtagaagcagttgctgtagaaccccatcgccgccacgccgtccgccttgagaatcaggtggcgcgtgttggcgaagaagcagacgcgcatgatgcactcctgctc

SEQ ID NO: 1921 - DNA, 1501 bp, Oryza sativa
agatagatacagaatgatctattttggatgactattcagaccaagatatggagtaccgatactctagtgtgtgatatggagggtaaacaaaggaaaatagtataattataaacagtgttccttgttatgaaatctatcttattgtggatgaattaaattatgaatgcgaagcttactacagaagaaagcttacgccagaagccaacttacagaggaagccagcttacggcgcaagccagcttacaggagaagcccgcttacggcgtaagccggcttacaacgcaagccagaaggtccaaggcttacgacgtaagtctccaccctcctccgcctataaatagggcccagaaggtccaaggcgaggacaaccgatcttcggtctcctgcttctcctcttatagcttgtactcaaatccagaagaaataaagcttccactcactcatactttctatgttcaacaactctgtgtttggtttgcttgtgtgctgatcagtagaatagactggtttctcaacacgttatcagcacgagactctaccgagctaaaaaggtaaacaggtgagaaatcagtttctactgatcatcttgctctttatatgcaaatcattcttctgctatagttgaaataagcagaagagcatggtacctgaagtaccatcccccgatattatctcaacgatacacaataacatcatggcggctctgccgccattatcgttgaattgctacagttgatacatcctctcagcaacgcccggtaacatgatggcagctctgccgccattaccgtccaaaggcttgagatggtacatccccttagcactatttgataacacaatggtggctctgccgccgttatcgtccaaatggtaggggcgatgtaggtgcctgaagcaccggcatggcaacttggacggctccgcggccgttgccaccaaatatcggaggcaaacgaaccttctgcacgaccctgaagtgtcgttttggatgtcctttgttttatggacatcacccatatgggcccttgatgccactaaggtcggctctgccaccatgaagcatgggctcatagtggggaagtgctacatggtttatcttactttttacagtctgcacaatatacatgaagttgtgcccatgtatactcttcgttttgttttacatgcttactttgttgtttgcatgtctttcataacatttattttattgttatgaaattgatttcctagcatgattgataatagttaatcaagcaatatgtaatcctgaagattacttaagttaatttgctaggaaagattctatgggaaactgtgtgataatcctaaagattacacacactagtaatcctgaagattacgcatgaccaattcatgtcgaccctgcacatcgtatttaccagtcgtaaataccaaattatgttgcagaacatgtcggacataacaaagaaggaattcgccgagcttgccttggatggtagtaactacctcacttgggcat

SEQ ID NO: 1922 - DNA, 1501 bp, Oryza sativa
cctcttctgaagaactgatcatctctccctctctctatctagacctctctcatggattagctagccatatctctctctacatctcactaactgtagaacattactgttgatttggatggtgagctgtggaggagatggtacggtatttataggagatggaaaggatgggttacttgggcagtttccgtttgaatggaataaacggggagatgccgccattggccgattgatgtaacaacagagaagacgaattaattaattaataattaattaattaattttcttgtcaccaacctagctactggtatcgaccgtagtagctgcctatagcctagcttctctcttccatctcgacatctcttctcctatgtgggacaagcttgacacatgaacgagataagcttgctttggagcctactacagcttggatggaccatatatatgcatgcatcgatcatacagtccacaactttacagaaaataaacttctttctgttaattcacagctaaaatataatctttcgactattacataggattaatatatagcaaaaaagaaaagtgtatacaatatactccatctgtcctaaaatataaggaattttgaagggatataatatttattagtactataaatctagataagctctttatccagattcatagtactagaaaatgttacatccctttaaaatcccttatattaattatgagacggagggagtataattatatatatacataaaatgaactactgatcaaaagttgatcatgaattcgcatatagcactatctgtgtcgacattatatgcaagaatctttcttctttccagctatatgggacatgcatggtccattgctgaaggcttgactactcatgagtcatgagtcatgactactcctgcatggagtactctgctagctgcacgctctgaatctctgatcaaaagccatgtaaacggcggtgcaattgcaagcagtagcttctcccaatgcgccttgtaattctaaaccaaatttaacctaacacacatgtgcatatctgccccaccgccgattctatccaatcaccccatgtcatgcgccattcctctctgacctctctattgttcttatctagatctccctccccatcggaaattttcaggattcaatttgttcttttccaatgaatagaacggtgtggatgaactaatattttcaattccatttttcagctttatactagtattcaattaattcatttgtgccctccaataataatcacaagtcattcagttcattagcacggttaatatattataggacagaccgaggaacatatttcacaagtcattcagttcttcattagcatggttaatatattgtagcaggacagaccgaggaacatattttgacaaccaaatcaatttaatatacccctcccaaaattgtttttagagaggtttttttttacctggcctctaaatccaaccgaatatatgcggtattttgaacaagc

SEQ ID NO: 1923 - DNA, 1501 bp, Oryza sativa
tatatttgtaaaaattacccaagttggacatattaaaactacaccactctagatttgacgattttgtttatgtttatgatattgcgaaattttgtgaggataatataataaattctataaaagatagtgatgtaaagtcataaaaatgctagatatatatagaattacagaagggatctgggacctatatattattttgtccttttcagatcagtaacacttaatagttaagtcatcgagtgctcaccaaaattccaagtaggaaattcttccgaagaaccgatgttctttttacgattacatgttgttatgtagtgttgatcaattaaattgacatccatgtcgtctctgctaaagtaatatgtgttttctttacatctaccgtaggttaagtatttactaggagaaaacagcagaagagtcaaacagctagcaatttaattccacacctagtcatcaacatgttcttttcttaattttactgaaatggacaaaaaagagtgtgtcatgcacacgcagtcatacatcttagtacatttgcaaaaccagaggcaagtatatgaactaaacgttaatagcaatggctatatataattaatgtttactcagatttgcttgttaacaccccagatcattagtctctgaaaaaaaatgtcatccaacaggcggcccaactgactgcaattctggaatattttgagcacattttcttgcctcaggtaattaaatctaataaatgatcacttgttgactaggatatgtcacaatcaggtatggaattgttgttaattttgtgtccttttctgtagcgttgcttatgaatgttaagatgacttaaagtgacatgaaagcttaaaaaaagtcagtgcaattaaattttagtaccatattattctatctccttgctttttcaaagaaaaattatttgtgcagtatatatggcaccttcaattaatacaaggactttgatgtatctggtctacaaataattaattaatgttcagtcatatatacctattaatacaagaccacaaaattaaattaatgtgatcatcgatcatattcagtgcattattgcacatatttactacattaactacacgtacatatactgccaaatccacatctagctaaatattaattgtgtacacctaaaaatatgtacatgtaacgtaaaaatacgtggtatatataccagtattctacggcaatcaacacgtatacatattactttttttttctctggtcaacagtagaaatagaaactgaagatcacctatacgtcaaagaatcccattgtgatttaatgctttaattttggcaacaatctcctggatataaatgtacacgcataattagatagatcatctatctatatatataggtgtgcaagttcaagtgcaagagcacaacacccttattaatccctaattaccaaacactctcatcgatcgatctcgcggattaattaaagtggtattagcgagcttaaacgcgccgc

SEQ ID NO: 1924 - DNA, 1501 bp, Oryza sativa
tttgcggcgagcggtagtgcccgaccctcctccacgcgttgaaggaggtgaggggcactgtggccctcccccgcccagatccggcggcgacggacgccaccccacacgcgctttgaaggaggcgagggggcaaggccgtccccgcgtggatccggtgatggcggtgggagaagctcgacggcaaaggaaccttgctagagttccaattttgggggatttttttcagatttttgcatgcggacaacataagcacccgcacgcgaaactctgatttttcgtgtacgggtgcgttacccacatgaaaaatagcaattttcgcagacaccttcgggcagacgggcaactcaactgcatgaaaaatcggttttgaccatttggaaaaaaaaaacatttttagtagtggttactttatttttctataaagtcaggaaatttaaagaagtttgactaagaaaaattaaaagttaaatgacttattataatataaatcggagggaatcctatgcaacggttagttctaccttatttcgtccaaatatataaaaaatgttaaatggctagctagctatatatatatgcgctcccgaccaaaatctcacttatgctagctaggagctagtagcaagtttaaacactgtactgactgagcaaggcatgtggcaatttgtgggaatatttgtccggccgtgcatgagatcaatcgatcgatacgcatcacctagccagacatgcatgtacatccatccaactagatggaacttcacacttttcacttaacctaatctatagactgaaataggctagctaggtatgagttgtctttagccaaaatggggcaggcattgcctgctgataaggatgttagccgtccatttctgatcattttttttcctcggttactctctctctctctctctctctctctctaaaaaatagactacgttattaatttttgaatatgtatttgagcattctacttattaaaaaaattatgtaaaaacatatgatataaatcatatttaaagtatttttagtgaaaaaacaactcatagaaaataataattacacagtttttttttaaatagaacgaatgatccgtatttaacaaagttaacggtgtcatctattataaagtaaaggtagctttaccatcaacgctgtctatttaaacgcttgtcgaaaaacgagcatttcatatatacacacttatgaaaacaccaaaatacttatttaaagaaaaggaagatagtacttaatttaatatattatagtactcctgtgtatatacatccatagttatatatcctccttatcaatcagctcgcaattgatcatatatatatatatatatatatatacctaatatattttaatttgatgtgacacattctagctagtcgtatctttgtaatggccgtgtttagttcagcgtaaagtttggattttagttgaaattgaagatgatgtgactgaaaagttgtgtgtgtatgacaggttgatg

SEQ ID NO: 1925 - DNA, 1501 bp, Oryza sativa
tgagatgctcattttcatttgcacgcttcgcctctaaacggtgtgtttttaaataaattatatataatttttttcttgaaataccttttaaaaacaacctttctgctctttagtggttaatttattttttataccctcaaacagctatcataaaatcaaattatccatcaatcaataaattttaggcatttttaaactggtttagtttccaactttttttttcaaacttctaacttttcaaacacatcaaaactttcctacacacacaaacttccaattttttcatcacatcgttccaatttcaatcaaacttctaattttgacgtgaactaaacacacccttagttaatttgtgtaaataattgttttctttccagaaaacttcatctggaagtatgcttttcttcagagcatgtgtgcagtgttccccagtgctacttgccaaatagtattgccaagagcctttacaaaaagtttaatttatttggacataacacgcttatttataagggaaataaagcatattttgcactagaaacaaaaagcaaatatacccagtttatactacaaggcaaagaaacggtgcaaaaaaataaaaacaacacaaacaaaaaagtagtactaatacaggaatggataagctggtgacctcattgcaaaaatagaggggcgtatttgcaaaacgtgaagactttctagatgtcttcctcgataaggttccagataagtccaataacttccatctttttatttttttcttttgaaaaagctcacctatgcactttcatcaagctaacatgtcattttaaactaaccaccaaactgttttgtgagctctgggcaaaagaaaaaaaaagacataaacaaaaacaaaatgtcaaccaaacatctacaggtactgtagatgataataattataggttttttactagacaacatatctgtctgaaatgagttaattaatgtaatagcagagcataaatgcaaaaaaacctctacaattctagatttatagagggataaataaaacagaataatccaacaataaatgtgctttttaaagctaaataaatctaatttaacacacttaagcaaagcagctgagaagaaaaaggtaggaaaaaaaaaaaccccggcgtcttctccagttctgctccacttgtccgtagtctctccactacagtccacacacaacgccgaaccctgcagtgcctacctacccgcacgaatctcaaagcaccatccgacgcctcccccagcttctccctccccctccccctcccccatcgagaagaagaggagaaaaagaagaggagagagaaagagaagagactagtagtagaggagagagaaactaaacccaacccaaatagggggaggaggaggaggaggcgcaaccaaacccaaccccgccgcctccgccgccgccgccgaggaggatctccgtcgaaggcccaccggagctcagcttgcggggaactcttctagcggctggagtctg

SEQ ID NO: 1926 - DNA, 1501 bp, Oryza sativa
tggatgagttttcagtcaagtttatgttatacccgattcacctctacatcctttaatatccatcttttaattaaaaagggtgttgtttttacaggaatggaacaattccattcaacggcatgcttcccgagctttcaaatggtgcactttataaagaattctcaatacattagtttcttataatactatcttgaatttattttcagcatcataacaattaattcatttgtttataccatatgataatatcacaaatcattaaactaatattcaatattccattccatttagtaaaagtacatatgcttcaattcccttttttaaagttgtctaaacacaagtactcccttcgtcccatcttaattgatgaaaagtgaaactcaaaatgaaacgaggatgagtcacatcattctataaatattaaccgttggattcattacaagacgaaagaggataaatgaatcttggctgttgaatttgatggatgtgaaaataataattcaagaggtttccggagatgaaactactagaagacaaaagaaagcaaggaagggggaaagctaaagaataaatataaggttatgcatataatttacgatttgcatctattgagtaaactactttacaaataaaccctcatcataaccaaagattcaccggtcaagattgagcaatttagggcaaatacaaaatgcaggttcatttgattaattttatttctaacagttaattttaatatatttgagaaaaaaatgcaataaggacatgcagagtcatggtcgcccgaatataggtttaataattttcacatgaatttgaaatgaaatcaaactcattccttaaaaacctaaaaacaatatttgtgcataggctataaagagcacgcaccaataaaaaatatgaggtcatgcaaccatgaagacctataagacaaaacttataaaatttgtgataaatattaagctatttattgttattatcataatattaattagcatgaccaatgttttttttacaagcaacgagaaacccataaaaaaggattgtcactctcacatatcacataccatataatagaaggtatagagtcacgcgaatacgcgacatcagatgcgggttttaagtgtagttgtgggtttttgcgtccaacgtttcaccgtccgtcttatttgaaacttttttataattagtatttttattgttattagatgataaaacatgaatattaatttatgcatgatttttattttttcataaatttttcaaataagacgaactgtcaaacgttagatacagaaactcacaactgcatttaaaataggacagagaaagtattattactaatacatactccatccgtaaaaaaaaaacagctttctgactacatgtatctggacatatggagtacgttatatccaaatatatatagccagaagtgtttttagagacggagggagtataaagtgtatagctgtcttccttggaaaaggaagagaatcaa

SEQ ID NO: 1927 - DNA, 1501 bp, Oryza sativa
gggatcaatttgaaatttcacggtaggggcatggaagggatcaaattgaaatttcaggggtatagaagggatcgggtaaattttaagggtaggggcatgggagggatcaaattgaaatttcaggggtatagaagggatcgggtaaattttaggggtatgaaagggattgagtgagttttcaggggtacacagggaatttactcttttagatgagaatgatactcccttcgttttttaatagatgacgccgttaattttttttctcacatgtttgaccattcgtcttattcaaaaattttatgcaaatgtataagatataaatcacactttgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaagatgttgtgtgaagaagggcaaacatgcacgttgctaagctgacacgcggtggacaagaatgaccgatttgtgaccggtctgacactgctcaggtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaa

SEQ ID NO: 1928 - DNA, 1501 bp, Oryza sativa
agatgtatctactgtcactcttgtttctgacgctatgaacacaaatcagaaattcagaattcagaggaggcgatgcatatgcaggtatactgactgacccagtggggagcttgtcgacgtaggagagcagcatcttgaccctgctcccaccctccttctccaggccggcgcccatctcgccggccatcgccgccgccacatcccgcagcagcgacgccggcgtcgcgcacctctcccgcagctccgccaccaccttctccgcctccaccgccgccatgatcccggtccccgacaggcgaatcgaaaagctaaagaaaagcttcagagcaagaaaggcgagacctttggagttcggttcagacaaacccaaccacgatcaaaagacgctccggaaatgcgcgcagaatcgcattcacggggctcgatcgatcgatctatagaaaaataatctgggattggagggaggcacgtgaaagttttgtgtttttgtctaaagcactcaactttttttcatcagtagtttagttgatccctttcagtggcggttttgatccatctaccgatcgatacggcggcagcggaaagggataagcgtcgtgctcttcttgttctgttccttagcttttcggtaactgcacactgcgtagcaacagggggaggaaacattgtccatggtcggatcggatggatatctatccaagaacagaagagaatccagcaaccaaattggatcgtggattggattggattggatggatttactcgcgtcacattggcatggaggtgaatggagaagttggccggagtcggggtcgccggtcgccaccgccgtcgccttcgccgtgcgttgggcttttcgcggtgcgggccttagatgggccgtcgacgaggggggctcacggcccacgttgatggctgggccgatccagcggcggcgctggcacctaggtcgccgcgccgccggccaccgcggattttacctgcagtttccctttctcgtagaccgtgtggcggcgagcgagaaaaccgtgcaaactttttattaccgcgatcaattcacctctccatctcgtataggaattgaattgaaattttgctgttttggttaaaaatcgaggggcgttgtgtcgtaggttcaaatttccatgatgcctctgattccatccgcccttctttgtttctcgtttcaaaaaaacccattgattcccccacatcatacttgcatcgcaacgtgacacccgaaaaacgccaactaatcccaaagaatttttttaaaaaaatattcgtgtgacagtccacaccatgcgtgccgtgccccccaaagatccagccagcaaatgtgcacctgccggttgccgccgtacacatttatttacagcttctgcgtctcagaaatatcacaagttttcacttggatatttccaaaaaaacctggccggtcaatggcagctgttaaatttcgtgccaatccgtttcgtttcatcacggtctgctgttaaaa

SEQ ID NO: 1929 - DNA, 1501 bp, Oryza sativa
ttgtccgtgtttcattggttctcgtcgattataccgagaaataatatacctgaataaccggtgtaccactcccagcaataatccatcggcgagatcttcctaaacccttttcggtgtgtttggataatgggaaatggagggttggattgtgattggaaaatgaatgaagggttaggattaaatgaaagaggagaatgaatggttaggatttaaagatgtcttttggtgaatgggaaatgatttccccaacccattagccaaacgctgccttcggagttttctcaccggagtatgactttctcatcggctacttgctttacttttttttttttttggccttttaacagttttgacatgtgctgttgcagtgttggtagtacctgcctatctggaaggaatgtgcgttaattctacaagaggggggaccaatcgtttttgccaatattctgtgcaatcaacaaactgacgacactgactgtgattaaaagagcttaaccagttaaagagcccagctgtaactaaaatagcttgatcaattacagctcattaactttctaggaaacacaatactcctaaaattgttttcagatttatgcatgcagtgatacaatgaacctcgactccttgagattgcagggggaaaaaaaggaaatattatcatcatcttgagataagtataatgtggtaggagaatcaattatcaaagaaaaggagatggtgtatagtaataaccacaagctgagcagcctgagcttatcttatctgatcctctcaccctctatgtccaacaccggcattcctgtcactttaacacatgcctcttctactaatcaaacatgacccaccggccactacagctttgcattattggctgtgtttatatctaaagtttggatccaaacttcagtccttttctattacattaacctgtcatacacacaacttttcagtcacatcatctccaatttcaactaaaatccaaacttcgcgctcaactagacacagccattgtagacattgccactgtctctccctgtgtctcttgggataagccaccaatcacctttgctctgtgtttctgatgctgtacagtgcaaatccaccaaagattcaccaggtttctagttagggctgtgtttagttcagcgcaaagtttggattttagttgaaatttgagatgatgtgactgaaaaattgtgtgtgtatgacaggttgatatgatggaaaaggactgaagtttggatccaaactttggatctaaacacagcctaggcagcgataaaattgagcaaacatttttgtctaccaactccctcgtttttgtctagtaacaactcctacactagaatgcttattagtttttctaagttcagattaagggttcgtttgtttgagcatttttatctaacatttttcttttttaatgatcgtgtttcttgaactgctaaatttgttataaataaataaacttattttttaaatttatactagtgattaaaat

SEQ ID NO: 1930 - DNA, 1501 bp, Oryza sativa
tgaggctatgactatgggacagtttcaagttgttctgaacattctcgttcaaaaaaacttatttcatatatttttttgcgtaaaaaaatgatgatccatttgcaattttcctgaattcaactagtgttaatctggcagacccaaagattatttgttccctcttaattgcgagtgaaaattttaaatatcttatgcctcaaagttccattacaagaaatacgacttaccgacttaccgtaagtttcacttattacgctcagtgttccctttctcctcgggcctttaaagtttctgaaaggaagaaaaaaagttacatataagataatttaagagagaagaagaaaactactagttgaacaaaacaaaaaattgaattaggaaaatgatgtcgacgggatatagccggcaatggtattgtcgagtatggagattaattctatcaaggtatacgcgagatagtaataaatagacgtggaatatggatttttatattggtgattggcttatcaagatgactaataaaccctattatacatttatatgcactctcttcgtccctaaaaaataaacctagtaacacatacccccaactaaaaaccaagataatattacaagtcagccatacaaagagatataaaacgtagaagatataaagatgccatttatccataatcagataatatatcgcagaatatcattgtatcaactatacaatcgtagagtacatacatatactaaaccaaaatcatttttacttatatatgaatctcactactctatttgtgcatcaccaagtaaaatggtgctgggctcgacttttcatgggagcgaattttccaggatttaacggtattgtgctttcaagggtaggacgagacgcccgtggtgactttgtcaatcttcaggatttaccggctcagtcttcaaagatgctcatagatgcagggtttacgtgtgtgttcataggggttagtgtgcgagcatgtgctgtgtaattttttaaaaaagtaaaatagtgcgataactttaccttttcatagattattcggttattaaaaaatacatagattattcgtgcgtgagagccgcaagtttaggttaagttaaacccacagccgacttatgcaaaaccttataatggacgcaaatacaacgtactggatccagcgagcgtcgccgactgcgacatgcgaccgggtggcccggtccggcgaggcgtgcggaaacatcaccgcaccacaccgcgcacaacccaccacatatacccctcccccccgcgtgtaaaataaaataaaccgtaaaacactccgacccgacggcctcgtccacgtcacgtgtgccgcgccaccctccgcaacgcaacccccttccttttttataccggcctcctccctcccattacccccctcacgcgctcgcttcctcttccccccagccatcggcgacgcgaggacgcgacgcgccccaccaaccaccaccgcctccgccgacctcgccgcca

SEQ ID NO: 1931 - DNA, 1501 bp, Oryza sativa
atgcttatatttgtaagctaaaatttaaatttaaatttttaatttgatatgattttatgatttttcatcgtatttttattttatggcgtttgcttttaaattgctatagacacatgtataaatttttacttataatatatactatttggttgttaataaactatgcggataagcataaccaaaaagacaatgcactattccgcacaaccgcatcaagtacttgctaggccttgcatgattgagttggtcgcagctgcagcgcaacacaaatgcaacagcgataaccatcagcaaaaactctcttgtgtttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattgacgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatatttataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcgggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataaataccctccggaactcactcttgctggtcaccaacacgaagcaaaaggacaccagaaacatagtacacttgagctcactccaaactcaaacactcacaccaatggctctccaag

SEQ ID NO: 1932 - DNA, 1501 bp, Oryza sativa
  unsure (1)..(1501): unsure at all n locations
ctccctccttcggcacccccgcgcaccgccaggtccgccgcctctcctccttcctcgcgccccacctccgccgcaccgacgcgtcgtgcaacttcgtcgccgccgccaccgtgctaggggaagaagaagaggagagaaagagagagaaagggagagagggaagaggaagaaggaaggagacagggtgtgcccacatttctttttacgtgaatgactaatgggtccaacgcatattttttaattctattgtcacgtaagtgccacnnnnnnnnnnnnnnnnnnnnnnnnnnnnnnnntatcgccacgtagacgctacgtcagtaaaaccgtcctccaaaaccattgaaggagttaaattgtaccgattttaacagtttagaagtcaaaatatctggttttgcggttaagtgttataaattagactcggaccacttttaaggaagtcaaagtgaacttattcctcttgaaattagatgcacatttggtttcttgtctctttgaaatatgcgattctgttccattttcatccgtatatttttcctatttcttctagggcaacgacgtgtggctctcgtgtatggcctcacaatcggacgatgaaagtttgcaatgaccgaaaaaaaaaagaaggttaattagatccatgcagtttttagtttttttttttgacgaaaatgctactgtcttctaactccatcaagcaatggcagacccgcccctcggtgggaaccacatcctacccacacgtcgtgcgcggccatgacgtatttggtgcgcgaaagggaaaacaaaggcgaggcgaagataaaccactctcgattttgctatccatctctcaaatggatagacagtcccagctactcttcagtgcaacccgatacggatacgggtgaccccaagtggccaagtgccaacgcaattgctgggcctggctgggaggttgggagagtccgagtcggtcaggagaggaataagttcactttgggtccctctatttttcgcccattccgattttcatcacttcattgcaaaacaggtccccaacttacaaaaccgtttaaataagatccatcggccgtattgtgtccggttttaacgcctacgtggcttcttttgactaagtctttgcctaacgtgtcattaacatagcgcttacatggcaattagatctgaaaaaaaaacatgtgggacccacatgtcagttgcacacacaaataataaaaatttcaatcgtcagctaatgaggtttctcgttttatgtgcgctaaaaattttacctagattagagtcgcaccccgagaaatttcaatcgtgcaatcttactctatcgtgatatataataacatacgactggatttgagaaatgcgaacctgaatatatatgtttagatttgtaggcctatgatacgtcaaatttggtcttgggttggtatatatttggatagagagggtaggatccaaacacgaaccgcctagacccatgaggccatgactccgcaca

SEQ ID NO: 1933 - DNA, 1501 bp, Oryza sativa
attatcttggtttttagttgggggtatgtgttactaggtttattttttagggacgaagagagtgcatataaatgtataatagggtttattagtcatcttgataagccaatcaccaatataaaaatccatattccacgtctatttattactatctcgcgtataccttgatagaattaatctccatactcgacaataccattgccggctatatcccgtcgacatcattttcctaattcaattttttgttttgttcaactagtagttttcttcttctctcttaaattatcttatatgtaactttttttcttcctttcagaaactttaaaggcccgaggagaaagggaacactgagcgtaataagtgaaacttacggtaagtcggtaagtcgtatttcttgtaatggaactttgaggcataagatatttaaaattttcactcgcaattaagagggaacaaataatctttgggtctgccagattaacactagttgaattcaggaaaattgcaaatggatcatcatttttttacgcaaaaaaatatatgaaataagtttttttgaacgagaatgttcagaacaacttgaaactgtcccatagtcatagcctcacaggtctgcactgccggcatagagtacatcgaacacatcagatttatttgcttgtcacttgtccttgtcatatggctcgctaatcacctgtaggcacagcacatgcctatcaataattatgagctggttggttagaatggagcaaacccaagattgtggctccaaatcaccgtgtaattaagctttggaatgttagttgaaccgtggaccatatggccatcagcgtgtgtggttgtgtggactttgggcgtcaagccagtacacgtcgaagatcgaatcgtcgtgtgtcaattcaagccacctttggttgagcactggtaatatgtggtcctgatcactactgattccatcacacagctatatatgattccatcccacagatttgggggagggggggggggcataaaaaaagaaggcacttgccttttcctatgtgaaggtcggagtaggcatgacgatgggttgtttggttagtagctaactttgccaaaccacaagacatgtaggatcatatgactaaaaagtgtggcgagccacagttgtgataatgaaccaaacgattgtctaaaaagttatggcataactatccttagacatggcaaattgaagatagcaaccaaacagtcccgtagtatgtcttatagcggacgagaggttttcaaacttccatccggcttctactagtagtagaaaataatttgaaccattgatctcatttgatcgaaggattcggatctatttataatatcaccctactagttatccgtagaaacaaggagtggcgttattatataaaaaaaggtacataggggtataatcgttatttggcagggactattttttttattcgatgaaatataagtaatgccaacgcaatggataaccacatatcga

SEQ ID NO: 1934 - DNA, 1501 bp, Oryza sativa
tcaacccttcctggatgttctacattggcgacgatcatccctgctaccaagtagtccacccagatcatgtagcgatcgtggcacgacaacaccgcatcagtcgtccagcagcacaggtgagcgagggcgtcgccatggcggatcggcacattcctgaagactctccagtcgtcagagccagaagcgaagaggtagacgttggtttcggaagattggcatgatcttctctcgagctcagccacaacgaacgacgaagaattcttgctgccgcaggacaaaatacatgtgccttccctgctcatgatgcgcgggcggatggtgtctcccctcctccagtaggaaacgggcagccgcgtcaaggaggggtggtggttgctgctgctgctgcggctggcattgtagacgaagtagtcgatggcggaagggcgagcgtgcttgtcgggggagacgatctggaacaggacgacgttgccgtgcgcggcgatgacgtatgggtaggatgtggttcccagcgacgggcggggcccctgcggccagtcgagggtgaggagggaggtctccggcggcttcacgagctcgaaggagacggagatctggtcgccgccggaggtgtaggagaccgccgacgtggtgcggtcgcggtcgtcgcggcggaaggaatccctccgggcgccgtaccgattcaggatcgcccaggtcgaggtcggattggaggcgccggcggcgtcgtccaacgatagggttgaggaggatcgcttcagcggccgcccgggaatctccgtctccttggtcggcgttggtccgcgacgggatgcgtcggccctggcccgcgaaccgtcggacgatcccttgcgccgcctgtggctgggaatccgtgtccccgtccccgtctccgtctccgtggtggggatccgcatggcggcggcggcggcgagggttctgtgtttggttcgcgaaagagaaattaaacaaaggcgagacgaacataaacttggctcgttggaggagtatttgggttggggaaagtcgggttaaataactcttcagtgcaacccgattcggatacccgagtcggggagggagaagcgcgataggcaggactcatccaagtcgttagatcgaaacatccaacggtcaaaaaaaatccaagagctcattgctcggactcggatatgctgtgttcgggaggtaactctccagctcccgcgcacgcagaacggaacgactcgtattttgttataattcattaagtactattaattttattaaaaaatagattaatataattttttaaagcagcttttgtttaaaaatcttttgtgaaaaacacatcatttagcaatttaaaaagtgtgcgcgcgtaaaacgaggaatgtgacttattctatgctgtgcggagtcatggcctcatgggtctaggcggttcgtgtttggatcctaccctctctatccaaatatataccaacccaagaccaaatttgacgtatcataggcctacaaa

SEQ ID NO: 1935 - DNA, 1501 bp, Oryza sativa
  unsure (1)..(1501): unsure at all n locations
cgatannnnnnnnnnnnnnnnnnnnnnnnnnnnnnnngtggcacttacgtgacaatagaattaaaaaatatgcgttggacccattagtcattcacgtaaaaagaaatgtgggcacaccctgtctccttccttcttcctcttccctctctccctttctctctctttctctcctcttcttcttcccctagcacggtggcggcggcgacgaagttgcacgacgcgtcggtgcggcggaggtggggcgcgaggaaggaggagaggcggcggacctggcggtgcgcgggggtgccgaaggagggagggcaatgcggtgagaattggagggggcggcgccgaacggcgggtgggggagggggttgaagggcgacaaggtcacagtcggagtggaggagggggtgtaggtgctggttgttgcgtcggcggcggcgacatggaggtgctcttcgagctcgtcgcggttggaggagcggagctcaatgctggctcgacgacgacggctccaccgacagcgtctgcggtcgtgcggaggtcgacgacggctccaccgccagcggcaggttctggagggtgaagaaggtactcaacctggggttagagcagcggctacgcgattccatcgccatcgtccacgacttcgtgaacgcatcatctggtagcggcaggagcagatccgccgctggtgccaacctacctccctcgtttcccccaaccccaagtatctccgccgccagcgccattctccactgacgccgtagctctatggccctctccgatggcggtgactgcctcgccccagcttgacggcctgcctcctcctatggctccggcgctgccattggtgccgacccacccaacttctaccatgctcgagttgaggccgtgacggaggaggagcaagagtggacgcctcggcctcgacctccctaggtcccgctggccgacgcccctctaccgccacccagctgacgcgacgccgccgctcccctcgttgtcccatcgtcgctgctgtgtagaagaggatacgtgccagcctgccaggggaggagaggagggggtgaagggaaagaggaagaagagagtgataaggggaagagggagatgacatgtgggccccacatgttaagtcagaccgggtcaaagcgccacgcaagcgaaaccactatccaaaacagagttaaattgtaccggttttaatagttgggggagttaagatatcgagaatacgaattagattggagctatatttaagggagtcaaagtggacttattccatttcatgaagctgggtgtgtgcacgaacacgtccatcaagcatttgagctgctaagcggcgaagatagctgtagcaggtggccgcttggctggtcggcacgaccgcgaccgttgggctgccaccacatggcgccccagttaagcttaggagtaagtctatcttcctctctcatttcttccccatggtcgaatccgatctttcaatcgtaaaaccgggtttaatatctcc

SEQ ID NO: 1936 - DNA, 1501 bp, Oryza sativa
aagaataaattagtatgtatatatagtatctttttctgattatatttacgatattccctatgtttcaaaatataagtatgtttaagatttaaaatttatatcataatatagcattttctgggacattgatttcaatatatgcatggaatttatgcattttcagccagtgagatgcttggaaagggaacataagctattcagaattcaaaattttaccactaaaatgactaaaagaaactatcttctgttaaacttaggcttcgttcgaaggtgtgtttggttgcagagttttcttcgcacacaaaacaaggtgagtgattaggatatgattaattaagtatcaattattacaaacttacaaattaacttatttatattttttaaaaaactttcatatagaaagttttaaaaaattgcaccgcttagcaatttgggaaacatgctcactataaatgaagaattaagtagctagctctatctgtagagattagaacactttgtttgctaagaatctaaaaatgcatatatcccttcattcctttttaactaagcaatgccaaataaaaaagaaatggagagagttttgggatgaaggggctaaaacgtacaatattaattaaagtgtttaagaaacagagactagccaaagcttaaaaattttgtactccaatttaaaaccaaagggagtaccgttttaattgtgatcaagctagctacctacccctccataaaaaaaatctaatcttatttatgaatctaacgtattatctagattcgtaggtaggattttttttaagacagagtaatgcaccattcattaaaaaaaataacattttaggaataagtttagataaataatttttcagactcattttcagaagttagttttttttacaaagaaagtactctctctatatttataaaggaagtcgtttaagataatgtttaagtcaaattttaggaatataaatcatgaatatctcttaaattattgagtttaaaaatataaaaaatatatgaatagatttatcttaaaaaaatacttttataaaagtatatatatcactttacaataaatatttttatagaaataaaaagttaaagttgtgtttacgagtacgggccgtaggcagttttactgtggttaattaagcgtcgtactttgtcgtaggcggcggcgggaggcgccacgtgtccgcctcctccgcttcactcgccggtgaaacgctcgcccccgtcgcttcctgtccatctcgtggccacagctaagccgccaattcccaaaatacccccgccccccaccaccgcagcccatgtccttttccgtcatttcacttcaactcgccgctctttttaagtggccaaaaatatcatcttccccggaaaagaacaagaagacagatagagaaggagaaaacccaccgcgcgcggcggcggcggcggcgagggtcgacgaggcgacgcattttggtgatctcgtggtgtcacggtgcgtgtgcga

SEQ ID NO: 1937 - DNA, 1501 bp, Oryza sativa
tttatttgtaagatttgtagaggcttgcagcgccgttaacgagttagctcatcttgtatgaagatttatgtatgagaagaaacttacagaatgacgttctcgtccatctaagaccactcgatgtaaggttgacctacaggtatgcagacagccgtattataataaagaacagtaacagttagtaaaaaaaacaatgacaccaagatggttctcctaaagaaaaacaatgactccaaagaacatgctttaagggatggtttggccaacctgaaaatacagttactccaccgttcgagcatatcgccaagattgacaataaaacctctggaaaatagagggaaaacatgtaaggatcttcactaacagttggcataggccgtagaataccttatgattgatacatcccaattttatactgccaacacagaaatcagaatttggcataaatattgctaagtgattagattagcaagctcacccttttacaggagctacatattcccatacttgaggctgagcattcctgtccttgcatatctgcataattcagatggaaaactaccattttattagaagtcacgaaaatcaatgaaacatttgataaggtgtcgattcaagatgcatttacttggagaccaactacatcatcggttgccagtagagtgattaggccataatcagaatgggcacctgctccaaaaactccctctgcaggatttgatactttacctgatgaaaaaaggaacatcaaacgacagaattcgttatgtttcttgtgtaataaaatactgaacggcaagaatgcatgacctgttttttgtccaccttcataatgcaggagccttaatgtggctatgggctcgccaagcatttctggtttatcaaagaagtcctcttctaggtttagagcaagggcaataatccttgcaattgattttgccaccctcctgaattcattagaatgcaaatcaaatcattacagtaataaatcatacaaaaagagcatcaccaaaacttgctgcaaagtcaggtttagagaacggctagttgataagtgtttaaacctaattgatcatcactgatcacttgacaatattaattgttgaactgatccatatatagcaaagtgtaatttgattgtgtgttcagcatgtccaaaacttacagggcctcgctatgatactgttccatcaccttcctccatcttggcaatacttctgaaataatgcaagggaaaattttgcaaaataagtaaataaaaccatgcaattccgaggaactttccttcctatcaagtaccaaagtataagaattgtagatcaaagggttagtacttctaatggatgctaagcttattcggtggatttactgccacaccaacatactcacttcatcccaaaatataaggtattttggttggatgagagatatcttggtactacgaatttggatataagatgtgtcccatccaatcaaaataccttatattttgtaacgaagt

SEQ ID NO: 1938 - DNA, 340 bp, Oryza sativa
gaggatccccaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcag

SEQ ID NO: 1939 - DNA, 1501 bp, Oryza sativa
cgccgcgtgaggcccgcccccaccggtgtggatggcggtcgagcctctgtactccgggccagtccttcgcctccgtcgcggccgggtcgctgtggccgggtccctatcggcagtcgaatggcggtcctcattggtggttgaatggtggacgcacctccgcgctcctggccgttcttctgcctctgccgctgcctcgtgagccccacggcgccaccaccgctcgtgctgctatcgctatcatcacaacgctagaagatgggaagaacgaaggaagaagacggggaaagaaggagatggatggaaaatgtgatgacgatggcatggttctagttttgtaaaatttgagtggcacgcttatgaatagacgaattgtaatagtatttttttaataaccatatttacattggcatggattgaattaacccaaatacttcttgttgcattgtgtagaatgtttttgtaagccctccatccaataataataacaatttactattagatgtgacatatcattttattaggttatgtcttatccaatactagttttttttacggagagagtatttgcttagtgcatttctaaaagtatttaatttatctctataatcaaatatataaccatgacaataatctcacgaataatctgtatcacttgttgaatgatttcgaagcatttctgttgctgggagtattttgaaggagaacattaccaccatcttttttagtgcaagggatggaagacataataatttggaaatggaatatttggttagatcacactacaaaattcaattgcacgacaattgaggactataacacataaatagcttggaaaactgctgcagaaggtaaatgctaaatttgcatggtttcattgcagggatgttcacatggttaattatgccctttaggcggccaggagaatgaaatgtcaaattacaacgattttaaggaagcttagccatgtggctgtaactttttttagatgcatttgcgatttgacagtaataacttagtaaggacataattgaaagaagtatataactttttttatgtcattctgaatttctggtttatacacattcgaacttagagaaggaacataatagttgaagttttgataatttttatcacggtttgtagcaggtaattgggaaaattgataagggtaaacatgagaggaagccagcatgcatagttgaactattgtagaactttttggtttaccaatctatgctatcctcgatgtacccttgtacgtgctcttgtttgaacatacacaaactttctctctctctctctctctctcaaactagaaaaggtaaggaaagcaatattccaattattaagatcattaaaaatcaccacacagaaaagaaaagtaagggtctgctgggaaggcgacgaaatccctagatgcccccaattcagtgtctgctgggacattgattccaaattgaaaaataaggctctgtttagttcacggctgtcacatcgaata

SEQ ID NO: 1940 - DNA, 1501 bp, Oryza sativa
ttgtatttctgtatggactctatactctacttctaatattccttatttttaattccgaatttctattatttcataattgtatttctatatggactctatactctacttctaatattccttactttttaattccgaatttcagttatttataaattgtatttctatatggactttgtttttctttttctccgattaatatgagaatttctatgccgtgagagcgaacgtggaggctcctttttctattcctttaataagttaactagcatggtggcccgcgcagattgcgcggctagcatcattatattttctctcatataatagcatatatgttttctcattatattattcaaatatattaaaatgacaacataattttaaattttgcaataactttacgaaactactgatgtgtaatattcatattttattttatatatgttttagttattaattatttttaatatcaaattttagttatttgtaaattatatatattttcggtctgctagttgacgaagcggattgcatgaaaagatttatgtttgttaatctgctgatgaagtggattgtagtaaaaagattactgatgtgctaatttgcggcgagaaaatcatgcgattacttttgttatttatgtttttctaggacatgtatttattgagatgacatgtattgtgtacaattaaaaaagggataagtcaattaccgtgatatgggcatgcagaaattctctcatacggattccaaagaatcattatctgtttacacactatcattataatatcctttgtttttttttctatttgttctgtatagttattaattattcttaatattttttaaattctgaattttcgttatatgtaaattgtatttctatgtagactctaggctcttcttccaatatttttttatttttaattctgaatttttgttatttctaattgcatttctatgtggactctaaactcatctttcaatattctttaatttttaatttcgaatttcagttacttctaaattatatccctatattgactttagaatcttcttcccatgtttttttttaattttgaattttagttatttgtaaattgtatttttatatggactctaaactctacttttaattttattatgtttattccgaattttagttagttttaaattcctatatggactctatactctacttctaatatttattatttttaattccgaatttatattatttcctaattgtatttctgtatggactctatactctacttctaatattccttatttttaattccgaatttctattatttcataattgtatttctatatggactctatactctacttctaatattccttactttttaattccgaatttcagttatttataaattgtatttctatatggactttgtttttctttttctccgattaatatgagaatttctatgccgtgagagcgaacgtggaggctcctttttctattcctttaataagt

SEQ ID NO: 1941 - DNA, 1501 bp, Oryza sativa
atatatgtttacataatatcctaattagcccctaaatcaataagattagctatatatataatgtccttttcgccttcctccggacgcactagacaagttcatgcaccaacatgagcattttataagttcatgcactagattgcacccacctgacaaattcgtgtaccgccaatgcaattcactctttcgtaaaactacagatactttgcacgatttatcacaaaactacagattaagaacttgtttcacaaaaatacagattcaatgtcttcgtttatcacaaaactacatgtactttacacaatatattataaaactacatatttaagaacttgctttacaaaactacagatttaatatcttcatttatcacaaaactacaggtttagtgtctccattatcacaaaactataggttttaaaacactaaatttgtagttttgtgataaataaagacactaaatgtgtagttctgtgataaacgaatacactaaatctatagttttatgaaacaaattcttaaatctgtagttttgtgatctattgtacaaagtacttgtagttttgtgataaacggagacactaaatctttagttttgtgaaacaagctcttaaatatttagttttatgataaactagcatggtggctcgcgcagattacgtggctagcattattatattttctctcatataatagcatatatgttttcttaatgtattattcaaatatattaaaatgacaacataattttaaattttgtactaactttacgaaactactaatgtgtaatattcatattgtattttatatacgtgatagttattaattattcttaatattttttaaattctgaattttcgttatctgtaaattgtatttctatgtagactctaggctcttcttccaatatttttttatttttaattctgaatttttgttatttctaattgcatttctatgtggactctaaactcatctttcaatattctttaatttttaatttcgaatttcagttacttctaaattatatccctatattgactttagaatcttcttcccatgtttttttttaattttgaattttagttatttgtaaattgtatttttatatggactctaaactctacttttaattttattatgtttattccgaattttagttagttttaaattcctatatggactctatactctacttctaatatttattatttttaattccgaatttatattatttcctaattgtatttctgtatggactctatactctacttctaatattccttatttttaattccgaatttctattatttcataattgtatttctatatggactctatactctacttctaatattccttactttttaattccgaatttcagttatttataaattgtatttctatatggactttgtttttctttttctccgattaatatgagaatttctatgccgtgagagcgaacgtggaggctcctttttctattcctttaataagt

SEQ ID NO: 1942 - DNA, 1501 bp, Oryza sativa
gcccgcacaccgcacccaccaaaccctagcaacacacccgcgtgcgctctccccaccgtgaaccttgccgccgacatgtgggccccacccgggaccccgcgaggtgcacccggtccaccggaccgctccctcccccttccgcgcgccctaatgggccgcctttcccgcgaccgcgccggcccaaatggcttggccgagcctccttcgacccttgggccgcgtccttgccgcccgaaaaagtctaatatacatccctccatccttttctttttcagtgatttaataaatcctttttcctttgtcccataaatcaattccttgttccaaaattccataaaccatttcctttggtcccacatgacagtgactgtcaataatattcttgggaatattatttctacaaatcccataaaccatttctcgtattctagaaaattccgataaatcatttccttgaccagaaaatccaaatcaaacttccaaaattcatatcttcccaaccgctcttccgattgactccgttccacttccagtaattccgtaaaattgagatctatttaatggcactattaattaggctaaataggatctttcttttgggtcttgtgtaggttttcaattgtttgcgtatagctgcggttatcggattttcgtcgatcgcgggttttctcgaagattcgtgaagcttcgtgaagaccttgagcaaggcaagtcaccctttgaccaattgctcctataattggaaaatcattattattttgttggtaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcaaaaacttgggaaatgggtttgtgaagccttcgaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtagctagtcggttcagggaaacctcgcatgccaatagttgggaacgccggggcggggtcggttggagccaaaccgggttcctggtaaggcaagaacgcgaagcttgccagattaccgatcgaggtggttggagtttgatttgtgtatgcctaaaatggcctatatttatgtgaggatttgatccttctatgtggcatgaggtatccctgggtcggcttgggaaaggctttgtcgcgaacctctgacaccggccagtgtctagagtaagttcgtgtcttgtgggtaaagtgtacccctctgcagaggttaacaaactgttcgaacag

SEQ ID NO: 1943 - DNA, 1501 bp, Oryza sativa
cacacctaatccaaatcgaacacgggtgagaggggaaacaagaaagcaaggctcaaaagggctagagagagagagcaagccaagggcacaaatgattgaaatggaaccagcagccctcacaagtgaggggagggggatatttatagccacagcccaaattctgcccgttatgcacaataattgagattttcggatattccgaaagattttcggacatgttcgaaaattccagctcagcaccgacagcaaagtcaacgaagtatttttcggacattccgaaaacttttcggacaagtccgaaaacaacaacatcgttctggatgttctcggaaaagtccgaaaatcactttcggacaagttcgaaaatatacagaagcgaaattgactctactgatgattttcagaaaatccaaaaatcagtttcggacaagtccgaaaatatacagaaccacttttgccttcgcagtcattttcggaaagtccgaaaatcacttttggacatatccgaaaatttccagaagcgaaaatttggttctgtgtgttttcggaaagtccgaaaatgagttttggaaaactccgaaaaaatccagaacacaccaaactgaggagaaacacttttaaaaatagattttgagcactttgatcactcctcatatgtcaatgcatcatccctcttaatagtgcgactttcctattgactcaaatgaaaagaaaagttacaatatactatttgtcctttgccacatcacatctcatcaacgtatttggcgggatatgcattatgctaattcattgaggacataacaaccctcacatttgcttaaataaaaatgttagttctctctaatcacattgtaattaatcatcaaaattattaggggcctagatgcactttcagttaacatttttcgtacttgggagacttggttggtcctgctaaaatgggggaaagctagaaggcgcgtgcacgcctctagtgcacacttccggcgtaactaactccgttagttaacgctaatgacagtaattagaaaagattgtgaagatttttttcaggagatttttttactaacagattgaaaaatttttaagttagatttgataactttcgacttaagatttaaattttagagtcaaatttttaaaactttcaactcagatttgaaaactttcaactcgaaatttgaaaactttcaactcagattcaaaaactttcaagtctagatttgaaaattttgaaaactttcaacttgagatttgaaaattttcaactcgagattcgaaaactttcaagtccaaatttgaaaattttgaaaactttcaacttgagattttaaaatttttaacttgatatttgaaaactttcaactcgagattcgaaaactttcaagtctagatttgaaaactttcaacttgagatttgaaaatttttaactcgagattaaaaactttcaactcgagattcgaaaactttcaagtccaaatttgaaaattttaagtt

SEQ ID NO: 1944 - DNA, 1501 bp, Oryza sativa
atagagggggggtgaatatagcaattcaaatcttgcccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagttcaaattgcaagtagaatttaaattgcggaatttaaatgaacaaggcaaaaacgaaatccttcaaatcatttcattcataggtgatgcaaaataaccgctcaactaggggcaaacatacaccttcagaggaacattaacacaaaattaaaatctctcggacaaacacactccaaactaatcctaatacaaaagcctctcgagcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccactccaagccaatcagcgtgcaccgatccgcgtcgtgctcctccaagccaacgcatccgcgccacgcgtcccagagagcgcgtgcctgctcctctcacgcctgcgcaccaccagtccgaagccgccacgtcgccgttcctcccaccgagccgcttctgcgcgcgctcgcgaaaaccatgttcccgcgcgcaccatgcgaaaaaccgcgtgggacccggtcgcttccttgacgaacagaaggccgccacgcctccaggtgccgtacgatctcccgcttccgcgcgcgcatgcacacacctgtgcatttgctgagccgagctgggccatcgtcatgtctagggcttgctcggcctagccttcaccatcttgagtcagcaacgtgcttaggccgggttggctcggccttcctgccaaccgaactgccagcccacaagcctagtggccagctcctgttggtctccttgccattcaatcatggcagcacacgtgcacatgatacatgctagctacagtaagccgaattactgtagcagcaatgcactcggtcttcatgtccttgcacagtcctcttctccttccaattttcttcgcgaatccgatgcttgcacacttgaccttgtgaagcccgttgcaaagacctcctcacacggtgtccgcccaccgtgtgcaaccttgtgtccaatcttgtcacccggcatccttgatcgttctggacctcaacttctccctgagtctagtcccgatccgccgttgactaagattgactctgatcacctgcacacacatgagccaaacaaccgttgtcttgg

SEQ ID NO: 1945 - DNA, 1501 bp, Oryza sativa
actagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccacttcaagccaatcagcgtgcaccgatccgcgtcgtgctcctccaagccaacgcatccgcgccacgcgtcccagagagcgcgtgcctgctcctctcacgcctgcgcgccaccagtccgaagccgtcatgtcacgccccgaactaatcccgaccggaactagcccgtgacgctccaaattaacctgttggtcgataccagtcctaggaaacagtgctggtatcacagggagacagaatatcacagcaacagcggtcactttattatagagtagagatacagtcatgttgggctacggacagatcccgagctcacaactgcattacaaaagggaaacggaagccaggactaggaccaaccaacacaggcgcgacttgggaactagaccgaaaccctaaaactcatcgtagccggcttgctcctgaaagaactcctcatcagcaggatccgcttcttcttcttcagcaactggggggggattatttatatagagcaagggtgagtacgggagtactcagcaagccaagggaaataagtgtttaatgtaggcttcaaggaaaggctgttgtttttgctgttgattttatttgaactcttttctaaaaacagctaagtgagtgtttctcaaacgacacggttgagacagtgcgtctcgtccggtcggagtatgtgcaatgtatcagtctttaaaattgaaaacaaggttggcacccggccaacagcttttcaaacggccacccgggccaacaactttcaaacggccacccgggcctagctgatcccatcagctgcagatttttcaaacagcgaacccctttctacaacaacaatttcacaagcagtagtcaaacaaaactacgctaggaatcacctcacatccgcccatgacggtgggcacggctgttcgaacagtttgttaacctctgcagatggggtacactttacccaca

SEQ ID NO: 1946 - DNA, 1501 bp, Oryza sativa
ctagcgagcggcacaccgacgaggctggtggagtagtggaggaccgtggcaccgggcgctcgtcctttcccggtgacggaaatcagatgacgatggcgttaggggcgggggggagaccaacgggaggtgctaagaggattgcggggaggccgaggggaggcgggaatcagtgtgggtgacggcggaggaaggtggtggtggcgacgggtgaccgtggaggttgaggaaggcgaggtcggcttccgggatactgccaccaacaagcgccgctacctctacctctgccgcctttccatcacgcacccaccattgctcgtccccctttgcgtgcgctcactagcggaccgtgacacccgcgggctcagcagcggtggccagtgcgcgaagaggcctggccggtgacgctcctccctccccaccccatcccctctcaccggcctccgccgattcggcattcgttgacaagttaagggaccttaagtgaacttattccgctcaatgcaggccaacatatctctaagattactcaccttatacatgggattttctgttcgatgggccataatcaatatttgttcggctagaaatatccccttggatgaaaagaggcccattacacacaagactttagattttcaggcattgggatccgtgacctggaatgctaatactatgatacgctagatgctatactctttctagtctaaaatataagtatttctaaattatttcacagagattaaaattgaggagaaaagattttggtgcctctcaacaaaaaagagagggttagagacttaggtgtgggaggatggttgggattaagatggggaaaaatattgaatggaaaataatttatgtgataaaatgtagtgtaaatagtggtacaaatgcttatattattgaacaaaactgaaatcctagatatacttatatattgaaactgatgaagttattaataaaatgcaaccaaactcacaaccatacattaatatattcaccaaaaaaaacccagtactctggcattcttatcatcaagaagaaaatctcaagtggtgcacgtgcaaccagacaggctagacgcagggtcgtaggcggcagtgcggcacaagatagtcaaccgagaaaaatcaatgaaggcggcatatcaaagcatatgccgggatacacgaacatagatgattgatcgaacaatgacaaattcaacttattttacgtgaaaatgtggcaacacatgtatatcaaaattgtactaccttcgtcccaaaatacttatcgttgtgagtttttgtttgtaacattttgatcattcgttttattaaaaaaagtatgaaattattatttattttgtttatgacttgctcaatagtactttttaagtaagacttatattttttatatttgcactagttttttaaataagatgaatagtattacaagtaaaaagttaaagcgacaactaatttggaagggaggtactattattttccttgtatcgcgc

SEQ ID NO: 1947 - DNA, 1501 bp, Oryza sativa
agccgaagtaggtctttccctacatcagcattttttttttttttttgcaaaacaaaaagggtacaatatgaattcagcatcacattggatttatcttggctcaagctcagtgatcgaaacctcatttggtgacataggcgatctatctgtggactatagttggccatgtgggccgcccggcacggcacggcccaggcccggccgtgcctgggccgagacttgtcgggccggcacggcccgaccgacgcaccgggccgtgccgtgccagcccacgtgccgcactcacggcccaggcacggcccaacacgcctcgggccgtgccgggccggcccgaaggcacgatgggccatcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccctgtactttatgtaccgggcctggcctaccggcccatcgtgccgggccggcccgaccgtgccgggccagcccagcgtgccggtggggaggcccaggcacggcccgacagtcgggccgggccagcacgggcccgacccaagtcgggccgtgccgtgcttgggccgggccaaaaaggcgtgccgtgggccgggccttcgggcctcgggccttatggccaactatactgtggactgattagctccacggaatggctccgagtacgaatctgagttgacactactcttttggatgcaaaatgccggcctagatggagcttgtaaagacacggtgctgctgctaagcatcacattcaccatcgacatcattggcctctccgtggggtcttcttgaacacacaggagtccgatgtggacgcacttcaagatctggtctccaggacaatgccccgccatggatgaatccgcaagctccacaactgttcctgccaaccagtgctcccacacctgcatattttgataggtaatgtaaatgctctgatattaatacaaaacattacttgggtgtagagtttgtaatatatagctgatctctcctgaggtactcactaaagttaagagatcaaccgattgctcggagtcgtaggagacattgtttttccttcccgtgacgatttctaaaatcagaacgccaaagctgaaaacatctgatttgatggagtaatgcccgcgcatagcgtactcaggggccatgtatccactgcagtgagaaattctgttatgtcaaggactaatgtgtactaccgaatatattagtagccaataatatcatcagaacttactatgttccgacaacacggttcgtgacgtcttgtgattgatcattcccaaatagccttgctaagccaaaatctgaaatcttaggattaaaatcggaatctaacagaacattacttgcttttaggtcccggtg

SEQ ID NO: 1948 - DNA, 1501 bp, Oryza sativa
atggttaaagaaatcaatttttacatagaaaatcgaaagaaagggagagagagaatgagaaaagaaagcgcatgaaagagagagcgagaaggaaggcgggagagagagagagagtgagaaatacgccgtaacagctagaaaatggccagaaaattcggaccagaccggcccacgtggctccccacgtggcctcatagcgctaaatccaccaccaatctagacgcacaatccgacggccagaaaaacgtcaaatttcagacgagaaatcacgcgacaaacgtttagcaaaattgatcattagcaaaattgatcatggaaacatctggtatatgactagtctaaaaggaaactcatagattcatgcgattaaagatgtgaacatcagaccagtccacaaaatgacaaagaaaatattttcttccaaattaagttgttcgtactaaaaaacaaatcatgaaagactaatctaacttcaaaaagaaagacgagttcgtaacctctacacagggccggccctagccctatgcagccgaagcgaccgccgggggcccatgatggtggggggccatgttagggggggggggcatctaattctagtagtaggggggggcatctaattctagtagtcgagtacctcatccgatgttgagatcaatgatttttattcagaattaaaggtgttgcaagtgagtttaccagattcttcgatgtctccgcgcctgagattttaaagtttgttatggatgcagattgctatacaaatgtttcagctgcctatcgaattcttttaactgtacctgtgactgtagtttcagctgaaagaagtttctcaaaaattgaagttgttgaagaactatttgagatcaactatgtcacaagaaaggttaaatggcttggctatgcgctcaatcgagaaggatatcttgaacactattgatcttaataccgttcttgatgattttgcatcaagaaatgcccaaagaagtatcttttcatgggaagcaatggatatgatggggttctattcttcattaagttaatgaataatgatattagttccaagttacaaatatattgttattttgatcgattttatttcttgataattaccatacatgttaaatttaatatatggatgtttttgtttttgttttgcaagtaaaattagcatatatatatatatatatcataaaattttatatataccttagagggtccatcgtgatgagtttgcctagggccctcaaaatcataggactggccctgcctctacaacaacttctatggctaggaatcagtcacgatggacaactcgaggtttacaaatgccattttcaccaaaaacaggtccctagaggttttttcaatagccacgacaatggaacggttatcgacaaaaacaggtagaatttggacaaattttgccaaaaaaataaattttttttctgtatttggacgattcagtttcttcatgtggaccgactcaaagccaataacagtg

SEQ ID NO: 1949 - DNA, 1501 bp, Oryza sativa
ccccgtcgaagaaaggatatatctcgtacctgtagttgcaccgcagtccgagaaccctgccgccctgcttcccgctgaaatacttgggcatcatcccgacgattccccccaggcagctccggcaggtggccgtcgccatgtccggcgtgcactgcgccagcccgtaaatcttgctgccgttgaacccttcctcccccgtgccgaaccgcctggacgagttcgccgccgcgtagtcggcggtggcgttgatgaggacgcccacggcggcgtcgaacaccttggccggcgcggacacgttctgcgtgttcatgaggatgaggaacttgttgtcgccgttggtggaggcgaggaagttctggttggagaagcggagcgcgcaggcgtcgtagaagacggtggcgtccttgttgtaggggcagagctgctgcgcgtcctggaacgcggcggcgacgcagccggcgcaggcggtggcgttggcggtgtcgccgcggcagagcgcgagcgcgtagacgatgtccgggacggcgccgagggtggcggtggcgaagagcgtgcgggacgaggaggcgttcttggggagggtggcggagatgctccggatgttgccctggtaggtgctgttcgccgtgtagttgccgctgtcgccgcagaagttgccgaggggctggcccgcgacgggcggcggtaggagggaggttaggagcgccgccgccgccgcgacggcggcgacgcaggcggggagatggccacgtggcgtggccatggcgcgagggtggaggtggtcggcgagcaaagagggataaatggagaagagatgatagatgagcggtgggcccttggttgactcgagtggagcttgcttgactcgtctatgttgcgctgtcgtcgatcctgacatcatgggacccaggcataaatgctggtgggcccacgtcaagctgccgtgacgaccattgcatggccggcgtgagggcaaacaatggggattttttatattttagatttttatttacaaaaacttattttataaatagataggctagacagcaataagtagtgtcgagagcctattcgtgaaaggaatatttttaattaaaaaaggatttacttgtaatataaaaatatttacatatagctctcagtgccatgttattggcattgaagtcctatttgtaaataaaataggtccttaatactaatatcattagcacctatacaacactatcatgtttagacgggataatatcttaaaagatattatacgtcgatacctaggaatcgcatgatacatataagtatttcgaatgggatacatcattataccattatcctcagcaataatatccagtgcgcttccatcacggcaaacaatgtgccgaaacatgaattcggcaataataaaagggggtagcgcacgagccctaaaagtggatggatgcggagacaaatgatttagacaggttcaggccctctcaatgagaggtaataccctactcctgtt

SEQ ID NO: 1950 - DNA, 1501 bp, Oryza sativa
ccaccgcgcgtaccggaacgccatggcgacgcaggcgccgcagtcggagtacgccggctccgacgagtcgcagcagaaggccgacgcggagatctggtccggccgcacgccagcgaggatgccgacgcagctggagcgatttgaggtggaggatccgttcgccaccatggctggcagcgcggcggcgacatgccgcaggttggcttcgtgccttcgtacgagctgttgcgagcgaaccgcccctgcacagccccgccgcactggtggatcggcggacggtggccgccgtcgtcgtcgtcgagggcgtcggtggccgcggcggcggcagcaagcggagtagttcagtggtagcagtggtagtggtacaggctgctccagttcagtggttatggtttactatgattaatccacggtagattacttgggttagttgttaactttgaccgttgagtactaacctccataaagagcagtaacaatgaatatatctatactccctcaagcaaaaatataaggaaaaatcaccactaacgcaaagataacaaaaataatcatctcttcggctgtatcgtctcgatgcatgcaaataatatgattgagcggtttgaattttgatggtaaagaatttaaaatgagtaaattttagaaaattgtaactttagtggaaaaactatcaatttgttacaacattagcgacatatttcagtttgctgcaacaatagcgtgcaaaattatcacaagactataacttttacgttatatgctgcaacagtgcggcatatatgtattgtagcagcatataacgtaaaagttgtagttttgtgataatttctcacgctattgttgcaacaaattgaaacatgtcgctaatgtggcagcaaactgatagttttgtcactaaagttcactacgccagatcctcacacctctgacgggatacctgtgacgggcaaacgaattggtcagtagtgaccattacctttgacgggttatacgggatgcagtcaccggtgaggcatctggccgcggcccgtcacaagtatcccctcacctgtgacgggccgaaaggaaaacccgtcagaggtataccagtgacgagtttttaatccaacccgtcactggtatcccctcacctgtgacgggccaatacattagaagccgtcagaggtgatgggccgccacctgtgacggctttaatttctggcccgtcacaggtgagatgataccagtgacgggccgttgaatacaagcccgtcaaaggtatgagcaatacctttgacgggctttttttatctaacccgtttgaggtgtgttggctctataaatacccccaaactgccaactgctttccatcccgaccattgtactgctcacacatcggttgggagggcaaggggggcgatttttttgctaaaattcaaggtaaaaaacacattattctccattcattctcaacatatcgatcatcatttatttttcttcgtatgttgttgatttcaga

SEQ ID NO: 1951 - DNA, 1501 bp, Oryza sativa
tcgcttctggaaattttcggatatgtccaaaagtgattttcggactttccgaaaatgactgcgaaggcaaaagtggttctgtatattttcggacttgtccgaaactgatttttggattttctgaaaatcatcagtagagtcaatttcgcttctgtatattttcgaacttgtccgaaagtgattttcggacttttccgagaacatccagaacgatgttgttgttttcggacttgtccgaaaagttttcggaatgtccgaaaaatacttcgttgactttgctgtcggtgctgagctggaattttcgaacatgtccgaaaatctttcggaatatccgaaaatctcaattattgtgcataacgggcagaatttgggctgtggctataaatatccccctcccctcacttgtgagggctgctggttccatttcaatcatttgtgcccttggcttgctctctctctctagcccttttgagccttgctttcttgtttcccctctcacccgtgttcgatttggattaggtgtgtgtgtgagagttatggattcgagttttgtgagtgcttgttgttgacttcgtgaagatttgtgagcacttgcatcatctccgggagttctttgcttcatttgttactcttggaggttgaggactcctaggcggctaggtgtcgctcccgagccaccgatctacttgtggttggccgggagaagtttgtgaaggtcggatcttacctccgaaagggaagagatacccttagtggaaggaggagtgcttagtgcaaccttttgaggaaagggttagctaagacccggctcttagtgagctcctcaacggagagtagaatcccctcaaggattcgaacttcgggaacaaccttatgagcttcaactttggtgactttacttcctccctctccactagctttgcttgtttgagccgctataggtctagttgctgtatgtgctagcatattcttgttgtaggcaactagatctaggatttactttgctatttgtgctgactccgaaaaattttcggatatatccgaaaatttcggaaatatccaaaaattactgcttccgtttttaattgatttttaaattagcctattcaccccccctctaggcctaattgacactttcaacccattccacaagcaagggaaaatgtatatctgaggtctctcatcttgtcaccgaattacaaaattgtccctaaacccaaaaacaagatactccctccatccacaaaagttacacctatttcacatttaagtttttccaaataagttgtttctatttatagtctttatacattcaagacttaaatgaagagataaattaaatattttattagaacctaaggagtcatctaaatactcattggttgcatgcttgcattcactcattgattttgtaacatctaaggtgacttaatttctccttggtcttagtgtcaaaagtaatatgtgtaacttttatggatggagggagtatatggcatcc

SEQ ID NO: 1952 - DNA, 1501 bp, Oryza sativa
gctatatatatatatccctcttcttaagggtgaacttttgcagttttgtcagatttgttgctgcgaaagcatttttttgagtaaccttattcatacctatttatttaagtgaataatgcaatttgatgtaacagggcaaaaggctcgaatattggcttaaagtgaacagatgtatgataaatacacaagacacatctattcaccactgaattttgtggagcagcatctccaaacagtcattgcagagaacagtaaataagtagcacagcaaaatggatcagctattagtgaagatgaaaaatgtcggttttaggcaaattaacatccacctgttgtccgcttgaatgatgtttaaagtaaacagagaggccatgcatctcaatctacaaggaacgagattttcgtcgataatacaggtttgtgactttgtataactacacgacttaagagcctgcatggatttgataacgcttgacaacgggtgccggtgggccgaggggaattagttcccctcggcaacctccggcgagaactcgaggacgccgacattgccggtgtgtagttcggtgtagaacttgccgtcgatcgccgtaaacttgcgtaaaaaactgatgatggcgtcacggtgggcagggttgcggtactggtacggttgctgatggagcttcacccagtggttgtcgccgggacggcaataccagagctccgggtcggcgaggtcgatgacgagatcggtgcagctggtcgggtccatgggaccacagcatgacaggaggcacctccggcgatggctgccttcggcggtgaggacggtgccgtcgtggtcggggggcagcctgacacggcggccggtgaaagggtcccataagaaagtgcacggcgagccggggcgcgccatgagcaaccagccctgcgccgtggtccaccagcggtggcctctcatcatgtcgtcgacgccgccgtcgcccaccctcgttggcgttggcattggcagcagcgctctcttcggcacgctgtacaggaacgtggcgtcgccgtggccgaacagcagcagaggagcaagcttgggatccagagcggcagatgcgttgactgcctcctccatgatttcgacggacgactggccgatcgatctttcggtatacgaatttgtgcagtgttttagaaatcctacaagtgttgtctcgtgatttctgttccaaatcatccgagataaagaagcgatttaatagtagtacaagtctacaagagataaagaagcgaagaagtatgcacacctaagacctacaatcagtaactcctaccaattataatctgcaccggcctgtagatcaggaaaaggaaacatgaattcctacacgacatcaaaattaattgtactagtactccagtatgcatctatttggagattggatagcaaactaacaaaaactacaagcggaagccgacctatattacgccgtgcaggccatcgcggacacgcacgcacgcacgcacgaac

SEQ ID NO: 1953 - DNA, 1501 bp, Oryza sativa
cacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatga

SEQ ID NO: 1954 - DNA, 1501 bp, Oryza sativa; identical to SEQ ID NO: 1953

SEQ ID NO: 1955 - DNA, 1501 bp, Oryza sativa
atgagtaaagactcttgttagattgcatgcctagaagaagtaggaacgtgaaaattagagtttaatcctattgaacatagtggattgtaggttgtatttagacattttttttgttaattcggtctattcatttaaccgaggagactaacaattgactgaacaaaatttggtatttccctgcctaggaccaaattgatgaccgcatttatcgatctcggtctttttctacccacccctataacggaggaagtatccagtagtatgaggccatctacaacgggtgcccctaggtcgtgcccctagcaccatccgtcaatctttccatccgcgtcatcccctcgtgagtccgtgcgcgccctggctaggggacgcgcctctcgctacttttcggccaggggacaaaggcgagcgacgcattgcagcgacgggctcctgtggccaccatgtctccagcgacagattccccttccacccctctcctctctctctctttctctctctcgcccgttcccctctctcgggcccttcgccgccacagcaaccacccggcaggagtagcggcgaggagcgggaggaggctgcagcaggagcggtggcgaggaacgggagtaggcggcggaggtcgcgctcggtgccgtcgacgggctgaggagcgagggaggaggcggaggtcgagctcggcgccgtcgacgggcttgaggcgcccgtgctcacggccaagcagcacgaggacgacgtcgtggttgtggtcgtcatgcttggggacgacagcgacgagatccggccactgcgcgccttgctcggcctcctccgccggcgccttgcccgtcaccgccggcgccatgcccgccatcgtatcctccccgatctagccgcggggggcccagatccgcccactacggcgccggatctggcgcccctaaccgatgacgggaaagagggagagagggatggcggtggatgccggcgatgggagaggcggccctcctcgtcgtcctcgcagccgccggcaacgagagaggcgagcggcggcagcggcgagagggagagacccgtgcggcggtgaaaaaaagaaaagaagggtctggagagagagattaggggtagggtagtaaaaatatatatggggttttgtggctgcatacccactatgggttggagtgtctctattgagttgcttcagattttgagtagcccatccacagttatcctccattgtaagctgagtttccccacgaggagtggctcatattatagatggcccgacggattcacgattgtaccagtgaaatgccctccgtagtccgtaccattaaaaagtttttcgtgccatctgacattcgccggaaggcgcccccctacacgtacagactacagtgcatcccacgcccgagtgcgaaccagccgtgccgctgtcacgtgtgcgcgcttcccccggctcgtaaaaccccacccccaaattcctccgccgtcgccacctttcccccaaaaataaacccca

SEQ ID NO: 1956 - DNA, 394 bp, Oryza sativa
gcgcccacgtggcgcgcgttggatggtggtggggttgaaattttgcaacggttaccccgcaacggctacttcaacggctaaaatttgaaaataaccgttggaggtcgaaaaaaattcaaaaatatatgaaaaaaaactcaaaaattaggaaattttttcctataaatagggtagccaacccaaacattctggctcatccaaacattcaatcttgtgctctcttgtggtattttgtgtgttgtaggttacgactttacggtcttccgaatttttggcaaaatttctctaaatattgccaaaaataaaaataactaggggaagacatatattcctatttgtaagctgcaaacaaagagttgaagaaggtaagaaattattattattattattatta

SEQ ID NO: 1957 - DNA, 1501 bp, Oryza sativa
cacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcggtttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatga

SEQ ID NO: 1958 - DNA, 1501 bp, Oryza sativa
agctgatcatagcaagatatggttgttgatcaataagaaactaattaaagatgctttgttttattaaaggaatggaacactacaaagatgctttgttttatctaggataacattataatatctgatagaacataggctagtcagaaaattcaaggaggcaaaagcaaatgaagacggagtatatgtctttatatttaatgacacctctttgagagagagagagagagagagagcataattacagaataaggctaaattataatcgaaactttatccacaacttacgttggtagatcagaatagatcttaaaagtatgttccaagtgtttagggcataagaaaaactctaatataatcccctcctgactctgagagagagagaataggacaagtcggtaccttttttattaaggagaaatgcatccaaatcaacaccgaagaggactaaaacttggatggctttggtgtccacccatacctgaccacaaacataggcacagttctctttctggctttccctaagatgacagaaatatggaaaagccggtatcagtggcaaatttgcagcatagttaattggagaggagactgatatatgtcgatgccccaatcatcatcattatgtgaaaacaaacagttctgattataatctttgatagatgaactggacattattctgaattctggatgatgacatacaatgatatagaccatacacttgtaccacaaactagcatctcaagcatccaattgatacaagtgcgatccagggacatgaaaattattatcttaagagaagacagccaacaattgatacaattgtcacgaaaacccattgccaccttttatcattgcagaatagtattcccatcccaccaagcttataccaattaaaatacctttagcaattcatcttacttagaaaaaatgatcatccctgcaataccatcaacacataattagtttctatcatgcataaacagcaagttgtaaacagagataaagagccttaggtgaatgaagcttgtgtttgctacaaacccttcactgtgaaaaaggaggggaatttaatagctgaaaacaaagaacatgatgcatcagtccatgtggcaagtcaaaaggcaatccccttttcactacggacaactatttattagaccctatgtataggggatacgtgagtatgatccatcagattttattcacctacgtggaattgcagtgagcgctgcttaccaatggtgtaggccaagagggtggacagcccgaaatatttcatttgatgggaacccatattattgtttacagtttaaagtaagataccatgtcgtccagagctactagtttccttgtccacaaatggttcagcatttgggattgcaagtatatatagagcacaaacctgaacccttcacttcacccaacttcacagttaaggccaagttagcctctcagcctccccagaacaatactactcatttcctgaaaaaataccaattgt

SEQ ID NO: 1959 - DNA, 1030 bp, Oryza sativa
tgcttactatactattaatacccggtcccacctatcatacactcgttacgtcttggagtccgtgctacagctggctacagatctgtagcctgctgctcttctctctcttcctttatctctttaaaatatgtttatagctggcttatagctcgctattgtacctgctctaagggggccgcttgcaaaataaccatggctggccatttataggtagaccccttgccgtccttctagaaagatgcaggggggcgtttgtaaaatatcgtatgtcgttattttacaggtagctcactagagagctgcaagagtgccgtctataaaatgtttacgtaactgttacaacacaccaatgggtgtgtgccacgccataaaaaatgacctttgggagggcgtttttgtagagcgttagatgtgtagatttgtgaaactttgaaaaaaaatattttaataaataaaattaatttaaattaaaaattttaaaaattccttgtacttggggctcggctcacagctcactctatacaacctgatcaatcacagttcacaaccagtaatatttgcgagactgactggaaaaaaagaagaaaatgtagataaaactctggagaaaaaatagggtcgccataatgcatcatttcacatgcgctgaggtaattacagagaaattaatctgacacaactgctaatcgatgggaataaacagcgaacatcgacataagttcagaacatggtgatgagatgaaaacagtaaggcccagcaacatttcatttcagccttagtaccaaattatggattaaactacataacacaaagtcaccaaacaagaagacgtgcagcaacatatcccaattttagcaatgatcctcgttttggataaggtttttggcgaaattaacattgctaaacagcatcaacatgttttcgccgtttggcagagcagcacaacctccagctctggtgagaattagcgatcttttatagcggtcaggggatcatgcctagcgtgattgatgcacggaccacgtaaca

SEQ ID NO: 1960 - DNA, 1501 bp, Oryza sativa
ttttgtaattttttgcgcccatggattatttctgtaaatattaaaagaaaaaaatttaaaaatgaaaaaaattctccgggcaagtggcagtaaaaagaaagaacctaacacgtgcatcaggaacatgcttagatctgcgagcacagtggtcagcttagccatgtggttcatgcactaatcggagtacataatacattagtacatgaatggtgattattctgtataatttactgttatatacagcgtagtactccgtactagcgagctggatattgagttcttgtttatgggttcgttgagacgtcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcacctt

SEQ ID NO: 1961 - DNA, 1501 bp, Oryza sativa
tccaaaccagttgaaatgtcccgatttccttctataagagctgatgagacatacaatgggtgcagcactatcaatatgcaaaaagctgcaaacaacacagaccttctgatgcttcaggatgttgtgaaacagctgtatagaacaaaatttgatgtcaaaatggtaacttaccaataaaattccttaacagggaaatgtttgtttaggcttggcatacctagatctgatcatatcaagaagacatggggcgacagctgatgcttccggatgcattgccatgcacttcatacagacaccgagcatgtataacaatttacctaggacaacaaagtagcgaccaaggaaatcgataccatattactaacgaagttcaacatgccattcttccttcacattagtttacactggtattttttctggataaaagggacacacaaattattcgtatcagttgggatgttgtgcattgtgatccttagcaatctcaattacttttctacatgctaaattacacattgcagagataatgtacaaaatcatcaatatgtacatgaatctaaaacaaaactgtggagaaagtttattagtattatgtagtacagatttatatagaggtgaattgaccctaagcataattcgtaaatttacaactaccaaatcaaatgcaagctatctacggatctaccagcgggggcgaagcccaatagaggcccgtgggtgcagatgaacccccctcaaacaaaatttttagttattacccccatatctcggccctatatgcaccccccttggcccaatatagtgcacccacagtccaaacaacagtccagttaacgttgtaagcccatgaggagagtcgaatccagatcaatcttttctcttctcgacttctcgtatgccgcgtcccgtcgctgccaatcttgacgactccgcctcgcatctgtttggcttccacgccactgctctgcaatcagccaatcccagtctcccagacaacacttgcccatctcggcatcgtgacgcgccgccgtcggccgtcgccctcggcagctcactgtcgctgtcgccgtcgcccctgcttgcttagtgcctacgttgctcgctccagccgcaggagccaggaaggcaggaagccggtcgccaggcaaccagctaaccaggagcaagcgtcagaccacactttcacaagccatgaagccaacaatgacatcatccatctccatcaactgatcagcacacagccacattgtgcgttagtagagacaaggtaagaaagcatgcttcatctatttcttttttaatcaatttgatttattagatacaaaggcctaaaatttttattggttgtttttttttacattgtagaattaggaggccagtagggttcaatttggaatccttcagaattggaataaaattgcagattggggggaaatttgagaatttgagttgaaggtgctatttggatgtaagtcatatcaattttcattctacttctgta

SEQ ID NO: 1962 - DNA, 1501 bp, Oryza sativa
ttagccttgacttggactgcagcgggaacaccactccacaggcatcctcgatggcacggacgaaacctactcctcggaaaagccaccatctgacgcatactcaaactctggggtttgggaaaaatagagcaagactaagtactacccactgtactcagcaagtcataccgggataggggtatgatgcagggtaatcaaaggatagctagagtggttcatttgcataaagcgagcatttataaacagtagttggaagaagtaaaaccattatagtaattaatcaatattaaccatccactgtccaacgctacaccacgttgcaacaggcccaaccatccacctgaactaatcagttccatcagactaccctagggtgagactaatcacggtgaatctggttgaccgcccataaccgcgggcacggctatttgaatagttttactctgatcagaggtgtacaactgtacccacaagacacagccccacgacacgtttccgtgcgccgacatgccaccacgacataccggaaagaggccatgacaggacccttcgcataaccacctctaaccaagcacaccacacctcaggtttcactcccacttctcgcaaggcagcgggcagtcccctctcgtgcctaggtgaatccggaagccgcataggccgtcgtaaggcccatccaaactccatcacgcccacccttgcctggatgtgtcggctagagaaaagctacactacaagctcagccgttgcccacgctggcttgtggtaagtacgaggaattcttccaggatttcccgcgaaccggtccttaattgccatgggcgcgaccatcaaaaccatgcacccacagcccaccatttaatatattttaattaaccaacactggagcggtgagcattaaccaacatcattcctagaatctgatatctatgcattaatgttgtcccccattgtgtgctagttgaactaagcaaggctaagaaatccctagtccaatctctagtcatgttatatcccaagctaacaaaggaacatggtacaaaatagcatggctataacagtaggtaaacttcccatggtaatattataaaacaatgcagtatttgaaggaaaacaatggagcatttgcaatataggatcaacatgttcaagtgacaagcatgacttgccttgctctactgctggaggaacctcggcgactatttcaaagtacaccggagcgtggggagagccggaatctaagcgacatacaaagcaaacaatacaaacaggctataagactactgaaacagagaacaaaaccatttttaatggattctacacatttttattgatttactgagacttcaatgggcttaaacggagcttggatgaattagatataaattttagaagattcactgtgtttttactataaacagaaaaatccttaattgaattattgcgcaataaataaatcacgggagagagagaggggcggcgccgacatgcgggccccaca

SEQ ID NO: 1963 - DNA, 1501 bp, Oryza sativa
atcacaaaccaatcagccaaaaacacatacaaaatcaaacccaaaatcaaactcaaaataaaataaaatcaaagattggcggatttacccatgagtgaaagagaggcggagcaaacgaggaactcaaaaacgaatggagatcgagaggagtgcaaacgcaaagctgtggggatccgatcaccggagcggggcgggtcgggtttatataagcggcctagggtttgtgcctcgttgcggggcccacgggagtaaacgtggcacgcgcggcggcgggggtggttttcgctagacggtgggcccaccacggccgccgcggtatgcggatcggcctcacagtttctaaacccaccgggagaggcggcgcccgcagcgcggtggcgggcacgcgtatgacatgcgggcccagggcgacaggtggggcccggagagcggtggatttctggaactttcggtgggtcgcgaacgttggttgtagtagtaaaaagtctatgaccgcacgacttgggccccactcgtcaggagagagaggggcgtggggaagggtgacttgtcttcttggagaggaagaaagaaagaaaaagtgaggaagaggaaaccaaaccatcggcaagattggatttcggccgccgtggaatgcaggattttctgtggacattctatagtaagaacacatgacgtcttccagacggtacagaaagcgacctcttcgaggaggaaaaaaaacaagggaaaatggaaagggacgtggtgaaatcatttgtcaattaggtagagtttggacgttcttttgaacggaacaggagttgatgctgatgttggttgaactgttgaagtttctatggtagaatatgcttgatcgtgctggtgttgaagttgttggtgctacactgtcatgtcaatgcgttaaaaagaaaaagaaaagaggatgtgcttttcgttttggcctccttaaaatagtagactgtacctaatgttcccagcaaaaaatactactaataataatataataggagtgtatgagatggcttgtggagtttgagtgtgccaattgttgtcaacgcaagtgattaatacattatggtcttgtttagttacaaatttttttttaaacttttaattttttcatcatatcaaaactttcctacacacataaactttcaacttttctatcacatcgtttcaatttcaaccaaactttcaattttagcgtgaaataaacacaccctatactacatctgatccaaccttctccaaaggggaatgcagcagagtgcacattattgggccacatatcgcaacctcgggattgtaaaatgtgcactccaaaaaacagataacgttgtttgcccgaactgacgttcgaacatctttaaaagaaaaagaactgttcgagtgtcgaaccatgtagtatacgtgtacacgttgaatgtgcactcgtgataaaccctttttcgaacggagagaagttgataaaagcctttgcaggaatgggctggctgtg

SEQ ID NO: 1964 - DNA, 1501 bp, Oryza sativa
gggggggggggggggaagaagaggatggaggaggcaacgagtggagcggcggcggcggcgggggcggcgctcgtcgtgactcgtgagaagggacggcgagatggcgggccaagtggaggcgttgcgccgtgctgggcttggagggggagatgggctggtagtccgactaaataatggcccatataatatacggcccgttgttttgaaccgaaaaccctagcccggaatagacaaggacttacgattttgctatatctcactcgaaagattttttcttatctctcactcgattttctcactcaaatttacagtgcatttccttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccaggacttatggcctagtatggatgggcctccacgtatattagctgggtttaggcccatctaatcaaggcatgtgggagaatgtggcctgttgactggaataagtccacaaactgtcccataatttttacgtcgaatttaattagtgctcccttcgttcctaaatatttgacgacgttaacctttttacacatgtttgaccgttcgtcttattcaaaaaattttatgaaatatgtaaaactatatgtatacataaaaatatatttaacaataaatcaaatgataggaaaaaaataataattacttaacttttttaataagacgaatggtcaaacatgtttaaaaagtcaacggcgtcaaatatttagaaacggatggagtattatgatttagagatatgatttaaactcgacggaaagataagagatggcaagtgaacttattgtcttagtagtattgtcttattattccctgtggacaacaggtgtgatgtggcccattaatttttaagtaagactcagatatactccataaactttaaaacattaattgtaactaaaacagaaatttcttaacatttattatcaagatatctccaagatgaccaatgttcaccgaatagtatctccaagatagagcattatatccaagggatacagaggccgggttttatttaaatctattatctctcagcaaggtcagccactacgtcggcacgtagaaatgcaactcatctcacactctcacctctacatatacgcttgcaaggcctaggcttttgcaattctatcttgcactcacagatccatctaaacgcgcagcttggtcgccatggagcaagtcgcgtactggttcatctgcgcatgcgccttcttggctctcgtgctcctcgtcaggctgggcgccgcgcgccgcgacgtcgtgc

SEQ ID NO: 1965 - DNA, 1501 bp, Oryza sativa
cgggttgaggaggagagaaatcgatcttcgatgagaggagtgaggcagccagccagccagccgccgccgtcgccgacgctcgtcgcggggggggggggggggggggggaagaagaggatggaggaggcaacgagtggagcggcggcggcggcgggggcggcgctcgtcgtgactcgtgagaagggacggcgagatggcgggccaagtggaggcgttgcgccgtgctgggcttggagggggagatgggctggtagtccgactaaataatggcccatataatatacggcccgttgttttgaaccgaaaaccctagcccggaatagacaaggacttacgattttgctatatctcactcgaaagattttttcttatctctcactcgattttctcactcaaatttacagtgcatttccttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccaggacttatggcctagtatggatgggcctccacgtatattagctgggtttaggcccatctaatcaaggcatgtgggagaatgtggcctgttgactggaataagtccacaaactgtcccataatttttacgtcgaatttaattagtgctcccttcgttcctaaatatttgacgacgttaacctttttacacatgtttgaccgttcgtcttattcaaaaaattttatgaaatatgtaaaactatatgtatacataaaaatatatttaacaataaatcaaatgataggaaaaaaataataattacttaacttttttaataagacgaatggtcaaacatgtttaaaaagtcaacggcgtcaaatatttagaaacggatggagtattatgatttagagatatgatttaaactcgacggaaagataagagatggcaagtgaacttattgtcttagtagtattgtcttattattccctgtggacaacaggtgtgatgtggcccattaatttttaagtaagactcagatatactccataaactttaaaacattaattgtaactaaaacagaaatttcttaacatttattatcaagatatctccaagatgaccaatgttcaccgaatagtatctccaagatagagcattatatccaagggatacagaggccgggttttatttaaatctattatctctcagcaaggtcagccactacgtcggcacgtagaaatgcaactcatctcacactctcacctctacatatacgcttgcaaggcctaggcttttgcaattctatcttgcactcacagatccatctaaacgcgcagcttggtcgcca

SEQ ID NO: 1966 - DNA, 1501 bp, Oryza sativa
aaaccagtggtagcaactgtgttcaggcagacataacccagatgaagaaactcaatatgagcagaggagttatctgggtcactgaaaacgtgcagggggaggatgtttttttcttcagctgaaccctctcgacgcggcggagaagcgaacccatctgttgacgtgggtgccccggctggcgcgacgttcttgacgcagacgtgcgccgtggacgtggtgtacacgcacgcacgcttgggggaaaatagaggcgagggcgatgccaccgccgccgcgagacgtccagtcgccgagcaaatggccgtgtccgcgaggtggctgtcgcggaggtcgaggccgaccatgcggagcgggagaaagaagcgccacccgcggcggtgtcagcgaggtggccaccgtaccccgcgccgtgaggtgtggccgcgacggcgctatcgttgccaatccgcatccgcctcggttgctgttagacagcgtgggaaaaagagaggaataaagaaagaaaggagagagataaaattgtgacactaacgtgtaggtcccacaagctgagttagctagttggatcgagtcaaagacaccacatcagtaaagccattctccaaaactgctaagggaggtaagttgcaccggttttaacagttgagggggccatgatatctggttttgcggttcagggacacggattagattcggtcacttttaagggagtcaaggtggacttattcttatacaaaaggcctacaatttaggcccttattttcttgggccgaatatggcccttttattaaaaaggaaaatcgcatggaaaatggagcgaacgactaaccttccgttttttctctttcggtacctaacccgtacccgttacatccttccctccaataacccagccacgcacctccttccacgtggcaccaagccttctcctccaagtcacctcgctccccggcgcgcccaaaccgtacccagatcccgcgtgctcgataaaagacggccgatctccgcaccacccaccccaacacgacccctcaaggtcactgacaggtggtcccgagctatagtaggccccacacgtcatcctcagttcgggtaggaatccgcgtccgcgcgcggaccttctcgaagaaagtcaaagcgcgccccgctccacgtcacgtcggcccgggtggggcccacgcccagatctaacccctggtccgtccgatccccgcgaagccgacggcccggatccgacccgcggcctcacccccgcctataaataccgcccgcgagggcgtccgcccctcgcgcgtcacagtctcgcatcgcttcgcttcccagtttcgggtctctcgcttcccccgcgcggatctccacttcggctctccccggctcggctcggctccctccacctcggctcggctcaagtcgagtcgcttcgcgaaggaaaaggataagcaggagacggctcgactcgagaggaggaaaaagaaaagagaagaaaaaagagaaaaaaaaa

SEQ ID NO: 1967 - DNA, 1501 bp, Oryza sativa
tatcaacttctctccgttcgaaaaagggtttatcacgagtgcacattcaacgtgtacacgtatactacatggttcgacactcgaacagttctttttcttttaaagatgttcgaacgtcagttcgggcaaacaacgttatctgttttttggagtgcacattttacaatcccgaggttgcgatatgtggcccaataatgtgcactctgctgcattcccctttggagaaggttggatcagatgtagtatagggtgtgtttatttcacgctaaaattgaaagtttggttgaaattgaaacgatgtgatagaaaagttgaaagtttatgtgtgtaggaaagttttgatatgatgaaaaaattaaaagtttaaaaaaaaatttgtaactaaacaagaccataatgtattaatcacttgcgttgacaacaattggcacactcaaactccacaagccatctcatacactcctattatattattattagtagtattttttgctgggaacattaggtacagtctactattttaaggaggccaaaacgaaaagcacatcctcttttctttttctttttaacgcattgacatgacagtgtagcaccaacaacttcaacaccagcacgatcaagcatattctaccatagaaacttcaacagttcaaccaacatcagcatcaactcctgttccgttcaaaagaacgtccaaactctacctaattgacaaatgatttcaccacgtccctttccattttcccttgttttttttcctcctcgaagaggtcgctttctgtaccgtctggaagacgtcatgtgttcttactatagaatgtccacagaaaatcctgcattccacggcggccgaaatccaatcttgccgatggtttggtttcctcttcctcactttttctttctttcttcctctccaagaagacaagtcacccttccccacgcccctctctctcctgacgagtggggcccaagtcgtgcggtcatagactttttactactacaaccaacgttcgcgacccaccgaaagttccagaaatccaccgctctccgggccccacctgtcgccctgggcccgcatgtcatacgcgtgcccgccaccgcgctgcgggcgccgcctctcccggtgggtttagaaactgtgaggccgatccgcataccgcggcggccgtggtgggcccaccgtctagcgaaaaccacccccgccgccgcgcgtgccacgtttactcccgtgggccccgcaacgaggcacaaaccctaggccgcttatataaacccgacccgccccgctccggtgatcggatccccacagctttgcgtttgcactcctctcgatctccattcgtttttgagttcctcgtttgctccgcctctctttcactcatgggtaaatccgccaatctttgattttattttattttgagtttgattttgggtttgattttgtatgtgtttttggctgattggtttgtgatttttttttttttggtttctctggaatgag

SEQ ID NO: 1968 - DNA, 1501 bp, Oryza sativa
ttaaaaaagttaagtaattattatttttttcctatcatttgatttattgttaaatatatttttatgtatacatatagttttacatatttcataaaattttttgaataagacgaacggtcaaacatgtgtaaaaaggttaacgtcgtcaaatatttaggaacgaagggagcactaattaaattcgacgtaaaaattatgggacagtttgtggacttattccagtcaacaggccacattctcccacatgccttgattagatgggcctaaacccagctaatatacgtggaggcccatccatactaggccataagtcctgggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaaggaaatgcactgtaaatttgagtgagaaaatcgagtgagagataagaaaaaatctttcgagtgagatatagcaaaatcgtaagtccttgtctattccgggctagggttttcggttcaaaacaacgggccgtatattatatgggccattatttagtcggactaccagcccatctccccctccaagcccagcacggcgcaacgcctccacttggcccgccatctcgccgtcccttctcacgagtcacgacgagcgccgcccccgccgccgccgccgctccactcgttgcctcctccatcctcttcttccccccccccccccccccccccgcgacgagcgtcggcgacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactactacccttgctgatccagatttttttttctgtctccagtccatccagtttgctccggatttgattgctgcgtgcgtggagtactgtactgacagcggtttcttcccaagaatttttggggatttttggggattcagcttgagccttcatgctccaacttaggtgctgctcctgatgcgtcttatgagtgtcggatgccgccatggcgctgcgagggcgctgcaaccacttccactctgcagattgtctatctcatcatgtacgcaatctagccgagatgtcagcaatgttaacctcacggtggaggaagaagaggcggcgaggctgatcaagaattcgctctcaaaggcacgcaagtggagtgtacaggacttgattcagtgccttggagccgatt

SEQ ID NO: 1969 - DNA, 1501 bp, Oryza sativa; identical to SEQ ID NO: 1953

SEQ ID NO: 1970 - DNA, 1501 bp, Oryza sativa
cagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacataga

SEQ ID NO: 1971 - DNA, 1501 bp, Oryza sativa
cactatagcatcactgtgcaaacggttttaaaaaataatgcatatcttatgagatattgcttttcaaagattggcattttgaactttaaccctccacatgcagtaacagaatgtgtaatttgcagtaacaaggacatatacatacagtaacatggttttactaaatgtataaaattgttcaaaacactcctacgtcaatcagaccttgctcaaagccccctatagattttacctatagcccaccaattcgatcttcatcttgtaaaaatgacatagtaaaactacaattatcgtgtagtaacatagctacttggaagtggtaagatgcacctattatatagtaacacttctacttttgtgcggtaacaagtatttggttagcatgtgagactttaacctagtaatactagtcagttaaatgtaataacaacctatatattttgtagtaactggacgcgttactatatctcatgatggcgttactatgacaagggtggaagtacatacatgaaggaaggataccggttttcttgagaagagagaggaaggcctagtttttgggaagagagagagatcgggagaggagaaagcagagggatcatgagagggagagagagactaggattatatctattctgttactacacactagttacactgttactatatttatttaacaatattactatggggttgcagtaacacatagtacaaagcagtaacgagcaagagtaaatactaaaatttaggaatcgttagttctacgaacaataatcaatagcgtggtgacccctactcataaaaattaaatgatggtaacaatagtaatctataattctcatggtaatgctattgtagttgtgtagtaaaagatttgtgatagtgcattaagatggtttgaagtgtatactaacaaccttcctagtatcgttactacgtgttttgtgccaaatactacaaggattagcacatatgagaagataaaattttactaagaaaactttatcacaattgagacatagcctactggttagtgccatgtggtaatttaagttgtaggtcttgagttctatattcccattaaatgcaatttttccctttatttttttccttctcaagaaaggggaggggtggaggggggatcagaagaaaaaaggggaggggcgcgcgctcgggttgggagggataggccgcgcgagaaggtgggggaatcgggaagaagagtggaggggggtatccataaaagaccaaaagcatgaaaaataattgaatgagattcttcgtccttcaaaaaagggtatccatagcgagaacaattctcaagccatgcgtattttgctataaaagaatattacgattggatggcaggcaggccggaagccttcgacctccaatcatggaaggggggcatgcagttggaaccatgctgccaggccagaagcagtcgacctctgtggatgagacagcaggctggaagaagctcacggactagcggcagcga

SEQ ID NO: 1972 - DNA, 455 bp, Oryza sativa
ggcgggagcggcgggaggaaggggatgacgggtgggccccacccgtcagcgagggaggtgggcgggcccgcccgtcagcggcgcgcgcgcggggaggaggccgaatgggccgcggggaagaggagagagagggagagagatgggccgagccggcccaagagggggagggggggaaaagactttttagagtttttctttttataaaaccattttaactttgtttatttcttaataattattatttttgctctgaaaattccactaaaatttatttacacattttaggcttttaggaaatatacaaaaatcctccaagccttatttgacttttaactttgcacattttaattgttgaaggcttgcacacagattttaattattctaggcataatttaaaagatatattttagagtcgttttgggacgcgacaaacataccccccttaaacggaatct

SEQ ID NO: 1973 - DNA, 1501 bp, Oryza sativa
tcccgagcaaccctttaagcatgttgaacccgtttaaagctattgttttatttcaacttatgcattattttagaatgtcatcgggtggtgagcctttcccatttaattatggccaaacatgactttatttttctatgggttataatttgactagcatggaccttatatattggattggttcagctagatgttatttatagttgcttagtcatgcttaggaacattagctcacaaatgggatgaattatactacattattatttatggttataattaatggtagctcacgatggttaatcgtgtttttataattaattgataattaaaacttttcaatggtgggttgtgagcacatggttttgaaggtcgtgctcgtgacaattaaggaccggtttgcgagctactgttgtgagacattaacagtgccaaccacaagccagcgtgggcaacagctttaccttttgtatagcatgattcattacggggcaccagactgagaagcggcgagaagtccgtgggggtcgctggggagtccatgcctctagtttttgagggggtgattatgatccaggaatggtgcactgtggtgagttgtgttgtgcgaagggtattgtcacgatttccccctttgcagtgccgtggtggtacttcggggcatggcgacatgtgtggaatcgtgtcttgtgggtacagtggtacatctctggccagagtaatactattcgaatagccgtgcccgcggttatgggagggttgagcaatgttttcgtgattagtcccacactactcattaatggtagtaatgtgataattaatttgactcctggtttggaatggttaattcctgttttggaggtttgatctgtacgaccggggttggttgttcaggtttggttgggcctgtgcagcattggggtgctgttcagtgttgattaatatggatgattaattactctactgttttactattcttaaatctttgctaaatgatgcttttgcaaattagcctatattatgccatcctttggtatccttatgcacttggatatttgttatgtagcttgttgagtatgtcatatgctcattcttgcaataatcatcaaacctcagttgaagaaaaaggatccagaaggagaagacctttggcttagatcccagttgagctgcctgtaggagtggagctgaggcttcgctagattttattttccgctgcagttttcttcatggtgaggactaagtgcctcttatgtaagtatttatcgttttagttattttgatgaatctgtatattaaattgtcagtttgtgtacctcggctgattcctggacgaggattttatgcacaaattagttcggaaaatactaatgaatttccgggcgtgacacaacttaaagcagtgcaccgttcctggatcataatcacccccttataaacaaggcatggactccccagcgacccccgtcggcttatctccgccacttctcagtctggtgccccgcaa

SEQ ID NO: 1974 - DNA, 1501 bp, Oryza sativa
ggaggggaagaggggcccaagagaaggagggagagaaggagagggagagaaagagagggaggaaagggagacttcgggctgggcttggcccaaaggaggaagagagattatttttaggtttttctttttaataaactttgataattgtttttgttgcttaataaatatttccggcgctctgaaaattcaagtaaaatttgagggctccttttagaccaaggagaatttaacaaaaattctccgggccacatttgaatttttcttgtgcgtattttagtgtttgccaatttcttttagaattttaattaattctattattccttttagaaaatgaattttatttcgggatgaatttatcaggacgtgacagtgtgccatgacatctcgactaccgggccgcagctcgtgtagccttcatttgtcctagagatgtccatcgacccccgacttcgtccatctccatccgtgtacttttgtttataaccagactgagccacaaactaagccttacccattagacatgtggaagtacggtagtgatttgcaacagaggcccgaagaccggtccttatatggccgaggtgctactatcaaaaccatgcaccccgagcccagcctaaaaccattttggggattttgaatagagggagaggtgtgaatccaattccacaataatccaacaattccaatgtgtccaggtgatgagaatattcccaaagtctagagttgtaaaaccacctaatgttacctaattaaacagcgaagcatctacctaaaatcatactagtggtacaatgagtagagtgtccactagttggggttttgtttattctagggtgaacaaggtaataataacaatcacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataatcagcagaaacaaagcacaaaaatgggttcttgacttcttaaggaaaaattagagacttgaacggtccaattccgagttcaaatgggcaagttatggccatttgaattttatatgctctttaaatgaatatttgcgaatttcttcatttaaattttaattcaaaaatggatttattgcgtcaaccgaggggaggggcgcgcggaccgggtccacgggggtggggcccacgcgtcagcctcacggtccacggtgaaccgggcgcacccgggcgcgcaccggccggcgccgtgtgtcccacgcgttagccgcacctaagggcgcgggcggctgacagccaggccccacgcggcagccgctcggtgcacccgaaggc

SEQ ID NO: 1975 - DNA, 1501 bp, Oryza sativa
tatatatatatatatatatagggtacccatatgggactccatggtgcccggcaccatgattgaaattgagtatatatccaattcaaatgagtatgaaactttttcaaatatttaggtattaacattaactactttattagattttgaacttgtttgaattgaatttgaacttgtttttgttagattttggttctaggtatatagcatccaaacatataattagttaggtatgtaatcatggattgttaaataaagttaaatttgagttgtttttttttgataggtataggtatgaatcgaattcttataactaggtatatactcacaatttgaaaattttgaaaattttgagtgaatttgtgtatttgataccatggtgcccgggcactatggtgtctcttatggatatatatatatatgagttggatttttttgcacgcgagttcacatgtacccacaatatacaccctatatatagcttgcacgaatcttagggtgagtatattaggtgctaataaaatgtaccatgcatgatgtttacgttatactatattttttacaagtgtaaaataccttgtttattgtaatttttgtatttctagtatgcaaaacttgtttatttagtttaccttgtttatataaattaccttgtttatgtagtttttgatggtaggatatatatcattttggaagtatcatttttgcaagatgacaatttggtgatataatagatatattgttttctcattttgactaaacaaaataagggttagagaaatacaatgcactagatatataaatgtcatatatgattgttattgaaaaaatttatttggtaaaaaatgcaacacacatgttatatatattgtgaaccaacccaatcctaatcttttctccctatagtaagcattcatttggttaaggttaggtatattttgcagcacgaatcttggaacacatcaacggtgtagattgtgtgtgtattatagggtgagactattctacacccagggtatagaataactattctacacccccttaccctttttatcccgtatccctcccgccctcccgatccccccttcccgtcgcttccccctcccgccttctttttcgctcccccttcctcctcccgatctctctctttcctttttcctttttttctgttttttcttcctgaaacattttttctcttttctagaaaaataaaaaataaattgctaaattcaagacttgaacccatgacctcatagttcaaagcacattcttctaaccaatttatctaatgattttatttgtttcaagaattttgtgagaaagtaatatgattatcaattctaatatctttcactaccgaaactcataacatgttattatgctccagtagtaatattgtggtaaaagtacagtaacacgtgacgttactgtagaacacatagggcattactgcacttttggcagtaatgtcatagtaaaattttagtagaccaggaatcaaaac

SEQ ID NO: 1976 - DNA, 1501 bp, Oryza sativa
taaccaagcacaccacacctcaggtttcaccccaacgcctcgcaaggcagcgcgcagtctcctctcgtgcctacgtgaatccggaagtcgcataggccgttacagggcccatccaaactccatcacgcccacccttgcctggatgcgtcagctagaggaaagtgacactacaagcccagccgttgcccacgctggcatgtggtaactacgaggaattcttctagggtttcccgcgaaccggttcttaagtgccatgggcgcgaccaacaaaaccatgcacccacaacccaccatatgatttattttaattaagaaacgccgggacggtggctctaatccaacatcaacactagaacctgaagtctatacattaatatgatttcccccattgtgtgctagttgaactaagcatggctaagcaatccctagtccagtatctagtcatgttatatcccaagctaacaaaggaacatggtacacaaataacatggctatagcagtaggtaaacatcccatggtattaatgtaaaacaatgcaatatttgaaggaaaacaatagaacctttgcaatataggatcaacatgttcaagtgacaagcatgacttgccttgctctgctgctggaggaacctcagcgactatttcaaagtacaccggagcgtcgggagggccggaatctaagcgacatagaaagcaaacaatacaaacaggctataagactactgaaaaagagaacaaaaccatttttaatggattctatgaatttttgttgatttattgagacttgaatgggcttaaacggagctcggatgaattagatatgaattttataagattcactgtgtttttactataaatagaaaaatccttaattgaattattgcgcaataaataaatcacgggagagagaggggcagcgctgacatgcgggccccacaaggcagcgactcggggagggcggtccggggaggagcggcgcaccacgtggtgcacacgtggcgccgacgcggcgcacacgcggcggccacgtggcagccacgcgggcagccggaccgacggccccgatctaccgccaggtagattggacggcggatgcggctcgcggccggcgcgcacgggcacggctcaagccgatccgcggccatggcgcgaggcagcgaccggccagcggcggagggcggcggcgtcgcggtgacgcgggcggcgatagcggcggctaagcggttaggcagcggcgcggcggctaagcggcgcgggagtgagggagaaaggggaggaggggcctcaccgacgacaatcgactacggcgagcgacggagggcgatggcgacggcgggacgagcaccgggaccacctaaggcatcaaaagggatgagttagagagggagagtgaaaccatggatggctagggcggcgaccgaaggcgccggccatggcgaagctcaccggcgcgcggcgcggacggggttccggcgttgaatcccgacggaggaggggtgga

SEQ ID NO: 1977 - DNA, 826 bp, Oryza sativa
ccccctgttgtttgtgaattctggtcacaaatcttttagttgcatgtcttgcgcatcttctctcttgctgtagctagcttccaatgtgcgtgtgtgtgtggtacgaacgggtacgtcccctctctactctgggtgtttctcacatcgatgtgtcacttttgtaggatatgtgtgtgccactgtgtggttcccctcgacttttgtttcccttggcacaaagaaacaaatgggataaaattagcggacaagaggcattttgtaagcttgtatcaaaatcggaagatatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgatcccatgcgtttgttgcattccttggctgcattttttttttgtatggtttcagg

SEQ ID NO: 1978 - DNA, 1453 bp, Oryza sativa
gccaagaaggttagaactgctttgtattgtttattcagcatttcgccatcagtagtcatatcatgactagtcgacttttgaaaatttgttagtcagaactgttgtgtgttgtttgttcaaaatttctttagtttgtattttgcaagtggacactattctcagatttgccagcagttaatccctgtggatttaataatgctgtcaaatagttttttatagaggcgcttttcaaggagtcacctagtaacattagatgttcttaatttgttgtatgggtccatcgtttcttatgatatacgcagtgccttcaagtgtggtgtagacgtgtagttactcttgggttatgtagaacagggtgtgtttgtttaccagaaatgacacaccaagtacatgactggagatgctatgaaacatattattaactttgatagaactgggaagtgcaatcttgccagttacagtaatcattgtctatctcacatggtttaaaagcatttctttcaagacatattatacatgtatatgtctaccagtgtaccacacaatatggaaacatggagaaaataggacattgtactataacatatctgataccttggttcaattttcattttggactcttgtaccatttaaaagatgtccacaaagtttcattactgttcaaaagacatccctggccgaaacaacccgatttttcatgagcagactgtttttctaattattattaaagttggtcaatgtggacactgactgtgggatggagagtgatgggtggcttaacagtatatggagttgagccaaattccatgaaagtaaattttattgaaaccactgtttgcaattgaaaactctgttgttttggcctgagagattcctttgaatggttttgcaagttaaggggtatgttttaaaaagtactacctccatcccagaatataagcatttttagagttggacacggttattaaggaagtaggtaaaagtgaatgatggagggctgtgattggttgagtagtggaggtaggtgggaaaagtgaatggtggagggttgtgattggttggaaaaagaatgttggtgaagaagttgttatattttgggacaaatgttgagggctaaaagttgttatattttgggacggagggagtatgaattaggatggaaattaaactgtgacaggaggtcagatacatagaatggattttctcaagcagacataacttataactaggttgctaagagcagactttgccttttggaaaaaaaactgaatattttgagttgctggtcaatttctttaaaattgggtgttttggctgccaaaatatattcaagaatatacctgagtgagatgttttttgtgttcagctctgtttgcataccagttcaaactgactcttatagttgtaaggtttattttggtcatttactttttctccttggtgctttccttta

SEQ ID NO: 1979 - DNA, 1501 bp, Oryza sativa
tcagctagttgtgatggagtttttgaaatggtcaggttgattcaaggaaggagagagagaaagagagaggaggagggagggacaaggggggaacctttcctcggtttggcagaagaggaatctgcgcaggagatggtggcccaagagccgggccgggccagtggtttggtttgagctccgctagctgcatcagccagcagggacaacatgcaacaccaaaacacaccatacgagagagagcgatatgtagagagagagagagagagagtggccatggtagtaggttgatgttacctttccccctagcatcattcatcgatccccccctctctctcccccttggctgcagcagaaagctttcatcatttgcacctttcaaccccttcatgcttatacttttcttcctttggtcgtacaccacattatcacagttttccttcttcttttatcttaaacaaaaagaagatcaaggctggttcattcattaaaaaaatattattgtcttctatagcatcctcaatgcaacattgataaggaacacacaattacttatatagactcggtatacacatgtgaaacaggttccataggccttcggactatcgtagcatagaataccattcatgaataccaggaagctaggcatggttaattaaaactttcaccttgatcgctctcgacctctcgttgttttggaagcatatctcattattacagtatcattacttcactaaaaaggaagcggacaagccgtcaattactcatagcctaatacgcatacttacacgccagtgaatccagcgcacgaaaacaaaacctctctcacggcccccagatttacataggcgccggaaaaaccatcggcgcatatcacgacgctcccacccccacccgccagcaccatatcagccgtaggaagtgcaccagaaaccacccgataccttgggcaagcatacaagacgtaggaagtgaaccagaaaccgcccgataccctgggcaggcatcggcgtccgtccgttaatcccagcgcatactatgttggcacacagttggcactcgtccagacagactgttcctccaattccctccaccccctcctaaaccaaaccaaagaaccctataaaccaaaaccaaaaccaaaaaaccaccccaaaaacacccaagattggcagcagcaggagcaacaatggcagtatatataacagtggctccaaccaggcaccaccaccacctccacctccaccactgtagcctcacgcgtcatacgctgcctacgctacccccggggggccacgcgcaccaccaccaccaccgcggcatcggcagccgctgcggcagcaacagcaaaagcaaattcctttctcctcctccttctcctcctcctcctcctcctcctccttcttcttcttcttcttcttcttcctcgccgtccgtttggttcttgttggagagggggaggggtgggggggtggggtgttggtggtggtagtggacttgacga

SEQ ID NO: 1980 - DNA, 995 bp, Oryza sativa
tttgattgcaacgtttgatcactcgtcttattcaaattctttttgcaaattaaaaaataaaaagttgtgcttaaaatactgtagataataaagtaaatcataaataaaataaataataattttaaaaatttttaaataagacgagtggtcaaatgttacaaataaaaactcaaaatcccttatattatgagattgggggagtatacggcaagggagtgtgctgtgtgtggtctgagatgatgtgtactgctgctagcctctcgccgtgtcggcattcgttggaacggcgcgagacttgttgtcatggaaacagaacttgcatgatgcattgttctacgtgaagtttgactccttttgatatattatcgttttaaatataattaacaaacaaaattcagaatgatcaaactggctaaccagtaaccagcatctgcatcaccgaagaaggacatgagcgtatgcaatttccgtttgaagttggcctcaacaggatcatttccaatacacggcccgcagattgcaagaagaattccgcttcggccgcttgggaatctgcagcccatgccgcgatggatcaggccgaatctattgcttaccacaagcctatggttatccgtaccattagtccagcccataatccccctctcaccatgggcggcccacagcacgaggaggagctcgccggcgtccggtgcgcggtggccggcgaaacaccggcgactcgccgccgccgccgcctccggatcgcccaagtcaagaaggcgagttttttccatacatattttacatttaccaaaaaaaaattaaagaaagcgaccgctaatacgcgacttcagtaactgacagggtggccccactgtcacagtgtccctaccaaccagagggacagggaggctgggaagaacgcgcgtcgagaaagggaagagagtgggtgagaccgtgagagagggggatggagatggaggcgtccgccgccgagggcggagccgcggcgg

SEQ ID NO: 1981 - DNA, 1501 bp, Oryza sativa
atattccagattcataagaaaattgaatgtaagtttcataaaaaatcaagagcaacatacacaaatgtttatcgaaaaactgaaatctgatttgaattacgttatgtaaacattttaccttttgggaagtatcaacatattctctgatagctggaaccaccgagactgcaaagtatgagttgcgttgtaaaaattactttccaaatgggtatattggaaactagtaaggcaacacttcaataatatttatgaaaaaaaaataccaatcaatggatatttttattagcaaaatgatgtaatcaatgagcatgctcatagcagacattgtcaacactcaacagtgaatttgagaatcaattgaactaatgaagaacacaaaatggcttctaagggaacagaacttggttgagactgcaacatgctatgtcaaatggggtcactatcttcatgaccccattgttatttccactatttatactagatagcataacgttcatatggaatcactaactcctgaaaaaacataatcccccgctcgctttaattgagccttccccacttttgaaggatagctaagtaagttgtaaggcatcaattgtccaatatggtagtgcctacctgagaccaaaatgtctttacaaagaaatgcatgctctacagcaaagtaatgaatctaaattccatgagacgtaaccattaatccgcatcggcagcactcgatagtaactgaccaattataagcttaaaaacattgatccacatgaatccacacgagaattggtccaattggattacaattaaccaagccaaagctcacctaagcacggatacagaaatctgtaacccacgaaacacgaattaacctagaaatcacagaccaacactcaatttaccaaaaaggtattagagtttctacacaaagcttgggctcaactctacaacctgcaaaattaacaggtaaaaagcttcccacaatcctcgtccccccaaccaacccagtccagctatctagatcagtagatctgcaagccccgccgataatcccctatcgtttcaatcgacgtttagccgtggaagggggaagagggagggagctcgcgggaagcgagaactcaccggagctcgggccgccgctcccgccggcggctgagggcggtgagacgggagccgtaggggagcgtcggccgcggcggcgcggtggggcggagctgttgccatggcggggtccggggctagggttggaagggcgcggcgcgagcggctgggatcctctggtggattcggaaggggagatggacatcaactccgcgcgggagctcggtgttgggtcaaacggcggctcgtctggtcggcggcgaggtggcgggcggcggtggcggcggcgacgccgacgcggtcacggtggcgcggcctttatacggtggtggttggggaagcagacacgacgaggacgcgcatggcttggctggaccaagtccacgtgagccgcaaacgtggagga

SEQ ID NO: 1982 - DNA, 1501 bp, Oryza sativa
ttaatatagatgtcatgtatatttacgggggaatatccaatgaaaaccatcaaataagtaaaacccgtgaaaaccatatctaaaagttttgtaaattcataaaaaaattactagaggtaggtataggcatgaaatacattcataccagatctcaagtccaaacttaacttcatttgagagaaaaaaaaagacaaatttcgtatgaatagtgttatgttattattcacctcaaatttgtttttttgtttttcccaaatgaagttgagtttggacttgagatttggtatgaatgtactttatgtgtatacctatctcttataattttttcatgaatttaaaaacttttagatatggtttcacgggctttcacttatttgatggttttcaccggatatgtccccatatatttatactatcatatcaactactgatataaacgtagtagaatattttctttcattggtactacaacttagaaaataactaccaaaactatttctaagaccataatactggtataatatatagtaatacaagtagagtacttattatatcttaaagaagtttaattttaaaaaataaaaatacagtgtctaactacctagctgttgtatgctcacgagtatatacatggatccatttagcagagctacagctcttaaaaataacttcaagagcatacttagagtagaatttgtgaagcgcgccaaacccttgcttcacctagctctctagtttattttactgagatcagtaaagcctgctccacttctctcctttatatggatttaaaattgtttggttatgccacggctctagaaaagatggatctgaacctagatccggccatattatataggagtacgtagctagtactagcgtatacgtccttgccgcttagctcaaagtcgtcgccctcctccctctatttattcgccccacccctcgctcgagctcgctcgcacctttgccaccccccaccctcgatccagagacgcacgagccaaccttgctctcaaccgttaatttcctctctccacgactcgacgccgcacgacaaaccagcggaggcgctcgcgcgctcgccttctcctcgccctccatttgaacaaccccttcaattaactcctcctcgatcgctagctctctctctctcgttgcctcctcgatctccttgaatcgatcagcggcaaccagcctgatcgttgtttgctagttagttaatttccgtcgccgatgccgacgacgcctcgtcgcaaggagccatgaaccgctgcaccgacgtcgagatcaggaacgcgctgcgcctcctcgcgcccaagcccaccgaggacatgtcccgcctccaccaggcctacgaccgcggctagcttagcgagtagctgctactagcgttcataatcattctgtgttccatcgctcgagttcttgaacacgaagaggagcttagtagtttgtgtcagctgttagtttaatttgtgcatagttcgctgcgcgcggc

SEQ ID NO: 1983 - DNA, 1123 bp, Oryza sativa
tagattgcgttgcacaacagtatggtattgtggtatatgatagtgatggaatgcattactctctatgttccctattctcattttagtgatgaaatgagataagtcttttaagactaatggtttgaggatctgaaggattcttgcccacgcatacgtctgagagatgttttatgctatgggaacatggtctgtgacaaaggttgtcatcagggggagtatgtgctatgtgttgattgtcatttgcgagacattgaaatgtcttagagtatgcccggagcattgactcgatgatgatcacttagacctgtttctaaggtcctatcatagaaagatctgtctttattgaccgacaccaaatacaagtgggctatctcacagactcctaaggcgaggtgatgtgagtagcaattcaagttgagtaataatctagaggattgatcacctagtctctcccaacagttagttctcggaagcttttccggagaattgggatgagaagactttgatgtttactaggttcagggggagagcaccctagaacatgacccacagtatggaccgtgtagtccttagtgttgtactctttttcccttgagtgagtgaagctgttgttcctcacatgaggtttttaacgaggcaacaacgtgcaatgcatgagcgataactatgtactctttctcctagcctttttcccactgggttttggtaggagttttgacgaggcatgagttagtcgcggataggtctaagggggagtgttatggaatattatctcccggggagataaagatcctttcttgtggaccaatccgaaccggagtagagataagatctatctcctactaagacccctatatatacagggggagggtgtgacatctatggctaatggttggcttgtactccagataagatctataatgaagagagagttccaccctatatctgtattaattgtctacttctgcaatgttcttgacggcaaagggatgggcgcgggtgttctacatcatctcacgcctatactgttgtgggaaggacagggaacggatccggtgatccgctaataggcgcgttgatttacaacacatctaatcacgttttttcctgatttttgtgcagg

SEQ ID NO: 1984 - DNA, 1501 bp, Oryza sativa
ttgagttccaatttgaggccaacccggtgctctgataccattgttggattgctttggatcggtttggcacaaagtggaactacaaattgaaatgggattagatcatacctttatctcctggagttcccatctctctgcctttgttcttctttcttctcttctagtttggaagcacagagagaatcatgtcttggtttttccctgtgtttcagtgggttgcttgatcgggtagcgagagaaatctcttaaggtttaacacttaggtattgatctctatttatagccactgcaggggaaaccgacactagggtatggcggttatcccccgatcagggatgttcatgagagatcgatcactgtagcgatcgccctaaacaaaatatctctttgccgactttaggtttagccgcaagatcatattttgtgttcacactaacaataataattaattcggtttttatcttgtgtgcacgaaaaagagaaaaaagaaaagaggaacgtgggcccagtgcatgaagtacgtacgttcatgcacgtatgtgggccttttaaggatagattaaattggttgttttttttataatctagtggttaaaaataatgggttcaccagattaaatgaaaaccgacagttagattttctttaatttctctaaatttattagagtgccacgtggcggtataggagtatttgtagagtgccacgtggcggcatgagaatgtttgatttttaggatttgtttagtatggatgtgagatataccaccacgataatacctagagcatcatgttattgtttatattttgacaaatatgtatagtcaaatagttctaaaaatacaaaaatactttgagaatcttaatcacaaacaaattataatttaattagatcaacttgaaaaacacaactaaattgtgttgtttttattttttaagtatgtagatctaaagtagtgttgtatatttgtgaagtgatatttcacttcctaaaatgtgatgtgatttttttaaaaaaaactatcatacataggtcggcctcatgtgttggtgttgtggtgtattgaggaccataatataacttttataatttaattaaagaaatacaacatgatcaccaattggatatataagttaaaaaatattttagaaggtggtttaaagaacatttattgggtattttatatttttaattatagatcatagtttaactatatttattatatatatgtatatatatatatatatatgtatgtatgtatatgtatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatatgtatatatatatatatgtatatatacatatatgtatatatatatgtatatatacatatatgtatatatatatgtatatatacatatatacatatacatat

SEQ ID NO: 1985 - DNA, 1501 bp, Oryza sativa
ctttgaatggatgatcaggatgtgcgaacccactggctgaaggatcgatgcttaatttcctcttttcttctttagttcttctgacctgtcccgattgaataaaaggaaagagcgacatcaccgttaaatgtttccatcattgagtaaacagaaacaaaatggtcaggtgacacacgtaaaagtgaaaaaatattggtttcaaaaaaatgaaaaaaaaagatttttctgttagcttgtcgcctcatgccacaaagctaaaattttgataggtaaatttgtcatcaatcgatgccaaggtggaagttacagaacaataaattcaatgtaaaataggagtgttcttcacttctcgtgggttattttgatcttatccgtccatttcaaaccaacggttgggattggccaacggcacgctgccgttgaaacagctaacggcagacgatgtgcacccgtcctcattggtcaccagccgctatagacttgccgtagtagctctacagcagcataaagagatggattattttctttctccagaacaaatataataataataatatctttataactgatgccatttttgaagaaaaatgcataaggatattccagctaactccacaaggtggtggattaaacgatctggtttcgaaaccttgtcgttactaattatttgatattatatcattccctattattcgtgttcttttttcatttctgaaatttactttttctaatttatataagtgtgatattgaaattggcattcaatagttaaattcataaatataaaatttcccgaccatttccgtacaaataatagaaaaataataccgattctgaccatttccgaccataattcgataataaattttagaattgatttagaactttttttttcatccctctgtatattttctagccttaatttgttggatcatttccgattattttatttattttccttccatataagccttatctcaaccaaccaataaggaacatctttttccgaagatcttccacccccgaacacgtaaaaaaaaacaatcggatctcaaattaccatacaaatgtacaaaatgagataaacatgcagtcattaactaccataaaaggtgttcaaggagataacaacccattgattacaacgaaacccccacgcaggcgtaggtaaggaaagaccaggacggacggccaagccagcaaataccaccaccacatcgtgtgaaagccgccgcagcaacgagcgagggggatgaaacccaaagacggggcgaagacgggagacggaacccgcaaagacgcgtattagttgggcggctgccgcgactccaccacctctcctcgctttgcttgcttgcttcctcctcgctctccctccctctcttcgcttccttcccctccaaaaacccaataaaaaacgcctttcctccccccccccccacctcctcctcctcgatcccctcgccgcgaagatccgatcccgagcacgagcagcacaccg

SEQ ID NO: 1986 - DNA, 1501 bp, Oryza sativa
tttcatttaaattagtggacccattattttagaccgttagattatatctattttagaaagttatttttaataagataactgatgttatcatcatagattatatattgtgttacaaatattatatataaaattaaaattatactcttcatagactacattaaaatccataaactctagactacattgaaattactcatcagattatatgtaatgggtcacaattatgctcgttgcaaattaagaatcccatataattgacagctcatgccatcctcatatttcaaatatatattttttcctgtaaaatatgagacccatgaaaacacattttctatttacggtagcatcgagaccactcctttatataacagtgattgtgtgttcgctcccggctaaaactctatggaaaaacagatcttttgactccacggtaacaaattatggtgtgtatttttaactgccttaattaattaggaaagaaaagaagagattgatgggggaggaatttgtacgtacgtacgtacacatgtggtgacagccaaggaaagggtgagggggggggggggtttaagttttgatctaaaggttaatagtatcgggtccaccgttttaaatgaaaattgacggtcagatatttttcttttttcatattttttctctaatttattaaagcgccacgtggtggcttaggagcgtttatagggtgacacatggcggtttagaagcgtttgtaggaagtttaatgaacttttagtatataatatatatgactaattccaggtaaagggaaagtacttactaacattcacctatactaaactttagtagtgaatgacttgtttgccatagaagttgaccagatgcttctgttaattgcagaatatgtctctgatcaaatgatcaatacgtattgtgcttgatttgggattgttcaatgttcatttgggctgaattaaccaggaaagggagcacaatggacaaggctcaaatatatgaatggaggagctaccactagctaggtgaaaaaacatgcatgtacaacgagtaatgcatgagtcaagctaccagcggcatacaagcaagtcaaagaattcacatcaccaacagattgacaataaactaaactagacaggtgaaaaataaacaaagtggtgagctagtgctaccccccaaaaaaacataagtaaaaccgagtaatattgggttggaaccccaaaaggacctcattggcttggaagtggcctagccttccttccctgcccccctaaatttaccattgtacccctcaccctcctctctatatatacatacccagcacccttcactcccttctccaagtgttcaagctcacctcagttgattctagcttagcaacacacaagcacacagctagctagctcagctctctgtgcttctctagctaagctaatcgttttcaggcgaaggaagcacacacatctccatttgtgcatcagatcaccggccaggtcgtcggcgagaa

SEQ ID NO: 1987 - DNA, 1501 bp, Oryza sativa
gacgagacggaggccgggctgcgggttgctactaccgtcgcggaagatgtagtcctgccgctccggcgggttcgccggcgtctgccacacgatccccgccggccccgccgccatatatatatatcccgggcgagacacccctcgatcgggcttgtggcggcggaggagggggcggcggggcggctgctcagctcggcggttcagcgcccgaggagaggaaggaggatgggcggcggcggcggcggcggtgggcgaggagaggacggagtggttcggcggcgcgactggctcggcagtggaggattttagtgagggtgtgcttccgagggcgtatgaccgtaggatccacatctaacgttcgtgggctcctggcattgtcgtgctcgaatcgtttcggcccatttgcagcgttactcacctgcttatccgtatcacttatattggtaaatagtaaatcatttgtgagtgtaaataatgtaaaataaactatgatgaaaaataaatttaaaattaaattctaaaatttaaattttagctttataagtataagcataagtggcccttgaagtatttaaagaatttaagttcactgtaagagcatgcatagtgatttagacggtacccatctatataatcttatcattttcctggcaatatgtccgtatattacaacggacttgtacctatcttcgaagcttttactgtttttcccaaagaagagcgtgctacactcaagggagagagaacggatggacaactctcctttttaaatagtagagatgtgtagacggcacatagacaactttaaattaggttgtctatttagttagctatattagattgtacaatttcgctatgtaattttataccagctaattgaattggatttgttatacaactcctagtttatatttcaatatatgtaattatattgtatgtataatagatactaaaagtagggttgaatttaatatacaactctaactcttttcttcttcctcttatgtacagttgtatttcgtatataaattttgatatcaatctacactataatttagttccataacaatctaatggcttatattttttttagtaatgtaataatttttagcccttaaaaaacaaacatagtatcatctttatgattcaatacatctatactttttataaagttatagtccactaagtctaaagctcagcatgcaaccatgccacatcatcacccgctagcaataattacatatttaatctcatgcaagcataaaacatcatctacaatttatttaatgtacaaatcaacatgcaagcatgtccaatcatcacccctcgcatcatttgcacaatattttaacaactctatctattattcttataatatttaacatatacttatcaatatgtttcacattaaagcgcgggtatcatttgattggttcatgataaatagtgataaaccctgatgttcattattttttttctttttactcctagcttgattgta

SEQ ID NO: 1988 - DNA, 1501 bp, Oryza sativa
ctcgggggacgacgaatccgacgcgtacgtggcctcggcggtgtcccagtggatgcccacggccgtgtcggcggcggtggcgagggacctgctcccgcgcttcttgtgcagcacatgttgggcgcacctcgacgacggcgagagcgcgtcgtcgaaggcgacggcgaggcaggtggctccggcagcgttccgcgtccacgtgacccggatgaggagctccttcccggagtgcagcgaggcaccgtacaccgccgtggtcgccgcctgtagcttgcgatccagcgcgccgccgcacccagagtcaccggcggcggcagcggcggcggcggcggcgatgcctaccgagctgtcgccgaagcacgacagctcctgcgtcgcctccggctttggtttttcttccggcgagattagctgctgtttgctattgctgctgcaataaaagagagagctgacgtggcacgctgacacgtggggtccacgtgggttccacgatgactcagccgtcacgtaggctaaaaccgaggtcaaaaccaccgagagacctaaagcggacggttttgttagttgagggatgcccagtatctggttttgcggtttgaggacgattttgtatctcgatgacaagttgagagaccttggatgtactttttccgcttgttttagcctagcctagggtttggcatattaagggctgtggtgggcctcgtggatgattaagctgctactataggccttgtttgatgggctatccaccggtgggcttcagcttgttttggctcacgtgcagctcgagctggctcgttatgtctaacgagctaaaatgctggctcggctcgttacgaaatttaaacgagccgaaccaagtttatcacgagccgagcgagctaacgagtcacgagcttcctgtccacccctaatgacataggccaaatcagctgggtctgtggcttttcctccttccctttctccgcctccatagtatttaatatggactgcattgcactcaataggattccataaggtctcttaagttctacgttgcaaggacctttcaaattaatttgaattatttttggattttggctatctgtcagtaatccctttttgatattgtcttatggagattggaattcagtatccacatgtacagtttcaattatgatggtatcagtttgctgtatgcctttcttttcagtgagatttcagttctgtctgtatatgtgaatctgatcttgtgctgcaagaaaataatgcttcgttttgctaatactgcagctgaaggctacacacatgacacatgtgcatatttttgtacgagaaaaatgggcacaattgatacctgataattgcatgcattgatctataaatagcctattagtactggagcaaaataaaaaatgcataacatagaaggctgaagctcttatatgctctcacaagtgtatggtggcaaagaacacatgaattttggaagtgattttagaactcacagataatgtta

SEQ ID NO: 1989 - DNA, 1501 bp, Oryza sativa
gtgggccgtggctccgtgctcgttcgccgtccgctccacccgcagcccgcccaccgatgctctgcccgccgtcgcgctcgcccgccgccggctccgcccgcagctggccgccgctccactgccgcgctcgtccaccgcgcgctccgtcggtgaagagaaaagtgaagaggagaagaaaagtgaagagagagaaaaaaagatgcgtgaagctgacaagtgggccccatagaatttttttattttttttctgactaggatgccacgtcagcaaaaccgggcaaaaatactgccaagggacctccggtgaacggtttgaatgagtttagaggtgaacatatctatcttgttttgtggttgagagacctaaaaaaaatctcgctgttaagttgagggacctccagtgaactcattcctaaaattattagtggaccaagcccaacccactgggcaaatttcttactctgaagcccacgagcacgggacgagatgacggctggttggattttagtaccacctcgtgagatgaggaggggagcggggcggccggaggctataaaaggctcgggggggcctctgtttggattcaacccgtccctgcggggggtgatcaggcgactcgttgatgatcgtttagagactgacgtgtcgcgccgacacccacaaaccgaacacgctttgccatggtgcgagcgatgtcccgtccctactttgggcgggctcgcgcgccaatttttggaaggccctgtgcccctcgggcaaccggggcctacacgacagagccaacctgcaacgttaaaacgatataagtatgatggtgaaaggttttttctcatattaaacgggccagtttctgaaccgaggattttgacacttttgacctttaaaaatttactaaaatgtccctagttaggttaaacatgaaaggggatataaattcgtcaaaaaaattactatagacagtatagatatatgaagtaattcatgaaacaattaccataggtatgaagtatattttcacccttttctttaaggaacgatagctcgtgagagaagaaaaaaggggaaggttaatgaggttaggtatatacattatatatatctattattttcttcatgaatttttttaaaaaaatatgctcggtttttacaaaggtttttataaggatatttcccttaaacatgtattctagaagtttctaactgcatatgttaagtcttaaaaggaaaaataggaaataccagcggtaaaatgggaatcaccatcttgagtagcgtgtagtaataatgtggtcagtatttgctaaattgagacatcgtttttttaaaaaactgagactccaagtatagtacactagagggctgttctaaactgtgttttggctttggctagttccttatttttcgttagcacattatattaatcatgttttacgtgcggctaatcagccctatgttctgacattacaaaacgcatgtgggtctaaacagagaaacaccatgt

SEQ ID NO: 1990 - DNA, 1501 bp, Oryza sativa
ttctcgtgtgttcccaatgatcacatccattctaggtatggaacaaataacctgttttccaggttgcttgcatttcagctgcagtatcatgtcctctggtatttaaaactattttgacctcttgcaggtcccaatttaggcaaggatttgctcaccggaaggagaaaatcggccacacaaccattgacctgggtgttgctgtagagataacagaaactcacaaggatggggatctggcaggcaccgatcctatggaaaaattacaggccgttaggggccatctcgtttccttccctttggagttcatgtgccaagaggacttgagaccattcttcggcgaaagcgaatattatacgtccccgcaagttttccattagcttctcccaaatttttttaactacattttagtagcattagcttcttgtttggtatagttttcccataggatctttttttaggctgtacatgttacatacagggtttttacaattgtatagatgtatatatgtcttgtggaaatagttaaaacttaagagaagaaaagcaaagagagaatcgggcagtgttagttcgcccatcacaaagggaataaaaaataatttcttaggcaaggaatgttgccgttcactttattctttcgcactgcacttgcaaaagaaaggcagttatgttgaaactggtgtcttcaccttgtagccgcatcaggcaccaccattatcaataatgatgtattctttcgtgattattttgaataaggttcatttacaatcttctattattgtgggaattatactgaatatgaagccattttcccccaaatgttatttcttcatcgctttacctctttgcaggaggaaatgactcaaactaaatcggtataaagctaacaatgggccaagctaagtctattgggctcaaacttagttagtaaaattatggaataagttcaccggaggtccctcaacttaatagtgagattttttgaggtccctcaaccacaaaaccagaaatgttcgtccctaaacttattcaaaccgttcaccggaggtctatttttgcccggttttactgacgtggcatcctagtcagcaaaaaaaaataaaaaaattccgtggggcccacatgtcagtttcacacatctttttttctcctcttcacttttcttcttctcctcttcacttttctcttcaccggtggagcggcggtgggcaagcgcggcagtggagtggcggccagctgcgggcggagcgggcggcgggcgagcgcgacggcgggcagaggaggaggtcgccggcgagcgcgctcctgctcctgctctagctactaccgcgcaggcgcagcggcggtggcgccgatgcagccgagctcgaccgagcgacggcggcgccgatgcgtcggggcgcggctggcggcggctcggcgcgagcgtggctgtgcggtggcgccggccctggcgcaggacgcggcctcggcggtgcagccggcgtcatcgtcatccctc

SEQ ID NO: 1991 - DNA, 1501 bp, Oryza sativa
ccgttccggccatctggacacacggctgagcgaggttgcttgctcatggcgaccgtctacgacgtcgacgacgatgccacttgctccgaggaggttggctgggctgcatgctgagcgctgcgagttgcaggcttgcattgcatctaccactttgcatgcctgttctgccggggccgtggttttttgtggctgacggaatggttgatgggatcattgcgtaagggcgcaaccacggcaaggtgggcgggcaggcagacatgcaaccgtggggaacggaagtggcaaagccttcagcgacaccggactgtagcttttgtgtggtggaggtacgttattgctgatgtttacacttaccctctgaaaaaggaaatcttaatttgcagcgcgcggatgcagcagcttattgaagcagaggtaaacgattgatctaccatccaacatgccttgagattgatgcaaaattaagaaaataaaataatattatctccgtcccaaaatataataagttttaaccatttacacagctattaaaggaggagtaaaggttgtgtggtggtatagcctataggtctggattagttggacgataatataactaaggatagttcagtaataaaaatcaccttttactatgttgttatatttgagaaaaaaattctaagaagttacggaaggaggattagtgtaataataatttaatcgatctttcaaggggcattctcggtagcttacagattatggattattgtgagcatgtttacttagtttactagtatttctaaacggtatgagttttatagaaactttttccatcaatatttcagagaactatttttaatcaatagtttatttttttattatgttgaataattaccataaaaatcattttcatccatcgataacgcaccaaagttaacgtgcaagctctgtagcatcatctggaaagtcactttttcccttactcaagagtgcgtgagagcttgagactgtaccaatgtatcttgacatattgatctcttactctttctttctcaggagagcgtcgatcgaggaacagtctccaggccgggcggggtgcatgcaggtgtgcgacacaagccgcaaactactccttgagccctctacacgtatcaaaatctcttcttttttttgtgtgtgtgcagcactgcaagtggtggtggtgtttagccttgtgggcgcagctaagtcagcgagctgcctccgtcgccgccgtcgccatcaccggagattaaaaagagcttggagcaggagggcctagctatatatacgcccttccacccgcacgctccggttgcagttgcgaggcacttgtcacgcccccaccccctttgctttgatgcacgcctagctaatcaattaacttaacctgcctcgcctctgcctattcgaaacagcagcggctccagctcgccgtggtcgactttcccggcggcgatcaccggcagcggaggaggagcagtacgtgtgtatatataaagga

SEQ ID NO: 1992 - DNA, 1501 bp, Oryza sativa
cctgtcctcttgacgctcattgtgatgtttcttttgcccatcaatctttacaattgcttgattctcgatatcgattgcttcattgtcagaatctggattatctgcaaattattgtgttcaataagtgcaaaccacaaggagaaaaaacaagtgaagagttttaatagagccctgtatacttgagattgagagttacttgtaatcattgcgcgaatcatgacagggagctcaatcacatagaagattgtgttcaaaatgtatgagagctaaaaggagaaaaaaaaacaaattaacaacatgactggtatcacagactgttaaagatgatggttatcctgtcatggcctcaggtcgtgacacttacctggacataaattttcatgctgtactgcttgtagacaatcaaaaccaattcactggcagcaaatagtatatttggtacatagaacagtatgaaaacgtgaatttctagtgacagagttgagtaccactgcaaattcaaatgagacaataattaggaaactagtatactctttgattgaaagaattcaataagtcacttaccaagttattgatctgaactagatggcacaaaacaatcataacatttcccagtgatccaaataaatgctccagcagtctcaatatgtcgtctcccacatttgtttccagcaaaaccaggattaccagaaaactgatgcatataaaacttacaagacaaattgtcttgtagaacaaaataggttagaacgtgaatgctctaataacaaagggaaaaaatatttgaaaagatacttacttttttcctttccttgttgtgtctataaatagacagcaagtggtagatgttcagtccacaagcgactgaattagtcattaacattgacagctcaactcccttattgacggcagaatagatcatccacgtcgtgtttcccaccaagttaatgatcgtaatgctagcattccaaagctctagtgtcagcaagtatctacccttcaaggcaccgtaaattattgggattgctgcctgaaatattgatatggttcctccaaagattgaaccatattgttggataaaagtggccgtggccttaaacaacaaaatagagacaaattaactttcatatgttatattgtcatcataactagtaatatggagcatttgataatacaaatcaaacaaataatttacaatttcttttaccaaattttacaatttgtcctgtgacaataatttaacaaataaaagttgtggtgacgttttacaactcaaactacttatctgtaataaatgttgaaatatgagtgaattgtgcggtaggacgacaaagggcatgttcagtgtgctagcattttctttttccagagaaaagtttggtaccattcaagttcaaccataccaggaacaaaagtaatcctaagataactatgaaaacaaaagcaatcctaagaaaactaacaaaagccctgccgactgccacggtagctgctaccacac

SEQ ID NO: 1993 - DNA, 1501 bp, Oryza sativa
cggcgtcatcgactcgatgaaggtgtgggtggcaccgtagccataaccgccctcgccgctcgcggggggtgtcagggccgccgtggtggtggtggatggggggcggggtggtaccggcgcgctgtggggctcggctacatccttccctttgtcttcatcctcgccgccatctcggcgctcgaggctgacgcaacaagtgctcctcgagcacctcgcggtcggcaaagatgccgatggtccatggggcacgctcgagcacctcgcggttcagctagctggccatcttgcgctgcgctctttgtggtatggcaccagcagtagggccggcggggacgtcctccatgcaacggtatacgtggatgttcttcgcgttcaaggcgcggcgccgcgtggtcgatcggcgatgtgtcgacctggcagatggaggtgaacacgttgacgcccccagttcacctgcgtgcaggcgtcgtcgatgcggcgatcgatgtcctttgtcgctgtcctggacccgctagtggtaccgcttcgagcagtaaaatcgatttgtttggtgtcagaacttatctaatggtgttatagtatactaactatacttagatcatgatgttatagcatatggataaacagtttcgctataggttttatcgtcggtgtcagacccgccggcttttttactgtagatctgcgcccctggcttcgagccgatcgacgtgcttgcattcggccggtatcgaacaggtttaggacctggatggtggcttatgcgcggggcgtcgtcgcctggagctcgaggaggctgagcattgccagcgtgtaattagtagtagggatgcggggcggccggacgggcaagcgggtttttttagcccgtttatctcacttctagtttattttttcttctaaattttatactattatgtagaaaataaactagcaagcgggtttttatgcgggttacgggactacccattatctctacgtattagctatccagcacccacaacacgattcaatagaacacgagatcaagatagtttgatggagatccaactgaattcgccgtcaccaatcacagcaagtaacatatgtattttcatttatccaaggagacattccctcgttaatttattgcatgttacttaaatataaaaaaattatatcactatatgaacatgcaagtttaaatttcacttctaccaggtctaagaaaaggaacaaattaaattgaatatattcactgttatatctcttctttttatataacttgtaactcgaatttaaatctatatgattgtgaagtaatatacctcaagttaatcaatcttgtcattggagtacgtctcgctcgttttggctccaggcccattgcaaataggacacgtatgagcctcgctcgcgactcggctaccaagcccgtctcggctcataggctcagatctcttgatcataatgctgctgctttcttgcactcaaattatcaataagcattttcattaagaca

SEQ ID NO: 1994 - DNA, 1501 bp, Oryza sativa
aaatgaagtctaaacattcatttagcttcccagtctcaaacttgacaaagtggagcctccctccaagaacaggatagctcctcctgccaccatttaacatcccaagtctcctcttcgtagatagcttacgcttgtcctcactggagtgctccgcatgccgagaaaaatataccagttttataagagaacctagagaaaatatacagttcagtacttagtaaacaaatttgcatgaaatttgggaaccaagaagagaataagagattgtagctctcattttggattgctagccaaaaatggagcttctgaacaataaaactaatcaccacattcgtcattactagttcagaaaccaacgtcacaaatccagagtttacttaataatccaaagttattggtgagatcaactagcaacagcacacataaggtgtccataacgtttagtagcgagcacacacagcatgcaaatgcaagtacaacagcattacgaccaactgctagcttgttcacactgatattagagagagaatccatcaagcatttgattctaagcttccatgcacttaactatctcccgtgcactctacactaactacttccgccagatgacttgatgctactgagctgattcgaacgaggaacggaaggtgccaacccgaaatcagtcggaaacggggggagtgtgagctagctccgccacgaacgtacgtaccaccgatgtcgagggcgaggtgggagatgtcgtcggactggttaggcagcaggatggtcgggttgcggtcctccaggttgccgtggatcgccgcgccgctgaggtccagctgcggccgcgagcccgatcggggcagcatcgccgcgggcgcctgcgtcgccgccgcaccaccaccaccacccttcccctctcccgcctcccccaccgcctcgtgcttcacgccccctccccctccctcgtccaggatcgggtcgctattattgttggccgccattttcggtcaagtgaatgcggtggagccgccaccaaccgcccacctgcccgcgcctctgccgccgcgaccgcgcgcgtggtgatggtggcgggcggctaggcggctaccgcctcgggggagatcgaaaagcgccaaaaacgcgagaacaaaatcggaatccggtggcgcgcgcggcggaatcgttgggcggatggagctcgatcccggggggtgggtgggcggcggggatgagccgatgaggggatttgtggcttatggttttggccttttgggaggttgggatttttttctctctctttcggtgcctctcctctctcgctgaacggctggagcctggagacgatgggtggaaaagtcaaattttgacctttttggcctttagtgtatcaggtgggccccgactgcagtggttgctcactgtgtagtcaaagtctaaggttcagttctatactccaaatctaaaattcaattttgttgttttccgttactacgtttctacaattttttacagaaaa

SEQ ID NO: 1995 - DNA, 1273 bp, Oryza sativa
attcggaattttaattatttttaaattctatttctttatggactctatattcttcatccaatatattttttaattttgaatttctttatttctaaattgtatttctagatggattctaacctctacatttattttttttcttattttttaattctgaatttctattagttttattgtatatcgatatggactttagacctaccttcctatattccttatttttaattccgaatttcagctattattaaatgtattcctatatggactctgttttttatttttctccgattaatgtcagaatttctaggccatgggagcaaacgtggaggcttctttttctatttctttaataatataactagctgggtggcccacgcaattacgcggctagcacccaaacaaaatcatattttttttaagtatgattttacttaaaatttgttaaatagctatctcattgtcttaagactttgaaagaccaaaccttaccatcctcgtgtttctaattatatagtttttaaaagtcacaccagttgctaccccttatgtcatcttcttttttatttacttgctcgatctaccactatttatattcattcttcttggaacctttaaaaattggattttatagtttttggagtttattgtcatgttgggtttcatttttataatttctagatgtcccgtcaaacgttgccactgctcttctctttattggattgagaatttaaaaatcgaacataattatcgtttgggtttatttttactttttagaagtcccgccaaaccgtcagcggctttgccattgtactcctctacgggtcgcccgctggcttccttctttattatcatttaagatttaaaatccaacatgattatcattgggtttcttttttttttaactttttaaaagttccgaacctttaaaattggacttgtagtttaattttttattaagttttaaaagtcacatcaaacgatgccactatgcccccaggtgaggttggccgaggctgaacaaataatagtggaggatgtcctcatcaccctctacagcccgtccgccgcctactctttattatcattgtgattctaaaaatcgaacataactatcgttggaattcattttttattttctataagtcctgtcaaccgtcggcggctctgcaactatactcttatacaccccgcccgctgcttctcctttttattatcattgagattttaaaaatcgaatatgattatcaatggggtttgtttttttactttctag

SEQ ID NO: 1996 - DNA, 1501 bp, Oryza sativa
aagcatgcccaattgcgtgaaacagtgtacaaatcgatagcgccataagaatcagttgaagttttccccgaatacagacgccagtaattcttcgtgtaaggaaggtgatcagagcgaggaagaggacaactgctgccgtttgtatcatcatcttgcaaggtggcatccacaacccagaattcctccccggtatagttgatgctagtcacgtagtacgtccctttgttgatctgaatggcagccctgccattgttacatgagaggttgtaccatggacgaggagtagcaacgcactgacgtgaatcgccttcaagacggaaagggtaggatatgttgccaagatggccacaggaggaaggaggacagtactgggggtttagccctgttccaacaacttctgctgcaacaaccgcaagcaaagaggagagaagtagagatttcgccatggctgcagcttccattcccagtccgtccctagagaaatgaccactataattggcagggattagccttgctgagtattaatttggtggggtcggggtgggtgctttaactggggagatactgactactagtactatctttttctttttcaatgtatgattctgttgacttttcagataatatttaattgttcttcttattcaaaaattcagtgcaaacatatatatataaataaagtaaggttagggtctctttgatgacaaaataaatcacaacaaaaaaacattcttataaattttttgagcaagacggatagtcaaacgttatgacaaaagttaacgacgtcatacattaaaaaacagaacagagtaactatctctctttcataatatataaaagaaatagacttagaccaggtattagaaaaagtatgtaaaattaaacgagagaatgttgtgattgtttaagagaaaaaagtagacaaaaaaaatttaaatattgaaagattgtgattggttgagaaggaaatgtaggtaaagaagttgttatattttagaacaaattttaaatactaatagtagaatttgttttattttaagacaggaacgagtattaatttttgggacttttatggaagcactcaatttccacacctgtcaatttcctccgtgtaatacacggtacagtacctataggtaacggtcaatcgcgatccaataaagtaggagagccaagctcccccatttccattaagagaaatgagcatttgccagatgtttgagggtttctacaaataaaccctttcccagacagataacaggtccagctaagctaaccaagcaaaccctcaaaagatctacctataggtctttttccacacggcaggatggatgctgctgcgattcactagactgcaggcagcttccggccgggtactacactgtggtatagtggtgtccatcttttaactcgacgcaacgcaacattgccctgccttgcttacttgttggatcgtctccatctcgcctgcctgtcacagtgcatacagaaaatagga

SEQ ID NO: 1997 - DNA, 1501 bp, Oryza sativa
gaaagaagtttccatataagaacccaatacgagattaatcaaaattcaaaataaaaataaaataaaatccaaaattagaaaagaaaaggagagcccgagtagaaatacaatttaaaaatagttgaaattcagaattaaatataaacaatattgattgaagtttccatataagaacccaatacgagattaatcaaaattcgaaataaaaataaaataaaatccaaaataagaaaaggtgatgagagtccaagtaggaatacaatttaaaaatagctaaaattcggaattaaaaagaaggaatattaaaagaagagtccatataaaaacccaatacgagattaattaaaattcagaataaaaataaataaatccgaaattagcaaaagaaaataaaagaagagttcaagtaggaatacaatttaaaattagctaaaattcggaattaaaaataagcaatattgaaagaagaatccatataagaacccaatacgagattaattaaaatttagaatagaaaataaaataatatccaaaaatagaaaggggcaattgcaaatttatcactactttgaaccgttattacaaaactgccactagaaaattgcaaaaatatcactagaactgtcattcgagtggcatccttgcaatattgaaaaaaccagtggtaaatttgcaaacgccccaaatagaaaaattaaaagagagttcaagtaggaatacaattttgaaacaactgaaattgaaaatataaaataaaaacattaaaagaacacagtacggtattaactaaaatttaaaaaaaatctgaaattagaaaaagaaaattaagatttcaattaggaatacaatttataaataactaaaatttgtgataaaaattaagattattgaaagaaaagaccatctaaaacacatgacgagataaattaagtaacatgcctataaaggagtagagtggtggcggttgatatgacatataaaaattgttaataaaacacctaatagaatcctaatgacgattaaaaggagggacgtcagacaggccgtgaagtaaacgagtaaggcggttgtcgggacttctagaaagtaaaaaaacaaaccccattgataatcatattcgatttttaaaatctcaatgataataaaaaggagaagcagcgggcggggtgtataagagtatagttgcagagccgccgacggttgacaggacttatagaaaataaaaaatgaattccaacgatagttatgttcgatttttagaatcacaatgataataaagagtaggcggcggacgggctgtagagggtgatgaggacatcctccactattatttgttcagcctcggccaacctcacctgggggcatagtggcatcgtttgatgtgacttttaaaacttaataaaaaattaaactacaagtccaattttaaaggttcggaacttttaaaaagttaaaaaaaaaagaaacccaatgataatcatgttggattttaaatcttaaa

SEQ ID NO: 1998 - DNA, 1501 bp, Oryza sativa
gtgccgttttgacgcaagaggaagatggcaaggaatatatcattacatatttgagccgccgtcttttggatgctgaaacgaggtatgtttttatagagatactttgtctatgcttatactatgcttgtaccaaattgaggcattatttgttatctagtacatgcatagttacttgtcaagccgatgttattaaacacatgttgcaaaggccaattctaagtgggagaattggtaagtgggcatatgctttgatagaatatgatttggcttatgaaccattgaaaactataaaaggccaaattgtatgtgattttatagtggaccatcatatagatgttgcttatgagggagaggtttgcttagttgaagttataccttggaagatttattttgatggttcttcttgcaaagaaggtcaaggcaaaggggtagttttgatttcacctaatggcatgtgttatgaggcatcggttcgtttggaatattattgcacaaataatcaagccgaatacaatgctttattgttcggcttacaagtgatggagatggttggagctaaatatgtggaggcctttggtgattcggaattggtggtgcaacaagtcgccgggatctacaagtgcttggatggatcactaaataggtacctcgattcatgtttagatattattgccaattttgataattttgctattagacatattgctaggtgtgataattctagagcaaatgacttggcacaacaaacatctggttataatgtaaaaagggggttatttctgatattagaagagccggtgcttgattttaaatttttgcgcaaaattggcaaagttggggaccagaggcggtctgaccgacgttgcacggccggtctgaccgtgaccaggggcggtctgaccggccacatgccgccggtctgaccggcatccctgagcggtctgaccggccctgtgtggccggtctgaccggttctaggcagaatgctggggggcacgtttcaagtaattttgaagccgaattaattgtgaattcggacgtttgtgtccaggatacagaagaggattcgagaattcctttgattcaatatttgaaagatcccacatttaaggttgatcgaaaaattcggcggcaagcattcaaatatacattgcttgatggagatttgtatcgtcgaaacatagatggtgtcttgttgaagtacttagataaagatcaatctaaagtggctatgggagaaatacatgaaggaatttgtggaaggagatttgtatcgccgaaacatagatggtgtcttgttgaagtgcttagataaagatcaatctaaagtggctatgggagaagtacatgaaggaatttgtggaactcataaatcggcccacaagatgaattggttgcttagaagagcggggttttattggccgaggatgattgatgattgcttcaaatattatagaggatgcgaggcttgtcaacggttcggcaatgttcaattggtgcc

SEQ ID NO: 1999 - DNA, 1501 bp, Oryza sativa
tactcctgtgtttttggtggatctgtgtaagagcaagttacaaaatatcaaccagccctctcctctcccgggaaaatcaaaatccccccttctcttcgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgaca

SEQ ID NO: 2000 - DNA, 1501 bp, Oryza sativa
cgaaacggaggcgcggacgaggtcgacggcgatgcggcgatgccgagggaggtggcgccgagccgggaggaagaccggagcgacgacggcggcgaaccagagcggaggaaggcgacggcgcggttcgggatgccgagggcgacggtgctccggcagtcggcggacgaagcggagcggcggacggggtcggcggcaacacggcgaagcggatggaggtgtcgccgagtcgggagggagaccggagcgacgtcggcggcgagccgaaggtcgacggcgacggcggagagagaggagcacggcgcgagcacgaatccgacggcgagagcgagcggcgagcggcggaaacggaagagcgaagcacggggagcaaatatatagcaacgggagggggagagcgcggccggggagagaggaaaccgcgcgcggagatctcgggcgccattgaagacgccggcgaacttcgcggggtgaatccggacgaatccgagggagagagagagggaaaagggggggaaacgggagagggaatcacgggggtgattttccccctctttaatgcgcgcggggacggcgggaaacggcgagattcgcggcggcggcggctctagggcacgggctggcggcggcgcggcgggaggaaggcgatgacaagtgggtcccacccgtcagcgagagtggcgggcgggcccgcctgtcagcggcgcgcgcgcgcgggggagctgatgggccgcggggagaggagagagagggagggagagttgggccgagccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacatttatgtaaagaagaaaagtccagtttaaaaagggaagggtacatgtggtatccccttaagagataaaaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaa

SEQ ID NO: 2001 - DNA, 1501 bp, Oryza sativa
ttcttccgggcacgcgatctttccacatacagagagagcttgagatctcaccctaagcccccggccgaactggcaaaggggggtctgcgcggtctcccggtgaggagccacgagctccgtgactgtcatacacacattacgtctcggagtccgtgctgcagctgctcttttctctcttccttttatctctttaaaatatatttatagttggcttatagtctgctattgtatccgctcttactgctcttagtaccagtactaataatgtgagagacggaggtgggagagacggaggtggtgtgaggaacttgagaagacgatacatgtggcatcgggcttggtagattcgaccggatctttgccgaccgtcagcgccaccattgaagacacagtagcaataagagcaagtttaatagtatagcccactactaactttaaatcatttataaccaatacaatagccaattcatacaatagttacttattatactattaatatctggtctcacatgtcatacacacgttacgtcttgaagtttgtgctgcccgctgctcttctctctttttttatctttttaaaatatgtttatagctgactagtttgctaacctgctctaacagatgcgccatggcggtacgggcgacggcgaggcttggtcacgcactctcgcatatgtcaggaggaaacgacagcttacccatctgtagacggaggcgaaaagcggcggcggacgcaaaccgccgcattaaccggagctctcgccgggaagagtggtgggggacaaggatcggaggaaggagaaagggatgtttttcttttcttttcttttgttttttttgagagagagagagagagggagaaggggatgatgattgctgggccacaggttaggatggcccatctaaggccttgcttcgatggcccacctaatcccccgcggcacatgaacgatagattgatcggacggttcacatgtggcccaattcacgagcaaatataaggaaaaagtacacccaaggtccttcactttgtcgtcgagatacaaaatcgtcctcaaaccgcaaaaccagataccggacgtccctcaactaataaaaccattcgctttagatccctcggtggttttgaccccgattttagcctacgtggcggctgagtcagcgtggaacctacgtggaccccacatgtcagcgtgtcacgtcaactctctcttttattgcagtagcagcaacagcaagcagcagctaatctcgccggaagaaaaaccaaagccagaggcgacacgggagtcgtcgtgcttcggcgacagctcggtcggcatcgccgccgccgccgccggtgactctgggcgcggcggcgcgctggatcgcaagctgcaggcggtgaccacggcggtgtacggtgcctcgttgcactccgggaaggagctcctcatccgggtcacgtggacgccgaacgctgccggagccaccggcctcgccgtcgccttcgacgacgcgc

SEQ ID NO: 2002 - DNA, 1385 bp, Oryza sativa
aaaatcgtctcgcggtttcccggcgagttctgaaattagttttttcattcgtgtccgaaaaccccttccaacatccgatcaaacgtccgatgtgacacccaaaattttcttttccccaactaaacacagcaaggtttaaccatgcaccacttagcaatacaattattacaatctattaaaagcacattaacataacatacaacaaagtaaataaataaaataataggaacccctacactaacatgttacaagtcagctgtaaacacatgtgaaaaagagaagagaagagaagagaagagaagagaaggaaaacaatctatatattggtagccagttgtagcacagactctaatactgtacagactctaataacacgtgagtgtataagaggtgagaccatatattaatggtgtaatatatgattatagctaacttagctattagatcagctataaatgaattggagctaatagttggttatattattaaacttactctcatatgctttccctttctcagctccagctcattcgctattcgaagaaaaaaaaaactaccaccaaaatacgcaaaaaataataccagtactagatctcgactaatcccgcgtcacgaacttgctaatcagtcaataaacctaatcaggagacaccaaaccaccgaaaaaaaaaggagagaaataataatattcgcgcatccatcacgaccccaactcgtcctcaatcgcggccacccgccgacccagcgacgacagcgcagggaagaagggaggacgcgacgcgacacgagcgcgagaggaaagcggaggagatcgaggagaaactccatttccccccccctcgccttctccgatttccctcgcgtggaatccccttggactcctccccctcccgccgccgcgcgagccgggcacggcgagcggcgccgccctgcccccgccgatctgctctgccttctcctcaggttcgccgtcttgttggattcgcctttttttgcgttcgtttcgggcgccgtcagatccccgcgccgtgtttggtgagcgtgagctaacggaatggcacggccagatctcgtgggggggatccgaggcggtcggcggatgctagatctggggcggggagctgtacgatcgccgccgcgttagatctggtcccgttgctcgcgccggattccgctgcttttgttgttcaaattgttttggtttcgagctttacctttgcgggctattgggttggatgctccgtgatgcttcgaagctacgggagaatgttagtgatgatgcttttttggatcttatggacgaattttatacaggggcttgcaccgaggaggaggaggaggagagagctgagcagaacaagctagattctcaaggaagggcgcca

SEQ ID NO: 2003 - DNA, 1501 bp, Oryza sativa
tcgtcgccgtcgccgacgtcgactccaagatcaaggacgccctccgcatggccgccgacgccgccgtcaaccgcaccgccctcgtcctcctcccccgcaactccatctccaaggttctctggatggccaacctccgccccacctcactgcccagtaagcttcttctacctcaaagctctaatccgccattgttgcattacatcaaagctctaaccattcgggaaagtgaattcatacctcgaggggatatcccctggtttcgtgaatacacctaaatagtcatcaaaaaatatataaaaaaaattagcaacataaattaatatgaaatatatcactccataaacacataagtttaaattcaacttctataagttataacaaaaataatagatatagttgcgaatgtgcgataactattttcagtttaatttgttatctttgttgcaatttatagaagttaaatttggtcttgcatgtttgtggaatgatatatttaatattaatctatgttatcaattttttttattttttttataacaatctagatgacatgcaaaccacgagtgtatcgagggatgaaaatccagatcctaaccaatccatggatttcacgcagactggaacaggatgcggatctcggtgaacatcatcacgcagaaccgggccaagtcgctgcggcggctgctggcgtcgctgcgggacgcctactacgtcggcgacgaggtgccgatcagcttcaacatggacagccgcgtggacgcggcgacgctgaacgtcgtcaacgccttcgactggccgcacggcggcaagacgctgcggcggaggatcatccagggcgggctgatccgcgccgtgagcgagagctggtacccggcgaccgacgacgactacggcctcctcctcgaggacgacatcgaggtctccccctactactacctctggatcaagtacgccctcctcgcctaccgctacgacccccaggtctctctccctgagctctcctccatctccctctacacgccgcgcctcgtcgaggtcgtcaaggagcggccgcgctggaacgccaccgcgttcttcggccgcagcaagaaccaccaccccaacaccccctatcttcaccagcttccctgcagctggggcgccgtcttcttccccaagcactggcgcgagttctacgcgtacatggcggcgaggttcaccgaggatgccaagcagaatccagttcagatacctcggtcccgcaccaatggctggcaggcgtcttggaagaagttcctcatcgacatgatgtacctgcgtggctacgtcgcgctctacccgaacttccccgaccagagcagcttctccaccaaccacatggagcccggcgcgcacatcagcgccaagggcaacgtcgtcaagcacgacaagagggacttcgaggtgccgctcgtcgccgacgacttctcgccgctgctccccgccgggaggatgccgccggcgtccaagctccccgtgctca

SEQ ID NO: 2004 - DNA, 1501 bp, Oryza sativa
tagccatcagtgcatcgctttcatgacggtggaatattggtataggttaggtgcagagacttggacgctaacacggtggaattgataaaaattttcaagctaatcatatagttttacaactggtcgaactatattaggtacagcttttggatggtagtagcatatacatagcttcctctatttcgacggctaagctgaaccaacttagtacggcacatgctacactcttttgcgtactaaggttggatagggtgagactatcaagaataaaaagactccttttgaatccttgaattttacagaaatttcaaatggattagttcaattccaaaaaaaaaaaaaattctataaattcctccattcaaggaatgcaaaagttagatgaattctgccaataaattttttaattaatatactagaagagcatatttttcactttgtttttaattttatattataatatactttttatattgtttttgtattggtacaatgtacatgggagaaaagcaagcaagctgcttagtttaattaggagtacacagtactatgctcttttgtgacctgtgagctgtcttgtaatactgacctggcgtcgcctcatgaatccgacgtgccactggccagcatctctgcggccagctggcacaagctgacaagctgtagccatcgccacgtaggatgggtaccacgacaaaaaatgacttgcattgctttttgcaagtgtttgtttagtcgccactactgtcgttgcaacttcttaatcacccctactttgtgtaccaatgtatgtatatatgcatacacgccccaagatggagtacattaattactagtttcatgtcacaatccaaagtaattatattttgggtacatacagagaaattaattgatttggaagctaacctctacttacatgttttgatggatacgtgtgtaatgtaaggcccttttaattcttttttttttgaaggtagtactatagtgttttgccgtgctggtaatcttgcttctaagatacgtcgttgcatcattattatggcaaatatataatagtaattctactgttttagcagctgcataattaggtgatgggatttgtcaattggatgctggaattgcatgctcaaccatcaaacaaatggtttagtttaaaaaacgtaaagtaaaagggaaatgaaaagatgggaaaaaataaaggaaattaaacatgggatcacgttggttgcatgtgcgccaaagactaagctccgtattctagaccaagtgatgactaactaatttttatagtttatgagcgtgcaaagatgtggagaatctgaattattctttttaattttttttgcaagtggggaatctctagtctttatgtccattttatcactttggaaaatggaaagaaaaataagacaacatcggtcataccgtactacttttgttctcctaaaaaagaaaggaaaacttcaaagtatgtatcactgcacatatgatcgaaaaaaga

SEQ ID NO: 2005 - DNA, 1501 bp, Oryza sativa
gtaatgggacgaataattacttggctgagggataccaaaaaaaaaaggaacatcaatgtcaggacaaaaaggaaacaacaccataagtagaatggatatggtaaacaggctttggaaaagtgagtgaatgcatttaaggtgcaaagaataagcaaaccatttatatcttgcagttgcatatgtgtatatgtgttagcaatcttataaggtgtttgaagaaaataaaggtataccttctctgcttgagaggccctcttctgggaagatagtctgccaccgtgtctactgtaagaatgccagctatggaggccttactgagaccgtgtttttcttggaagtcagcatctcttaaatctccacattcaatgctgatacttctactaagcgaattactgttaacggcgacaaggcaagttctcatgcagccaggtggaaccgaaaaaccggataggagggcaatgtaacgatcaatacgtagaacaaggtccagtggaaaagtgtaatctggaaagaacgagctgcaatgagtatcagctacttcccagcaatcctctagccgcgcatctcgaaccaggatgtctgggctcaaagatggcaacaattcaaccgccgggctggcacagcaaactcctgaaaacaaagtagacattctcatgggcacatgccaaccatgtgaaataaacccagataaatttacagttagctcatacaagaccaacatataaaacactgaatgtttagtgtagtaagttcaaattatcgcgatatattcattttgaggtagcatggtaccctttctaatgacaacactctaagccaaatgccccagttggagcaaggtattcaccaaatactaattcagtcgatttgctaaacgacactcccatcctttggggagaaccaaaccgattgcgtgctgtcaaattaatcttccccggataatccaatactacccaattgtaaagaggattacgattataacctcaattacttatcaatgccaagaaaattggagcggtagataagacctgcagcgggtttggtggcgaaggacgggcagcggtggtgccggacggcgactgcggcggatcggcggacggggtagagaggagaagcggaggcggacgacgtcggagagcgagccaagcttatcgccggcggcatcatggcctccctccccccgcctcggctcctccgctccttcgctgtctctctcctccgatttttaatctactactgtttgcccccacactttccgccttccaaactcgtttacgtaaaataaaattacgccttattagggtgtagcccacggcccacctttccgtcttcgaaaagagtttacgtaaaattaaagtgcgccttgtgaactgtgcagcaactaacaaggcagtggattccggaggcgagcgagagagggagagaggaggggtgggagcgggggcggcgcggcggcggcggtggatggcgatggcgggcggcggggggctcaaccggtcgt

SEQ ID NO: 2006 - DNA, 1501 bp, Oryza sativa
aaggctaatacgccattaaccacccggcgcccgcgccgcttaattccaaaaccctcctgataaaccaaacctggcgcggtacgcaccacaccatcgctacctcatcacgctcacgcgtctccctttctccgcactcctcttcgctctctctcgtgatctcgtctgatcagctccgcctccgcctcagaattcagaaatccccaaaccccaatgctgctgctgcctcgcagtcgcacggcgaatcggggataagcaccggaggagggatcggagatggaggcgccggggctcgtcgtcggatcggcgctgcgagccgcgcaaccgccaccgccacctcctctcccgcgctccccgcgtggcgctgcggatcgcctcctcatcttctcgcgggagcctcgacctcgactcgcccctctcacccggtgctactgttccaggtacttgcttgcttgcgaagttgcggttccactgcgctggcgctcacgcacccgcgcgcactcgtaacatgtggatgtgggtattcgtcaccgtggctttgtttgggcgtttgatcctcaaatcggtgtgtattccagggaggggaagggcaatgctcgcagcaaaccccatcgcgagggctccaattccgttcggtgtgtgctccgccgctcgtattatctctagattctttttttcagttttattttcactatttgacgcagcgagtggttaatttttgtgagtttgtctaggctgaacgtgaaagcaaacaatgaccaggtatgcattaaaacttcgaatctgtaacacgtttccccacatattttacctcatgtacctgcattctcttatggtttaagaggatcatgaatttagagctgatgtcgcaggaaacatatttggctgatgaacgacacgaaggggttgacatctgggagctattcagccaggctcagagaagtaataactacttttttttttttttaaatctgagcttaccattgaaccacaccagagcagtatcatttgatatttggcgtggcatgcttatggcacttttcaattagagtgaaccatttgcatcactttgttgtttgctaaaagaaaagcgttatctgttctgatggcttcaatttcacagatatcctacaccttaacaagcagcggcttgtggccatggaagagctcaagaaactgcaggatgaaaataaatcgcttctgcaggacatagaagtactggaaacagaaaggcaaggtgtggcggtgataccatcctaatgccaagatacttttgtgaattaactgtgaagatagaatgcgagatgtgtaacatcgagcaattcaatcctgtgtttgatgtgatacttctattttctctttatcattgttagcttaagagaataagaggtaaacgacagacctaaaatttgacgctgcattctccttttacatatttcaggtttttccatagaaatagcagaatcatcaaggttctctgagttgcttctgcgtatagatacaa

SEQ ID NO: 2007 - DNA, 1501 bp, Oryza sativa
aaagcaaggattagcattacattaattaagtattagctaaaaaatttaaaaaatagattaatatgatttttaaagcaacttttatatagaaaattttttaaaaaataagaacacagagtaaagccttgtttgcaaacctccttgttccaatataaatattgtactagttgactaggtccaagatccatcatggaagtgtatctaggacgcttaatgggttttagctaattgatgacaaatgtttaatggactaatgcggttaaaaaagttacaatataatatgtttggatttggtttgaataaccggacactactctagtcaaatttgtataattattttagagataatacaagaaatccattgacaagcgtctaaattcaaaaattgccatcgtagaaacggttttgtcctaaaaatgctatcgccgttagagttctttctatcccgcgccattaaatactatatatgatgaacagtgtacttaacagcgtgggggtagaaggaatcctaaccgcgatggcatttttgagacaaaatcgtttgtatgatggtaattcttggaattaacgcttgttgatatcatttcttggatttaaacgcttgtcaatggtatttattgaattatcgcattattttatggcgatgtcatagaggtactgttagtaaggatacatcacaattaatgcaagtctattggatgcaaatagtactacctccgtcccaatataaatgcaattgtgattttctgtgttcaacatttgaccgtccgtcttatttaaaaaaattataaaaaaataaaaaaaatcacactaaaagttttattcatgttttatcatctaaaaacaacaaaaatactaatcataattttttttcaaataaaatggatggtcaaacgttgtacacggaaactcgcaaatgtacttatattggggacggagttagtacgtgtacgtataatctactaccgataaatgctacggcaaaggatacgtttccttcctttaattttgggctggcgttgtttacatgtgcttgagatatatatactctataataatacaaatgtgatgctagtatatattgcgattaaatgtacagtaaatagggatgaacaatatacgattttttactgagaagacatgcatgtacctacactatatatatctggatcatctgctgcagaaagagtgagagttaatgtttgtcgtgattaaaccattaattaataataattccaggttcagtgtggttaattgagaaagttactactagaaaagaagaagtttgggatgaagcccaggcccaccatccgaaactagtagcggtcagcccgacaaagtaggtagcggccgccatgcgtccatcgatcccccgacgccttcctttgtcccgcgatcccggcggtgctccgtccatagctctcttgcctccgcccataaataccacccgcattggcgttcagctgtatcatccaccagcaataacattatattgcagcaa

SEQ ID NO: 2008 - DNA, 1501 bp, Oryza sativa
aatactatgaaaaatatttttgtgagataataaatattacatatataaaaaaaagaaaaaggaaggaagggaggcccacggcccagtgggctggaattccaggcccaagcccaagatgggttgcgggatagataaggactccaccggccgggttcccccatttcgcttcgcttcccccaaaccgcaggcgcacccccaccaaccaaaaaaccacaacctccccctctcctctcctctcctcgccgccggcgccgccgccgccgccgtcaccgccgccttctccctctccagcctctccttctctccgccacgaggtacgcccccgcccccgcgcccgcgcccgcgcccaatcctttccttcgtttgcgttcgtgcgtagggtcggttcccgggttagggttttggccggggcgacagccgacaccgtcgccgtcgagtgggcttcgtggattgcttgcttttgcgacacgccttccgtttgcctccctccgcggcgccaatcctcgtttagggtttaaccccatttcgctgctccggtggttgcgattcacgtctttcttaccttgtctcttgccggggaatggataagtttcttgccgtagccgcggccttgttaggttgtatagctatgtgttttacgaggaccaaatggaggccattttttgccgattagacagggggaacgtgtcgccggatgcaaattgctgtatctttgattacctagtttccatttcattgctttgattacacatgcatatctgatttcatatttggttgctggatgcccatgcatgttcggtaccaggattaagtgcatagactagtgccttctcctctgcatttatgaggattaattctttcaatgaactcaacctgtggacctcaaatatggatcagttagtcataccgccaaatggtacccagcgtgaatctgtttgtacctattgggtcgaggtgtctatgtagtgtaaccagaattaacctaggaacctatcggtacttttgaaagggcaatagtgagctttatgtcatttggtgatgccatttagttgctactaccttgagagtacaactgtagaaaggctgcatattttatttctctatttgaagctggatgctctatctttcttctttttttttttaaaaaaaagttttgcttcatgtgtcatattgcatttctatgtgactatttaccccctgtgtactccaaaatgccataacttatgcatctcgggtttctctctgtactgtaggctaaacaagatcattcattccattagtcataaataaagaccattgttgaatcaaaagagaaataaggtcactatccaattgaagaccaaaaacagggtactgtgatttgttgtacaggataaaagtttgtcgacataatttccggccattggagtactggcaggtgttataccccgaaaggagtttcttgtaaattttctggtgtattgtattggcggctttgttgtttctctggaattggcaataa

SEQ ID NO: 2009 - DNA, 1501 bp, Oryza sativa
acagggccagttcgatgggagagcagacgccattatagtgctggcgtgtatatgctccacaatcctagctcagaaatttatagattatttcgtttaaaaaatatttctctggatatatatgtgcatgcatgcaagcatgcagcaacacatatatagtatataatatatatatatatatatatatatatatatatatataggcagccgcgccggatcgtacgtacgctggtttcttccttgcttaaaatgctcacttggcctggacgttggacttgtacacgctgtcggccttccagccatcagggatggcgtcctcggcgatgatcttctcgccaccctcggtggtgacgcggacggagaaggggcccttgagcggcttgggggtgtctatcctccaaatggcaccccatgactccttgagcgccttccactcctcggagcccttctccttgatttccacctccacgacgtcaccatcaccagcgacgtacttgactagcagcgcaaggtagttggggttggaggccttctcgatgtggaaggtgatcttggtgtcggcaggatacttgcacttgacgcggcggaactgcgtgtcgatgatgccggccttacggagctcttcgtccttgccatccttagccatggcgccgaaggcaaggccggagaggtcaaagtggtaggcagcgatgggctcgtcgttcatgtcggtgacgtggataagggcgggcttgtcggagcaggcctccggcttggagcacttgatctcgaagcatgagccgcagcccttgccgtccttgaagatggggtcgttgccgcaggagttcatgccgaggaagggagccttgtcgacatccttgtacccgcaggcgccgccgttgtccttggggccagcacccttgggcgcaccataccaggtggccttggcttccagccacttgtcgccgtagcttgtcgtgatgttggggcccggtggcaccttgggtggcccgcaggagacggcggacaccatagccgccaccacaacacaggcgagtagaagggaggaggatgccattgctgcaatataatgttattgctggtggatgatacagctgaacgccaatgcgggtggtatttatgggcggaggcaagagagctatggacggagcaccgccgggatcgcgggacaaaggaaggcgtcgggggatcgatggacgcatggcggccgctacctactttgtcgggctgaccgctactagtttcggatggtgggcctgggcttcatcccaaacttcttcttttctagtagtaactttctcaattaaccacactgaacctggaattattattaattaatggtttaatcacgacaaacattaactctcactctttctgcagcagatgatccagatatatatagtgtaggtacatgcatgtcttctcagtaaaaaatcgtatattgttcatccctatttactgtacatttaatcgcaatatatactagcatcacatttgtattatt

SEQ ID NO: 2010 - DNA, 1501 bp, Oryza sativa
tatatgggctttttgggcttacaatatggtagtattaatagtctaatatacatcttcggggccaggcaggtcacccgcgggtggatgtcctccccagccaccgttcccgcccatggccggggccccgactccgactccccgcgggtcgaaatcagtacccacccccacccccgtaggggcaggtccccggccccacgagggaaattgccatccctaagcatagccgatagggcaaacccagctagtatcggctagtattccataccaccttataccgagatatcagcatagatgaaatatataaaattgaaactattcaaacgagcaatgtgaactagcagattgataggaagcttaatatactttaaacggatgagatcttgatataaggggcagatttagatgatccagaaccaaataaggaaacaagacgactaaatcaagtaagatcggctaaaactccgatgctatctctgttagcaatcaaagaaagagctagataaaacgattaaagatagtacttaatagatcgaacctaaccgatgcagcattaagcgtgagaagaaacataagatctaatcaaatcgatgaaaactcattcaagatggtagatacaccgcatagtctagcttgatatcgaagcctaaacctgcctctcgatgatagaggctagccgatgaagtttagatgacgaaaccaatctagactatgcggtatatatgataactcggcggtttacatagacaggattagagtgtcatgaagatgcaagcactaatcccgagaacgcaaacctccataacaagctttacctcttcattggagatcgaacccgatgcagcccaactcgaaagcaataacttgtcgaaacaatgaaaataaaaaagggtgacgatgcgccaaagtattattgaaccgtcgtcccttgattacatggtgtgggtcatatttatattcgaagtacataatatgtccttgctggacatgactcttatctctaacgaaatttaaaatacgaatgagtcccttcaggtggactcttaccaacatatctctaaggaaactgaaaattgtcctaattaatagatacaattgctccgttttaggactccaatcattgcgtggcaatggctatgaagtgcttcgaccaatcccaatgatggacatgggaccatctttcccgagattggttgcatcggcttgactccgtcagatctagcgcttagccgatatgtggcagccgataccgcctatagccgattcatgtggtagccgatgctacttgtaactgatgcgtattctgctttctcgaacggaatttctccaaatcggcttcgactctaactttgaatccggcccatggcattaccaaatttggtcgttaacaaccgcttgtgagcgggtggtacacatgatggagttcatgtgtttggttttatggacctgtttatggtcgtaatggatatatggatatatttatggttatttcttatttaaaatt

SEQ ID NO: 2011 - DNA, 1501 bp, Oryza sativa
taaaatataacaacttttatcctttaaattttatcttaaaatataacaacaacttctcctatcaacaaatcacatcgttaattaatttcaccatttaaattatttacctactttattttctcaatcaatcataattctttctcatttaatgttatctgctttctcaatacgctagcttgcctaactctaaaacgaatgtatagtaactaagtgctgcatgcatgtcaatgaatgatgtcatctctctctcgatctatataaacccctccgcgcaacataggcatatatagctaccttcatatattaagcacttaattaagcagctgtggtgcgagatcgaggcaaatacgtactcatagttaggtaaaattaaggcacccagagagatagagagagagagagagagagagagagagagagcttaattaatttgcagatatatatggcgcacaatggttgtccagctgctgctacacctacaacagaggtattatgttcccatgcatattgatctccattgggtacccaagttctccttctcaatctgtggcccgggctttgatctccatcaataatactatatatctgctctgatagtataaataagagagaaaaataataagtattaacttataatttttaatatataagaattaaccctacatatactttaaaataaatatattaaataaataagtgagataaagagaaaaaagagaggtgaagacaaccttatggatgctacctgtctaataccttctttcccaaatattcgagctaacccaacttagaaaaagcatagaggaagtattagctcgttctaattgtttaattttgaccacctgttaaaaatcactcgcatatctaattatttggcggatagaaaaatattatttcaccctttaaaggataatattttatcttaaccatccattcttcgcatctcttatcttttcaaacctacctcttataacccatttatcaaacacacccatataaaaaaaatcagctattggaaagctaggcatgtacaaaaatctaataatggtaataaatttcacaaaaccatcttaaaaacatatataattttttaaaatatttttttacattaaatttataattttgtgatacaaaatctttaataaattttatagtttgccatagttttatctaatatagttggtggaatttactcaaaatttaatgcgtaaagtgcattgacagttcttaaacttgtaaagttgtgtcatataccacattaacgtcacgtaagatcctgaagaggttgtggcgatttagaatctagatgacacattatgataagttctggagcttggatatgtattttgagagtctagggacccagataacacacccctacaagtttaaggaccgcacgtacaatttactcaaatttaaatttatgtgattagatttgaaaaacgcatcacatagacaaacaacagaaaaagaaaagtaccgttcaaaaaaaaaacagaaa

SEQ ID NO: 2012 - DNA, 1501 bp, Oryza sativa
ctgcaccaaaccctagccccgtcgccccccaccctcgcacgcgcactcgccctcctccctctgcgcgccgccacgctctcctcctcggctcctcccctcacatgcgctgtcgccgccgccgccttgctgtcctcctgccctcacgcgcctctcctcgccatcctcctccacttgcacgcatcgttgccatcgcagactcgccatcttcctccactcgcgcacgtcgtcgtcatcgcaatctcgccctcctccagccatcgtcgccgacccaccgctgcctctccctcccagtgaggtctagaggtcaggtccgccagatccgccgcgccgccgctcgcgtgttctctgtccgctggcgtttgacatgttggttttgcatcatcgatctgctgcagctgtgaaaggtcgacgccatcagtcaaggtgtcgctcccctccctcctgttctaattcctgtccttgcgccgaccagccgaccattagcacagaggccgcaatgtaagtccgttctacctcatcattgattatttcccatgcattcacttgaggttttataggatccaccatcttgccttggtcccattgagttactcatgggttaggatgtatagcagattaaggagaggattggcttccattgctgctgtttgcatccgctttcaggttaagccatccattaagttttatcctcgttgttatggctgcttgcaaggctgcaagattcagatgatgtcctcactgttaaggatggccgcagctctgcaatattcaaatggtaacattcttgctaaaattgccacaaatgatgagataaactgaaatccaattatttcctttaattttaattgcattcgctatggtgcaatgtggtaagaaatccatgcactatagcaatgaagcctgttggggtcatgtatgtatggtcttctcagttgtcgtatttaacgattgctgcttattcttgttataaccaaaacctcgagagatagatcatgatcaaatgatgacatcgccacccatcatcgtactaacgcaatgtatagttacgaatttatgggtaaaataatgataaatgggaatatgacagcacccctttgtgcaggatctttgagctatggatgctaaacgataaaggtggctcacattgaactacaactgctaaaggcttaaaggctaaaggtatggatcttttaaatagaaaatgcagaaggagccttcccctgctgttttcgagggaaaaaaaaaggctaaaggtgtgaatagaacataaaaaactgaaccaatcaaatgacaatttctggtctgttgactattcagtattgcatgaggtttctatttgtgaattagacatgttcataatcaaattgaactacaagaaaaaaaactgagataattttattaagtacacatttggtatgcctgaaatttctgatataatcaaatttaatcgtcattaataacaatttatttggttaaatttgacattactttgcattaatac

SEQ ID NO: 2013 - DNA, 1501 bp, Oryza sativa
gaaagcccagtcgaggttcttctgacctcgacggtcggcggcggcggttctttcgttgcttctctccctagagacgttggcttggcagcacccttgtcgaaacctcccaatcaactgctacaagttcgttctagagtctcttcctcttgtatcagcgtcctagtttgtacaagttggccacgtcggggggcctaggggggagagcggttccatcttctctctcaccctctctccctgaatccctgagatgtggatagagcggggttttgtgtcggttgtatagattgttttgggcgatcccagttgtagctcctttgttggccttgcggtgggcggtcacgcttagcggtggccggtccggtgcaggccttctcctgggtgagtgcttggtgttgtcggtgtgtgggaggtggtataccttttcttttcatggttacggcctcccagggttgtatccttgtatttttttctgctctatcaatatgaacttcacactgtcttatgcgagtcgttaaaaaaaaaaccaccagcaaaatatgcaagctatattctttcaagatctttttaaaaaaccctgaacatcagtgtcctcacatgcaccatctcctgaatgacgtgggaaccctacagaactgcatttcctccaagaaccacctagactacggctgaatccttactacatttcctgaacatgaaactatctttatttaactgtacatggcaaactgaatcccctggaatgcaactgtctcaaggggaaaaaaagaacttttgaaaggtacgtacatttacatctgaaaaacttgttaggcatgggagcaaaaggatcataaaatggcataatttactccagaaagagccaaaactactaaggtcacttcacttcacaagcatcgaaggcccaagttgatttggagtaccatacaaaactactataaattcaagacctagccttaatcatcgtacatactcagcaacataaaaagctgtaatatataaagtaagaagaatataacaataaagcctatgccatggctaaaaacaaaatctaatctcagtgcctgacaagctgtaataaatatgcccatgatatagagaaatagcagccatagaagacgatatcattcataagggcacctataaaccatgacccacacaggaaatgcctctaaacatattaattaatcgtaggatgaagcgatagagggacctacagcagcacaacgaaaatccgttctgacatgatatttgtaaagaccagaaaaatcaattaaccaatgaaaatgactatttccctttgagaagcctaaataagttataagaaaccctgtacctctcatgccatccagtagctaataaaagaaccacgcatgtatacaaagcgagcaacaccaaatgcaagatctccaacaaacacctgatggatgggtcatgcgaagtcagcgaacctgattcatcctgcatagcacagcaatcatatgaccactataaataaacaaaa

SEQ ID NO: 2014 - DNA, 1501 bp, Oryza sativa
gattcattgcggagcaccagactgagaagtggcggagataagcccacgggggtcgctggggagtccatgccttgttttataagggggtgattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcaggatggttgggcctgtacagcatgggtgtgctgttcagtgttgattaaaatttctgattaattactcttaactcttaaccaggagctcgccatcaaccgatccgatgaccgaaatctcattctcgtccaaatccggtcagcaaccagttgaagcgggtgaggtcgaggtcattaccatcgtcgctgtggtggtcgaggtcgtcgttgttgccaccgccgtggtcgaggtcatcgttgccaccagtcatcgccgccgccacaatggttgagatcattgccgccgcgttcttcttcttccatgccggtggtcgcagccggggaaaaggagaggagcgctcgcctcctcactttctccgcgtccgccggcgaaacccgcgctcggcgagggcgacggcgcaagagggaggtggagacggcaaggcgacagcggcagcaccggcggcggaggtgtaggcggcgacgcgaggggaaggcagaggcggtgcgaggtgacggggacgacgcgaggcggaggcggggcccgtcagcggcggcaggagagggacagggttggggggcgagtaggaggaggggagacgggcggcggtggctaacatgaaatattttttaaaaaaaattaaagacaaatagagttgtaccgtagtgtttagcatgggcatattactagtaggactgtagtgggtgaattatagggcagaagatagattggatctacatgtcatttgactgagggaggtcaagtgtaccttctcgttcggcgggacatttgacgccgtcgtaggccggcccataatttaccagtgtgggccaagctcattctaagagaggcccacggacagaagcagaaatgcgggaaccctaaaaggaaggggaagccggagcccccatcccaatctcgattcgccactcccatccccgccggccgccgctggcccctttccccttctccgaccggaccgcgctcctcaggtcagcagctgtgcatctgctgcaccttgatatcatgtttgatcgaaagccgattccttttatttcgtttaatctttgcatatatattgttttctcggtgatgtttgttaggttttcgtgatttcat

SEQ ID NO: 2015 - DNA, 1501 bp, Oryza sativa
tatatgggctttttgggcttgcaatatggtagtattaatagtctaatatacatcatcggggctccgcaggtcacccgcgggtggatgtcctcccccgcccccgtccccgcccatggccggggccccgaccccgactccccgcgggtcgaaatcagtacccacccccacccccgtaggggcaggtccacggccccacgagggaaattgccatccctaagcatagccgatagggcaaacccagctagtatcggctagtattccataccaccttataccgagatatcagcatagatgaaatatataaaattgaaactaatctaacgagcaatgtgaactagcagattgataggaagcttaatatactttaaacggatgagatcttgatataaggggcagatttagatgatccagaaccaaataaggaaacaagacgactaaatcaagtaagatcggctaaaactccgatgctatctctgttagcaatcaaagaaagagctagataaaacgattaaagatagtacttaatagatcgaacctaaccgatgcagcattaagcgtgagaagaaacataagatctaatcaaatcgatgaaaactcattcaagatggtagatacaccgcatagtctagcttgatatcgaagcctaaacctgcctctcgatgatagaggctagccgatgaagtttagatgacgaaaccaatctagactatgcggtatatatgataactcggcggtttacatagacaggattagagtgtcatgaagatgcaagcactaatcccgagaacgcaaacctccataacaagctttacctcttcattggagatcgaacccgatgcagcccaactcgaaagcaataacttgtcgaaacaatgaaaataaaaaagggtgacgatgcgccaaagtattattgaaccgtcgtcccttgattacatggtgtgggtcatatttatattcgaagtacataatatgtccttgctggacatgactcttatctctaacgaaatttaaaatacgaatgagtcccttcaggtggactcttaccaacatatctctaaggaaactgaaaattgtcctaattaatagatacaattgctccgttttaggactccaatcattgcgtggcaatggctatgaagtgcttcgaccaatcccaatgatggacatgggaccatctttcccgagattggttgcatcggcttgactccgtcagatctagcgcttagccgatatgtggcagccgataccgcctatagccgattcatgtggtagccgatgctacttgtaactgatgcgtattctgctttctcgaacggaatttctccaaatcggcttcgactctaactttgaatccggcccatggcattaccaaatttggtcgttaacaaccgcttgtgagcgggtggtacacatgatggagttcatgtgtttggttttatggacctgtttatggtcgtaatggatatatggatatatttatggttatttcttatttaaaatt

SEQ ID NO: 2016 - DNA, 1501 bp, Oryza sativa
aaacgatcaaacatatttaaaaaagtcaacggcgtcaaatatttagaaatggagggagtacataactagatggagaccccatactttaatataatttgccacgagacttctgtgtgattaagtgacaatataatatgtttggatttggtctgaataagcaggacactactctagtccaaatttgtataattattttatggtgatgtcatagaggtagtatgagtaagaacaagatcaatagtgcagctagcagcaagctctaaaattttatcatgtcaagtagagtaacttaaaagccaactcatacaacaagcaaactttatagttagctataatctatcttggtagcatacatacattaaataattgtatggatacatcagagagggttctgtatgggacccacataaacacattttttatcgtctcttctggctgcacgtgagcaatacagtttggggcacggtgcaagcgctggcgccaaaacaagcgctcacttgtttctttctctgagattttatttccttaatctcaaattaagctgataagtaagttttggagccagtttaacagctctatacctgctctaagtagttattcataaatattaatgcaagtccattggatgcaaatagtacttataagggcatgtacaatggttgtcaatagtggtatcttagcggtgctaattagaaatacttgttgacatggaagaaaaagaaagagagaaaaaaatcattgttatgcataacaatggcttaacaacgactcttaatcactataatatggaaatatggttgcatgagtataaaaaaaggaaagaatattaataaaataaatattttttaagttaatgattagagcctttatcgtctcaactattgtaaacatatggtctctaaataatcttgtattgtttaagagaccatactcgcctcaaccattgaacgtgccctaatatgctatcgataaatgctacggcaaaggatacgtttccttcctttaattttgggctggcgttgtttacatgtgcttgagatatatatactctataataatacaaatgtgatgctagtatatattgcgattaaatgtacagtaaatagggatgaacaatatacgattttttactgagaagacatgcatgtacctacactatatatatctggatcatctgctgcagaaagagtgagagttaatgtttgtcgtgattaaaccattaattaataataattccaggttcagtgtggttaattgagaaagttactactagaaaagaagaagtttgggatgaagcccaggcccaccatccgaaactagtagcggtcagcccgacaaagtaggtagcggccgccatgcgtccatcgatcccccgacgccttcctttgtcccgcgatcccggcggtgctccgtccatagctctcttgcctccgcccataaataccacccgcattggcgttcagctgtatcatccaccagcaataacattatattgcagcaa

SEQ ID NO: 2017 - DNA, 1501 bp, Oryza sativa
tgactgccgagttccttacgacagcccgtcatgaccatacaaccggggctaaatacggaggaataccctcccagggaattaacttaggattatatataggcgcggaggaatacccgtactgagctgtcaccatcagctgcccacctctcatccgcaatatataatcccaaataatgatatcccgtaatctggacaccacgtctaaactaccagatactactctaatatcatcgtcatgacatagagtaattgtataagcaaacattatacccgcaccaaagcatctcacagatacgccagccgtatatttagtataacacgaacataatgtaaggtaggtactcatatacacgaaaagtatttcaataccataaatgtataaagaagagtattataataaaagtacaaagcttacaaaagaggaaaggaaatctgctagagccatacccgaactcttccgaaagcttccggactcctgattcctattctatttctattccaccagctagatactactaaactaaacttgagagaaataagagagctattccttgaggtgtgtgagtgaagtgagaaggtgaagtccttttatagctgaactatgacggttgtgacggttggaatggtcggtaatacccttcaacagtcattggggctttatctcaaccgtccagccaaaaccagcccaatttctgctggcggccttctccattgttcttctccgcagacttgtgaattttggcccaatgtgtcgtgttatgtcacgtcctgataaattcatcccaaaataaaaatcattttctaaaaggaataatagaattaattaaaattcgaaaagaaattggcaaacactaaaatatgtacaagaaaaattcgaatatggccggagaatttttgttaaattctccttggtctaaaaggagccctcaaattttacttgaattttcagagcaccggaaatatttattaaacaacaacaacaattaacaaagtttattaaaaagaaaacctaaaaataatccccctcctccctctggcccaaagcctccctctctctctctctctcggcccgcggccaaagtcctctcttcctccctctcttcctctccctctcctcctctccctccttctcttgggcctcctctccttcccctcggcccactccctcctcctccctctgtcccccaggccgcctccccctcctctcctcctgggccggccacccggcccaagccgcgcccctgcccaagccgagcggcgccctcccgcccgtgccgcgcatgtgcgcgcgctgacgacgcgcgcctgaccgatgggtcccacccgcccggtcgtctccttcctcccgcccggcatcctctctctctcttctctctcccgtgaaatctagcgtcgattcctcccctaaatccacgcgattcaaaccaggaattccaaaattgattagggggaattaatcccctttccttcctcttcaattccccctaatttcccccttgat

SEQ ID NO: 2018 - DNA, 1109 bp, Oryza sativa
ggggggggggaagagataaggaagaagagaggaagagaaggagaaaggaggggtaatttggtcaaggagcgtaaaaaagtgggcctcttctcgtctagtcagcacgaaaatattaatttaatggatggagtgtcccatgacaaataatcatatttatagagtgtgtttccccaaaagtgatttcgtgcggtgtaaaaaatttatgttttttttctccatcaattattccgggacgccacagtacatattgcttacgatattacaaggtagatattttgttgggttattccggtgagaacatttttttttcgaacacagagatctaatttctatgctcttcaattcttcaatttagtcaaacttcaattcttctagcacgaagaggaaaataattgttattacatattagttcccatccttatattctaaaaattttagagagaacacggcttggtcagaatattagagcatcaatataagttccacaacgacccgcatagaaaagcttggaacagaggcaaccaacactgttatgttgtttttttctatagtcattacctaactagttggctccactcatgttaaaaataattttagcttcgacactgatctattcgagactattaggatagatggatatgaataaagcagacaggccctacgtctgaagggtagcatactgaatggaatatatgctcgggtttcctaatcgagccaaccaaattaagcttgcaaacaatgctagctagctaccccctctcataagacgcagtaaatttagtctaagtcaaactaccacgtgtctatactacaatatgaaaattgcatattggttagtttgataagttagaatataatttaaaattatgtttccattttaatataatttaataataaaatgtgaaaatgtatatgttatttatgtgaaaatataacggtgttagcaacataatttgcgtggaccaccgtgctactttatataaaaatataacaactcttataaaaaaataattttattaaatctaaccttcaatatatttgatattatgtttgtcagggttacgggtaaggtataccctctacccttcgatatacgtcacgtatcgata

(The sequence listing continues in the following parts.)

We claim:

1. A polynucleotide construct comprising a nucleic acid sequence selected from the group consisting of:
   the nucleic acid sequence of SEQ ID NO:2411, and the complement thereof;
   wherein the nucleic acid sequence is operably linked to a heterologous transcribable polynucleotide molecule.

2. The polynucleotide construct of claim 1, wherein the transcribable polynucleotide molecule encodes a protein selected from the group consisting of a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

3. The polynucleotide construct of claim 1, wherein the polynucleotide construct further comprises one or more cis-acting nucleic acid elements.

4. The polynucleotide construct of claim 1, wherein the polynucleotide construct further comprises a 5' leader sequence selected from the group consisting of dSSU 5', PetHSP70 5', and GmHSP17.9 5'.

5. The polynucleotide construct of claim 1, wherein the polynucleotide construct further comprises a 3' untranslated region.

6. The polynucleotide construct of claim 5, wherein the 3' untranslated region is selected from the group consisting of NOS 3', E9 3', ADR12 3', 7Sα 3', 11S 3', and albumin 3'.

7. The polynucleotide construct of claim 1, wherein the polynucleotide construct further comprises an intron that is heterologous with respect to the structural nucleic acid sequence.

8. The polynucleotide construct of claim 7, wherein the intron is selected from the group consisting of the rice actin intron and the corn HSP70 intron.

9. The polynucleotide construct of claim 1, wherein said transcribable polynucleotide molecule codes for an mRNA that is complementary to an mRNA that is present in a cell.

10. A transgenic plant comprising a polynucleotide construct comprising a nucleic acid sequence selected from the group consisting of:
    the nucleic acid sequence of SEQ ID NO:2411, and the complement thereof;
    wherein the nucleic acid sequence is operably linked to a heterologous transcribable polynucleotide molecule.

11. The transgenic plant of claim 10, wherein the transcribable polynucleotide molecule encodes a protein selected from the group consisting of a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

12. The transgenic plant of claim 10, wherein the polynucleotide construct further comprises one or more cis-acting nucleic acid elements.

13. The transgenic plant of claim 10, wherein the polynucleotide construct further comprises a 5' leader sequence selected from the group consisting of dSSU 5', PetHSP70 5', and GmHSP17.9 5'.

14. The transgenic plant of claim 10, wherein the polynucleotide construct further comprises a 3' untranslated region.

15. The transgenic plant of claim 14, wherein the 3' untranslated region is selected from the group consisting of NOS 3', E9 3', ADR12 3', 7Sα 3', 11S 3', and albumin 3'.

16. The transgenic plant of claim 10, wherein the polynucleotide construct further comprises an intron that is heterologous with respect to the structural nucleic acid sequence.

17. The transgenic plant of claim 16, wherein the intron is selected from the group consisting of the rice actin intron and the corn HSP70 intron.

18. The transgenic plant of claim 10, wherein the plant is rice, sorghum, maize, barley, or wheat.

19. The transgenic plant of claim 10, wherein the nucleic acid sequence expresses the heterologous transcribable polynucleotide molecule in an amount greater than 0.5% (w/w) of the total cellular RNA or protein; in an amount greater than 1% (w/w) of the total cellular RNA or protein; or in an amount greater than 2% (w/w) of the total cellular RNA or protein.

20. The transgenic plant of claim 10, wherein said transcribable polynucleotide molecule encodes an mRNA that is complementary to an mRNA that is present in said transgenic plant.

21. A seed that produces the transgenic plant of claim 10.

22. A method of transforming a host cell comprising:
a) providing a polynucleotide construct comprising a nucleic acid sequence selected from the group consisting of:
the nucleic acid sequence of SEQ ID NO:2411, and the complement thereof;
wherein the nucleic acid molecule is operably linked to a heterologous transcribable polynucleotide molecule; and
b) transforming said host cell with the polynucleotide construct.

* * * * *